United States Patent 10,233,495 (METHODS AND COMPOSITIONS FOR SCREENING AND TREATING DEVELOPMENTAL DISORDERS) - sequence listing, part 186

SEQ ID NO: 1241 - DNA, 1226984 bp, Homo sapiens
cgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttcctgacacttgaaggggttgagccagttcctctcagttctgtctcctaacccgctccaccccgacccagccctcccacactaaggaggtggggggcgaacaacaacaacagcaacaaaaactcccagttacctaagtatctagcaggctgttgacttttttataacttacctttagtcaatgaaacgaccatatttactctattgctttatattaatggaggtcaatgggcttaatgatttctttagtcaagtcatttatttctaagccaatagataatgccttcgtcatagttttctggggggaaagtaactgtgcgtttgttctgcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcaggtaagtgccacccagagaaagatcacacaaggattggtaaggcagtgatcctcgcgcggggactcgagaaagccggtgtgggatcgccttgggttttcccccaagtcttgacagagctgattattacaagactctagagactttggggtttaagcaagtagatgttttaagattgcagccagtaacatcgtgacatgtacaactagtaaagaaggataagacaggtcaagaagaagagaagataatctttcaccattggtcttaggttgattttgacttgaggtggatgaaaggtaactgttcagctatggaggtgggagtgggtttggtgcaagtttaatgacaaggataggtttttgctttccatttggcatgcatgtctatgttcaggtgaattgggccaactaaatcattaagattgtgaagtggttctttaaaaatcaagctatggttttcagtattttggttgtaaattttgcttagcaacagctttttaccctgtcgaaacttaaagtctctctttcgtctcccctgttgctaaggtgctgccatggggcacacaggcagagttattaaggacgttcattccgtttcacagtcgcttgataacagtatgttgctaacagcttgctgtcatattggaaacacccatactaaagatatgtagtataatatgttttctttctacttaatatgtaactcattagtatgtatatacctcatgacttaacatggaccaaaataactgtgttccctggtgaacaataatgcaaaatagacttcccaaaatgttgatgaaaatcaatgttgtcgaattccttgtttgttaataaataaaatagcttccgtaattaaacgtttaacaacagaatgcagtcttcttcatgatattgataaaccactttttcagttagtcctgtgcatcaccttggaatattaatattcttaatttcaagggtcatcacccatgaacactctgtaccttccacacatagaaaatgttgaagtagtccattcctggaaaacagcaatatatagtaatggccattaaatatttgctcttatacttaatgaagtttaattttctttttgcacagtggttagttgtgcaatataaagaggtaatctgctttttcattatgacaagaaatcattaccagtctctaaactttaaagagaatgagttgtccatggatttttagtggattgttatttcgaggaaaaatgttgacatattttcatttagttgttaatatttattatcctttctaataggaattcaactttggtttgaagtatattctgttttgtcattccagtgaaaaaaagaagatggacactttggatgtgaaactttttttgttcttatttacatcattcaacccttgatgtaaaacaggattttaataactttagtagtcaatatgctattatgtaaaatctccactccatgctggtaaaacaggaaaggcaaaattattttttcttgaaatttgctaattcaattaacaataaccatctgaagtatttgctggtatagctaacataaagcgctaattaattttattaatgagattcttacaactttcacattgactctataattttgacccttaatgagaaaattgtttgtctaatagcagaaaaaaaaaactgtgacagtttaactctctgatctgtcattataataattgactgtttccttatttctggttcttctgtagtgcaaatgatacttaatttcaggtaataaagtaatgggtataaaagacatggggtggcaagagaattttcgtatactgtagaataaataactgaaattgattgatattgtatgacattccagtttaataactctatgtagaggctttgaaaccaagtggggaagaaaataagccccaaaatgaatgtcagtcatctactttaatattacctaaataatggttttaaaactaatactttttatagattaaaaaataaaatttaaaaggtaaaaattaattgattacttaatgaaaaatataattcactgtaaaatagaaacagttcattttcattggttttattctattatttattataattagaaggaaaattaggatatgttgtcctcaataagcaagttttgggtaagtaagagttaagtcattaatattgatattggaacaaataaaaagcaacttttaaaacatgcttaatattgtgatgtaatatttggctaatgtatgtgtatattgcaatgttagcaaggtggctaaacacataggttttaaattgaaacataatttggctactgggtaatatgttatttctatttagcaattaatttttaaaggacattttcatggttaattgctaaatgttccccagaacacatttactactatacttctccccaagttgcaaaatattgaggatgaagataatgtgcagatcaaagcactgacagcaataagtactgaggctagtcaaacaagtcacatgcccaaatgagtgaactatttttacagtacttatgtgtaaaacagccaagggttctagttctgagtatcatgtggtagtggtcataagagctgaaaaacttgcactgttttaaatagtttaattattagaaaaggttacagggaaataatttaatttatggaaattcaaaattatggaatggctaattcttttaaaatatacgttatttatattttagcagatgatatcactaataatttttctatctagtattgagtacaaattgtactaattctgcaatctgaagtaaataaaataaagggaagtgaaacaggaaacactgatgggaaccatgtggattaattttcacaatgtttagtatttaacactttttttctctaatctactgtctgattacacattaattgtttgtattttctagaccttcatttaaaaataatatttaagataattttctaatattttaaaatcttctgcatttatgttgcagaaaatgaaacaaggacgtaaaaattaccaagttatttatttcaaagtttttctttttcctttactctcagaaaaccaaagaggatcgatataacagttttaataacatgatacaattaaaagttttttatggtttgggatctgcaaaattgaaatcaagtcactgaaataaatatgaagtttttgagattttaagattttataaaaattatatttttaaatttttatttagatgttacattattataattgtgatgtgttattttcaattgacttaattttgtctttttttgttattgggatgatataagtatctcctttatgtcatttagaaatatatatgtatattaaaagaatctactgataatatatttagctgagaatgattgctatatagtcattgtaaagtaattcttagcttcatttttctgtttaaacatttgaaatgctcctcttctcttgtttcagctgtatttgcattaaataccacttacatatttaggtcataagctgtgagttaggatgatacatagaataatactatattttagaacaaaactactatatccagtcttattgtatttctcttttcttaatcacttattcaagaatatgtgaaaaaaaatctagcaccaaatactttcttttcctaaatacatttttaaaaaccccaaattccaaaaaaagtaactgtaatagtagtttagcaagtaacttggaaataatattaattacagaaataattcaagaatatttagaatatgaagaggatcttgcaattttttaaataaaaatgagggccaaaatcttagaattttaaaacagatcagaactgttcagaatgattttagaagcttatattgtcctagattttctaccacattaaaaaaaaaaaaaaagcctaggtcctctatgtctctttgaaattgtggaaccctattatttatttgaatttcagaatttctatttttaaagtaggactcttcgtgtgtgtcacataacaagatgaataaagtcctgagagctcacaccttatatatggaaaatattgtggggtaatgcattgtttctgtcttgtaaactgtgcttgacagatatgtgactttacctccattaaaaaaaaattctgaaaaggataccttagcatctttgtctaattcatctaatgttaatcagccctacactgcaggggagccttctttttgaacaacaatattttttccagtggcttttaaaacttgttttataacatgaaaataagaaaatatcagataattggtacccagtgtatgcaaactgtcttaggcattttttttttaacatgctgatcactaaagctgtaaaatttatgtctgtgttccttttttagcaaataccttagaatttggaagagctaaggacaggaggaaaaatttacacctacactcaggatggcacattatcaatacactagatatgaaaggacacattagtttgagccacagtggtcttaattagctaagatgtagattttaaattagggttttaaaggaccgtttctggaatttatggaaaatgcattcagaatcactacagggtggcaccacacggaacactgtaacaagtatcttaattatttgctgtgacctggtagatcactacatgattagttcatcacattgccccatgggagacagagtgtgaaacacagtcttctgttcacaatctggtcaaaaaaataaataaataatttttcccctctattcatttctgagttggacaagctgtgctgaatcaattagtttcctataagttttccctgcaaaaggagccaaatcaagttggaatatataggaaaagggtgagaaaggttgagtggtttaaacggtgtagaagaaaggattgaatttttttgtttgtttgtcaggagtagccgtgacaacccttagaaagtttgcagccatgtctctccttgcaacatttttatacaaatgaaagacagctgagggacatcaacaataacattacaggcagagataaaacttaaaatcatgagaaggcatcagaagatgtaagtggaatatagaatcagacttagatatgtttcgtgcatcatgtattcccatttctcccttgattggcttgcttatggggaagagttttagctctggaaacatcagatctttaaaaccatctaaggagaccatgttcttttcttttgctcatatttgcatgtgtttacaaaattactgttattaaacaaaggtgcaagtgtgcaaagaaatggaaggttctgaagatgacagtaaagacacactgtcctaaacttgctctccttatcacctcactgtacagctaatgatttctaaattatctcaaaatgtagtcgtaatgcttgaatggacaacaaaaaacaacagataaaaaacctgtgtgctatggaaatatgtacttagacacataaaatatatctatatagggttcatttaaaggttgtaaagaaggacaagcattcacaaaacttcaaggcatcatgacctctaactttcttcactaatgtgttgatgtctgtcactgcttaacaagcaaaatggcatcagaaagagggtgaacaaataaaggtatatttagggctaatgatgaattcaaggtaaagcacatcaatgtttccaccaaggtttttgcttccagtgtggtagggcaaaaagatgtgaactgaattattggtactctcaaattaaatgtattcattttattaattcatttagcaacagacatacacaggtacatatacccatatccgtagtttcacttataaagaaaaattaaatccacccaactgttttgttttcagcaatatttttaacttctgtgactttttgttttttccattgctttgaatccacaataggtaggtaggggaatttgaagcaccattgaaatgaagtattctagaaaagtatgcagaaagataaagaaaatgcatccatctctagaagtgcttacatctacttagcaagtgtgaaactcacaatgaggatttagtctgttagtatggcacagattataaataggagagtcgctgttataatgtaatataattaacacaattgttcttgttatagagcatgatagtagctaccacctgtcttaaggactggtggtttctcaataagggctaagaaggccaattttgaattatttcaagtattcaaatattcatggactatgatttcaatacttgaaatctagaaatccagagaaaattataataattttgaattttttcattatattaaaaatgaccaaattgttaggtatgccacataagttttagtgaggtggcctttccttttccctcatatatttatttatttttccccaagacaaggtcttactctgccaccccagctagagtgcagtggtgcaactgtaactcgctgcagcctcagtctcctgggctcaagcagtcctcctgcctcagccttccaagtagctgggactacaggcaggcgccatgatacctggataactttttaaaaaattttttttgtagcgacaaggtctcactatgttacccaggctggtctcaactcctactgtcaagagatccccccacttcagcctcccgaagtgccgggattgcaagcatgagcccccactcccagccttgtgcccttatttctgacatgtctccccagctggaaaatccaattgaacttaaggagaaatatcagaatttctgtagtattgggtcttgttctcttttaggtcagagtgtagtctctagaatcaaattatttaggcttaaaaattctggcttagtatgttgtgacatttaagaacttatggctcttccctggatcagttttcttaattagtaaaatgcaggtgatgataccttttttgtagtgttataatgaggattaaacgcttagcatctttaacagtatataacaaggcttaacggatatatatatatatatatatatatatagttattacacacaagtgtttataagcaatcattgcctttaccaaggtaattagtgtttgtttaataaatatttacagctggcttctctttcagaggcattgtcaagacagcacagcagagcaacgtcactggtgtgttgaatgtagtagggaggactgttgaataagccaatagagtcttagaaactaaaagggcatttttcttaacattttggatttcatacttaaggataagttgattattttaatttttttattgtttattacaaaaattactaaaattagttcttgatgtattgtattgaaaactatccaaaagttgaagcttttaataaaaaagaaaagaaaaaaggcaatatttctttgtagtgactactgtcatttcctataaaaataaagtccatgagtcaatataagcatttttttttcttcttactaattacaggcaagaaactgagaactacttttgttgttgctgtttaaatcttggccatgagtttggctggattattcgaggagaaaaaaagttaaaaagtagaataaaaactctcaaaatcattcagccactttatggagttagcatttttttcagtagaattaggggacagataaaacatattgcattgtgcctgttcttcttataaaaattacacagggttggcattaagcaaaggggagttcagatacttcaagtttgtaggtgggcctcatcccttacagaagtatgtaactgtgggcatgctacttaacatctttaaacctcagttccacacgtggaaacacaaaaattacctcataatagggtagctaggagaaataattggattgtatgtttaaattgcttggtacatggtaaataatgagggaagctttacaaatagcaatctatactttcttgactttttagaacgtccattgaaggtagtaaataaccttaaatattgtgtacacctaaaaaagatataataaaatacataaaatctaccactatcaatttttcttttattgttgataccatatttttggatatgcaatatgtgcaccatactgggatagacccagagggaaataagcaattaaaccataaacctgttttcaattaacttcgaatctattagtttaaaaaggcatatgtacactttaatataaggctggattacatggctttacaataaatacatgctcaaattatttagagtttagaagaggtaaaaaatatgtaagttattgtgtgatgattgtatgtggtcccactctaagtcgtctgtacctttaggatttaatcgtccaccaaattcattgacaggttcttctatataactgaattcacaagtaaggaaggcacaaagacagaatttgagtccatgagctctggatttatagaaaaagaaactaattggcaatgttaacagccacattgtttaagggtttcaagatgtcattaggcttgataatttgtccctggtattctcttgattatagttacacacaattgtagaaatttaaataaaattatactagattaaatggtaagactaaatatttaactaaaatatcttatatttttaagacggataatggatactggtgaggtcagcattgatctaaatggctggatgtgggaccctggttggtaagatacaagtcaggagaaggctgatgccctgagagattgaggggacagtcccaaggagaatggaggtagtcaagtgaaataaagcaaagagagaagcagcaatggttattatccaaaaggcaaatttagagtctgtgcttttaatagtttgaatgtttctcctggcagagatgtctgagatttttttcccatgcaaatatcttactactttagagaggtaattaaaaatttctgaaatagtctataaactgtgaatatatatatatgtatatatatatacacacacacatatatatatatattatagatgtcttagctagaaagatgatagatgggtaatcagatatttattatagtttatataatcttatgaaaaagactgacgactataatactgaaaggagatgtcaggaaaccatacagccaccttgtcaataagtaagcaagctacctgtcaacataaatgctgatgatgaccagatacacagagtgaaggaaacaaacaaataaacaagcaagagtgtacttaagcatagtatagtaagtggggatagatgggtgggtggtggtacttattgcaactaatatccagttgccaaaaaatattaagataatatattcataataaaaggataaagtgattataataaaacaacaataaaagtaaaaataaaagtccacatattaataaactttaaggtcacatttattgaacttctaacatttctctgacactgtattaaactgctcttaagtcctcaacacaaatccattttatatatatatatatatatatatatatatatatgtaaaatattactatcttatattacaaatgcaaagagattttaaaaagttgtcaaggtagtacagggatttttctatcaatatcaactattgagattatatgaagttcaccatatattacaactgcatcggaaatatcctaggtcattgcaacaaaagaaatggtataataatttaactgtgaaagtcaatatgcacagtggtgaagggcatggacactagctccagactccctggtgttagttccagttccattatttaactactcaaagaccttggacaaattacttatcttccctgtgtcttagatttctcatttctaaaaagagtataaaaagagtgtctaatggatttagatggtgtaaggctttaataagctaatctgcataaaatgcttagaaaactggattgaacatgataagcaatttaaaatgttatctattattacttgttagaattctagaaaattaagattggaaaaagagaaaaagcatgttcctattattacttgttagaattctagaaagttaagattggaaaaagagaaaaaacatgttcccacacactttctttcatgaaccatcatgaatatgtttccctttttggatacatttttgcatttttatttttattttttgtttctagatccatcaatgcctcttgatatttttgcattttaaagtagtttttaaaagtgtttgaatcatgtttaacttcttctttcactttttaaattcttgagtagcccatacagaaaataatacggcacttgtttcagaagtttttgtaacttgaaccaaggtctcatgtggtcccacctgtcagaagcaaattagatttcaacagagaatgtagctcttcccagaatatgcaatgaacaacgaatgctattttgatgacctttcccctcatatttttagttctgttcttactacatggtgttaatttctgaacatgtattctgccctcagggaaaaaacgatcttttaaattgtgtcattaaatcagtctagttgccaaagacaattctcaaagaatgtctttagggctgaatactttattatttcatctaacttgagttttaacgttgttgttttggttgcatccaacagtcaggtagaattggaaaaatcaagaataatgcggctggagaccatagttgagtaacttgatgaaggaagtgctttctcacgccctcttctagtgcttccaagaaaccagctggccggaaagacaggggaatggaaagctgtgtaaaattaagtgatgggggaaaataaaaatgcttctgttccctagccgagtgaattttaccatttttcagatagcctagcagaatggtgtcagattaacaactatgtaatggaattgtcccccctcttaacttacgtagaaacttttaacttttctttcacaagccaaaggaaattacatttttttggaagatctttggcattccacgacaaagatcttgagttctaatatatgaaatacagagaggaaaataagcatcagggaaaccaatagatagagttcaagaaaagtgcagaaatataagcaagtctatcactttacacctcttctctcctcttcccaacttcttagagccttttcttttcctccttttcctttaaaagacaagtttcacatagggactgattggatcaattattagcccgatgaatagatgaaagatgagacacttcaaaaacttgaatcttttgcttcgtaaaaaacattctgttgaacatcaccgtgtttccaactattagaatgtgtgtgatgtgagaaatatttttcagctcaagtcttctgctattgctctttgttgtcattggtttgtctgtaatgctgggacctgtcagtttattccaaactacgcaaccagaaagtaaatatagcttagttgtgtcaccttaacagaaacaatctttcacaagttaaaagtataaactggtacagtgaaacataaactacctgaaaagaatcattccacattttcctattcagctctcttcgtcgtttttggaaactgctttttccaatcttctttctctcttcaaatctcccgtgccaccacctcttttattatgcttggtaggtagccttccttcatctttcactgtgagtataggattttcatttggggagaaccacgactcatgtcataaaaccagaaagcactgccatttgcatgggtgttttcccaattctctacttgcctcctgttactatggaaaaacatctctagctttaagataaatatggaacctctatccagactatgaatcacaactttctttaggaacgtccacatattttgtttttcttctcattcatttattttcagccttttcctctcaaaacatccctcacaataatatttaaacatgctgaggtttctccccctattggagggggtaggggagccattcctgactttccgtttctacccacctcaggctgaatctgactcctgctaatctgcattaacccctttcgccaatatcatcagcaatctctagttagttgtttcaaagccgcatatcattagtcgtattacttgttagaaattagcttaacactcctacggaaaacggtcttcttcatctgagaagaggtggtgaggtaggagatttgaggggagaagggattggaaaaagcagcttttggaagacagaaaagagagtagaacaggaaaacatcaagtggcgtgtgctggtaattcaggcttctcggtgcacacccctattttaattcttctgtcttcactgccattcccaaccaacacccataccacgtacatttaccagtatcctttacagactcctacttgtgttcttttcctaaaaatatgctcatcgggagtgtcaaccttaaataatgagattcagaaactattaagtatagagtttattcaaatgcaaaacttgagaacagccacctggaaacatggactccaaatgaatgggatcagtgttccaaagtggagaagttaaggttacactttatataggcagagataaaaaagttccaacaaggtcacatttgccatacaagactagtgcatatgccacagctatttgattgattacagactgctacattacaaggaagattactttattactctgtgaatagaggcaatgatctaaggggatcttatggctgccacttaattatttacaggaaataattaattggtcttaattatttacaggaaaaaggtagaagttgcaaccgcatgctctgtgactcagggcgcatagccatactcttctcaaggctcagaaaatttaaagttccaacaactttaagtttgaattatgtaatttcacaggtgtttgtacaattacttcttgttctgcactctccctgggaccatcactcacaagccttcagaatttcagttatcaaatttaggttgttgactcccagactattttctctaatccaaatttccctccttacgatatgaaccacatatgaagctaaaatctagaaacagatatttgaaattatagaagtctgaaattaaattcctttcattccctatacctttcctccttctctgtatcttatcttatcttatctaaaggaagtaacctggatactattccagcattcaagctgaaaggtgatcactgtcttcggtaccttcattatctttactctcagattcaattgaatgctaagtatagttgacccttaaacataggtttgaactgcataggtacacttacctgtggatttttttcaataaatacattggaatttttttggagattttcagaaaatttgaaaaaagcttgcagacaaaccatgtagtctagtaatataaaaaaagttatgttacaaatgcataaaatatatgtaggtactagtctattttatgtgctaccataaaaatacacaaaaatctattataaaaagtaaaaagattatcacaagttataatacacttacagaccatacctggcaccattcacaatcaagagaaatgtaaacaaatataaagatgcagtattgggttataattgcatgaaattaactgtaatacgtactgtactactgcaggaatttcatagccactccttgtgctattacagtgggttcaagtatcacgagcatctgcttaaaacactgtgcgatgctaatcacttggagaagtgagcagttcatctgtctagtaaatcgctatctcagtaaaacatgatatcacaattctctcatatttctggccatgcttagtgtaaaaccataaccttgaatagcaccatgggacccaaattaccactagtgatgctggaagtactcccaagaagcagagaagagtcatgacattacaagacaaagtagagttgtttgatacgtaccgtagatggaagtccacagctgcagttgcctgccacttcagacaattcatcttataaacaaacgaaacaaacttatggtattgataaacacaatgcagtacgctacatgtcttttctcttcctcatgccttttttgttgtttgtttgtttgttagatggagtctccctccatcgcccaggctggagtgcagtggctcaatctctgcttactgcaacttcttctgcctcccaagttcaaacgattctccggcctcagcctcccaagtagctgggactacaggcacatgctactgggcctagctaatctttgtatttttagttgagacagggtttcactatggtctagttgttcgagatcaggctggtctcgaactcctgaccacaagtgatccttctgcctgggcctctcaaaatgctggaattacaggtgtgaaccaccatgcccaccccctcatgactttcttaataacattttattttctctagcttactttactgtaatagagtatataatgcacataacatgcaaaatatgcattaattgacagtttattttattggtaaagccactggtcaaaagtaggctattagtagttaagttgaaagttacatgcagatttttgagtgcacaagaggtcaatatccctagccccagcacttttcaatggtaaactgtactagcagtgcttcctacaatgtctttcttgaattcatccacgtctcgttacaccccttgtgagtgtcctagttgggatcaccttaaaaactttactggacttctgtgagacaccctcagaaggatactctgccaccagcttgctctcaagttcaccctcacagcagccagagctgtttatccaaggtgcttaactgagcaggctactccagtcttaaatctctttattggactcttacagcttcagataaaagcttgttttctttgatacagcttaccccgagtcttcttgatatgcacccacatccaattgatcactatttcactgccaagactccctaagcctcaaccattttgagcttcttttagtttcctgggagtatcatactttttccccctggaatttgaagacattttctctgcagttttgcctggttaatttctacttttcgtcaagcggtctctgggaaactttcctaatctcccatgtttgcattagatacaacagtttgatgttatatcttctttttctgcccttataacggtacttatcagtctgaatatcaactacctgttcaggtagtttattctctattgatcagtaagtttcttaaacatactagtgggtagaatggtggcacctaagaagatatgctcatgtactactccctgaaacctgtgagtattatcttatttggaaaaatggttatcgcaaatgtaattaatttgaagatcttaaaatgcagaggtcattctagattatctgccctaaattttgggccctaaattcaatcacaagtcttcttacaaaagacacactggggaatttgatggacagattaaaagacacagacagaatatgtagatgagatatgaagacagaggcagagattacaatgatgcagtggtaagtcagatagataccaaggagaaggcaatgtgcagacgaaggcaggaattagagtgatgtggccacaagccaaagaactcaagaaatgccaacaaccaccagagctggaagaggcaaggaaggattctctaatagaacttccagaggtagtgcatccctgccaacaccttgatttcagatttctggtctcctgaactgtggaagaattaacttttgtagttttaagctgcctagtttgtggagattggctacagcaatcccaggaagctcatacaatcaggaattgtctatcttttttcctctttttacttagagtgcttagcattatctgaccacaaattaagtacttgataaatatttcttgaaataattaagtgtcaaaaagttgtcttttacatattgaatttatttgagttgagctatatgtatacaaaaaaataagagtatacacaatcaaaatatgtataaatatcatataggtactgccaaacaaatatgaatataagcaagtaaacagttgtcatactcatgaattaatgttccatttgcatatttttgttctgtcaaccttatcctgactaaatatgctattatgtcaagacttgactgatcttgatactgaacattgtaagatttcatcagacatattgacctctgactatgctatagaagatatggattatttaaataactttattaaaaagaagactgtcacagccaaataagccaatgataacataaataacaaaatataaccattgaatttgctctttcttcaattatgcaatttctgttgtataacatttactataaaatgtgtaggcacaatgtgtgtttacatttaaataactaccacggcaatttaggaaaagcttatttttaaaactttactaatctttaaaaaaagcatgtggttgactgagttcattaatacacaatacaagtgaccatgaagcagcacacttcattaaaagaagtaattttgggaatatagactgatatatttcaaggggcttattttaatttgaatgcttcagaccttaagacttctattggtttgattctccagcacaagtcctcctttgaacaacccccactctttttaaggaaatctaccttgagttaggttcatttgaattagcagtcacgtagcagaaacgtagaagcaaggagagaaagggagaaaaatcaaaggtaaaacatgcgaaagagattaggaaaatttataggagctggaatagatatgacaagctttatttggtagaggcatattaaatgcagtgtcttggggaaaaatgtcttactgttatgataattaaataacattgtgtttggtgaaatgattctacaacttttctcataatgctaaattacatcaagcacattaattatatctcctcttgtttgtactagcactacggtcaacttttcatttttaaacttttcattctgacatttctatctactttttacctagctttgaccttctttcatttcacttgcttttgtgttcatttcaatagtgtatgaaaatggttttcaataaaagaaggtttattggctagatttaaatagaaaaagatgttcagaagtattagagggagttgtttaaattggttctttttccttaatgttaccagctcaaaggcattcattaataaaaatatcatttacagatacaattaaacaaaaattatacatgtcattgcacattgttttgtatcataatatttgtatgctaaaacataactttctaatggtgttacctaacaaaaatatgtccttgggtatcattttaatattataagaaaatatgtggatacacttttaggtaactaccctgttttggacacaaaagtatttttttatttttaatactttatatgattgtatgtggttcctgtaagtatatccagttacatatttctacttatttgagacacaatctgtccttgtcttatggtaatatctttgatctggataattgataaatttattatattttatgtagttatacacaatgccaattccctatgatattttccatggaaattggttttcattttcattttactgatgaaatgtaaagattctaatgaaattttttaaaataatgtgtttttaaaatattatcattcaggtaaaacagtcaaatatttgccaccaatatttgctattattataaatataaaatagtaatctgatctatatatgttttcagtcttttaattttttttgtatctcaaactttaaattgggcaggatattcctatttacaattatttatctcatgaattaatttatttaatatgttcttgttttcatatctaccttttattgtcttgtttatggcaagttttggatagtatttttcttccagcactagtgacattgaatagatagggaggtagatagataggtagagagatagatagatagataatatttctatatctacttatataatttgttccattgtcaagaacaataggcatgtgaatacattgcaaaaaaaagtatagagtaaaaaataagaatataaaataaaataaacttatcatttctcattttatcaaacatcatattattccctggtttattggttttatttgagtaagtacaaagtattgagccatgactaacaaaaacatcacttaagattcattaataagattgatttttattaattatgagcccaagcaaaagagtcataaagttaaaggataaaaggtaagtaggtctacactagctggtggtaagcattacacgctgccaactgtgtatttctagacaaacataaacattcaataagcttccaagtccttccatcattagagcaaaatgtttaaattaccctcatttgattatacatcctggaagtcagagatttgtgaacaatttttccatttttaagcagccttaaatgctaattttaatcaatataaaatatcatggaatggtcaaaacctgattttgatgattctaccctaaggcctgtttcacgtgtggcttgattagtgctgtactaagcaatattaaaagtatgtaaatggacaaaattatatatgatatctagggtatagtattaaaagcagctttcttttttatgaatgtgaagtaaagtataaattgcttatcataatggacaagggatgctcaatgaattgctattgactggtgtttaatattttttatgaatttatattttattataaatattattgctgacaacaaatggtatctgtgaatgcattcttggtttttaaatatcttattccaattttaatttgttaagcacactttatgtttagccagaagtttttgaagatgctaatattaagaataaaatagaatcagaggaaaaatgatcttattctctcattaacaaccaaaatacctggctaaaatcttaattattatgacttttcagtcattttcttttctagtagtagattctgcatttttttgagtttttatggtccagagtcatagtcacattttgaatgttatgtaaaatttgtttgtaaactatggtaaaaagaaattttatttccactcttctgctcttctggtttcttagcgtattgtctaaatcataatataatgtccgatttctgtattgttaaattagccttggtgtatgggtttatattagcatagactttgagctatggaataaacttttggtccagcctgttaaaagaaatatattcaaataggggaattattttagaacgtgcttatatatatattttatttttcctatcaaatagctacatttctccaacccataattatcttcatcttttttaaacacactgctctagcaaaatcatttcaaccactgtttgaaaatacggagcaaaatatgcaatgtgatctcctttttataacagtttgcatagatgttttcatgtttttgccacaaaatgagagacttctttctttgaaaaataaaaaaaaagatttcacttacttattaaaaaaacattttttaaagccaagtcctcatatttcctggctttgggataacatttggaaacctgtttgtaagcagatgctatagtgtaaaacattaatgcttatatttcaggaaattatgtgattctaagtataagtattttcaattaaatacagtacatttgctctcacggaattgattgccacttcaaaatggataaaataatcttgcctaagtttctcataagtcagatgaagaaactaagtgaatgtattggccaaaaccacacaatgagttaacattcatgcctcagtttagctcaagtcttaaggttcctgagactcatggagttttccttattacaacattgctttgcgatggtgtcactagtacatctctttttggaaatatcacactggaacttgagattgattggcctgataaatttaggatactgaccctggtaaacacttcaaatgcctttctttgtaggaaaataaacataatggcatgatgtagggttttctttacatttcatttactgagaggatacaatatgtagtggttaatagattttacatttaacacacatttacaatatgcgatggctaatagattttaggaagagggaggaaacactagtgcttgaaaagtgtggatataccatctaaagatgtgtccctagaaaatcatgaaaagtgctcttttctatcaatggcacaggcaagaggggtaaaggacgagaggcgtaagtcagacatgcttagataaaagactcgactagtggctacagagaaaactgatgaaccagggggaggagtactttgttgttgtcttgtttcagttttcccctagactgtggaaatggagttattgtaattgaagaaccttgtagagataacatttagccacaagccacaatatttcatagtagttagcaaaaagagtgagaggcatcagaactaaaaacaacacctagttttaccacttattgacagacaaagaacattctccatgttcttcttgccatctctctctgattgaattttgaaagaaagattgacaaacatatcacttagaaatgaggagtaaattcaaaaggatttatgaggtcataagcacattttgtttaattttctatggctttctatttttatttctgcaagaaaagaatattaatattctactttgaaaaatatacaaagttctacagaaaaatggaaaatttgtttctaaggtcaagtaggatttttggctttgtgtgtctgtgtatgtatatgtgtctccgtgtatctgtgtgtgtctgtatgtctatgcaaatgtatgtgtgtgggttttgtttcactgtttattgtttaacattgttaggtgctagattattttacatttttatttacaactatagtttatttataactatagcaatagtttatttataactatagttttataacctaaatgttactcaagctctaaaatatattacttaggcagaaaggctattattatgtataatgtaacatttaatatttatagtggtcgagatcattatattgcttttttattatttatggatatagcattaatttttaaagcaattgacagtctctaattattcaaatctagagaaaagtgaaaatagtcatgtataattcattaataaataagagcttaaattagctttctatattgttacaagtatatgtctacaagtgactgaatgttaattacttactaatggctaagtacattttatgacatatcttatgttaaagacaacctgtcagatttcttttactattagtgttctcatttttaaataataatagttaacagtagtgataatggtttactgtaaacaaaaataaaaaaatattttttaaatgttattgtaagatagggtgcaatcaattgatagttgaacgaggtagaaaaatattgtctgtaacatctatacaatcattagattttatgtagtatttggagctgaagggaaaatgatactatcacttagccatacagcatcataaaatagtgctagtaatattaaaagtaataaaatttacttcctcaatgctttctcctagcatcctttagtagtgtggacactgaaacagttaatttgatatcagaccctcaagaaaatggggttgggctagatgaaactatctatttttaaattatataaaaatagttggcacatctgattctgtatcccatctttttggcaactacttcacactgcttccaactctgcactgctctcagtcacatccctttttcatcaatgtagaggtgagctgatgaactttgggggcaacaatgaccgttaaacagttgctcaaggccaagtcagtatatttttattttaataattatttattaagaaatactttagacaataaaaagatatgaaagaatagaatgataatatttctactatcatctttgcaaatacaacagaaaaaatataactgaagacaccccagtccttgtcatgtaccacacactatttgaatgctcctcctttctagttctccaacatcatcgtaaatatgatatgattgtattattaattccctgaaatgttttcagatttttaatattttgtttcgtatcccacagaagagttttcattgtttcatgttaacacattcaactttttcagtcttctttcgtgattgtcactgactaccttggagaggggaagttggcattttcacatgagagttgggtgatggctatgatggaagatggtttaaatacaagcaaatagatcaaataagtaaatgttgaaggaaaaggaagctaagtttctcttcattatagaagagagttaatatgtcaagggaaaaacctagaatgaaccctaaggtattagaatggaattggagaaatcaatgtgcattcatgttttgtaatacaaatataaacacaaaatgaatatatatgtaaatgtgtgcatataaatacttaataattacaaaggggaaaagagcaattttacaaggaggaatattggcagacaccacaatgcgtaaatgacaaaatgatcactagtaatagggcaaattgaaattgtgagccagctgattggatgcaatgaaaatgtgttataagttctgtggtattccctccaaagatatacaacctgaatcaaatagtgaaacagcagacatgcccaaatttatgcatgaaataactggcctgtaatcttcagaagggttggcatcaggaaaatcaggaaaaatctaggacgtaatccatactgaaagaagctaaagaaatattacaactaaatgcaaggcatgagagtgaactagatcacatttgtataaaggatattttggggggcgattggtgaaacgtggtgggatctgaggcttaggtgacagtaatgaattggtgttaatatcctgacctggattgctgtattgtggttatgaaggagaaggtcactattcaaagcaatgggacatcttgttagcaacttcatactaaatggttcagaaaaaaaaatatataaatacatattatatattaatattatagatattaattattatatattaatagtaattgatatataatgtatatatttatataatatattaataataaattaataattaatatataaatatattatgtatatttatatgttatatatatttatatatataatatataaaaccacttttctgaagtttaagtttaagattgttttaaaataatgtaagggggaaaacgcccatgaggatagccctaattatgcagcacatttcccatctagaaatatttacccaactctcctacaaaatcatccctgagacattactctcaaaactccagcaaaccctcttttatctttgataggttggcatgttacattactaggttatgaaatgagagtcatatattcttggctagtaggaagctccaagataaatgctgtgtttatttggtgtaactttcttaattaacatttgtgcatgtagtttctcccttcactcttttgtttgtttctttatttgctttattgtgggtttaaaagtttaaaattcattgtttctgtctatttatttatttatttatttatttattttttgagacagagtttcgctctttttgcccaggctgacgtgcaatggcgccatctcggctcactgcaacctctgtctcccaggttcaagcaattctcctgactcagcctcccaagaagctggggttacaggagcacaccaccatgcccatctaagtttgaatttttggtagagagggggtttcaccatgttggccaggctggtcttgaactccggacctcaggtgatccacccaccttggcctaccaaaatgctgagattacagttgtgagccaccacgcccagcctctgtctttgctttttacttttatggtagctacaaagacaataaatattttattgttctccctttttctctctcttctcccttcactctctctccatccagtgccaagagcctcatagatatttagcactgagttaaatatattcactgtacttctttgcagcaaaatcacacaacatatacacttgtgaatttcatttcaaaatatgagtttctaacattagtccgaggtgctttttcatatctccgttgagactggatatatacatgagttgggctaagcaacaaagtgctggtccaggtttgaagcttggcaatataaaagacaaacataaaatgcatagagaatggacacatatctttgattcccagatctttatagggagctacagagtttggtgttcaacagtaaggaatatgctaggtcaggcgagtaaaggaaacacaaggacggttgccttttaagctgctgtgcagggctggagctgcataagcactctagggactgctctctgccgtctaaaaccttcctgtgtctcaagcaccagtttcccggttttatactgagtattctgatgtagagcattccaaggcatgatgtaccatggaaatgatgaagcttaaacataaataaaagtccagagatttttttttttatgtagtagttcagataacataggttatagaaaggcttgcagatatagggatgtgaggaggcacaggtaaaaaaggcacaggctgacattcatgccattattatcacaggaagtaagtaaagagaggagcatcttccaatactgcatgctattagtgctgttaaaatctgctttctcagaattcatacttcagtgaatttttaaatttgttcataaatttgcatatgatgctacaatttctgatttaaaaaaaatctgcctgactggttgatcaggaatttatctggaaggcaaaattttataggacactttttgggatatctgttgatttaagggaaaataaagtctttggtgacctaagttataaagttacacttcataaatttatgtctcttttctactgtctgttgcttagtttctacatgtgtgttgggtttgatcttggtaactctacttatggcccccattcccaacacacacacatacatacctgtacacacacatacttgcacatacgttcacacatgcataggtatgatttaagtctacagattgctagacacagaagggacagcaatcaagggaataacaggattgcagcaaaaaaaaaaaagatgtaataaaaatgaacatgaaaattttgagttaccaaggttaaaactaagtggatgaaaattcacaagcagaaaggtgaaacccaagattccttttcttaatctttctggaccaaatgaaactgctcgtatcatgtcctataggctctttatcatgcctttcattttagcaataatttattcatgagtctaagagacttttttgcatcatttaaatgtatcatatcttgacagttttttcctctcttcaggctcatcctactccattgtaatttatttaagtattttagtgttttagaggattgtggataatgatgcatttaaactgctttagaatgaccttaggctaggtaaattactgaagtagtgccggccagggatatttactttcatggcagtaagcttttactctcttgtttaaccacatggcacacaaagtcaccggctcgctggcttaaaatatattctgaaagagttacaaacaaattttattaacagggaaataactgttataatcttggccctactatagccaatatttaattttacttttcatgaagattgagtgactttatcttgactgttaacagtacaggtttgaaaagcagtgtgtcttagaatagtgctggccttaggcctgggcccatagttgaggtctcagcatctcacagtcatacatgcggaaataaacatattaaagaaaccgtgggcacttgtgttactcggaatcccacatttggagctggcatgctgtgacccttagcactaaacatcagctctgtgcctctctccacacaggccttaagaaaagcttcctcacccgtgatggcccccatcattcttacaaaagccaatgatctgaatgggcacattttgtgatttgtgctgctaacttttgcaatagatactgcttaggagtgtgggtagcctttggagtagaacagtactccagggagagaaaagacaaattaattaactcatcatattattttctctcatagtgcacaaatgcaatagagtttcgtgtaacaatatataactttccagggctccaagccaagcatccttctcttgtttcttatcatgttgcaacatatgtcctaaaatctagatttttctgaaccatcttaattcctcttttttcttaacttttcctcctggccccattctcccccattggaaaattggacatgcttatgtagaaaattctaaaagcttaattactgagaagtagctattgttatctctcaaaagaagatgcatgcaccctttctgcttatgatcacatcagcccacatcatgtttcagtggaaaatgcttgaaattttgtggattctgtttctagaacctccggtacttgtaccaagggtggctgtgaacaaaaccttttagaagattctttccctgctggatctggatctttgaaagcagtttcttttcaggctgactttcctactgtgttatctttccacttcaaatacttatttcaataggctgaacatgtaataaaggttaaaaataatgtagcatatgattatcaggatgaagaattgaaaggagatattaattaatggtggataaagtgaaaaaagaaaacataaatgaaattaccaaagtaaacattcagtgcaatttgatcactgcaaatattatattgaacaactaatatttaatctatgtattggtgaaataccagtaatagaaaacaatatgttagagttaataaacactttcattgttttacaaaaacaaatatagcttaagtgaatattttagtttaagtgaattacttgaaaaacataaacaacaaaaataaccttctcaattttatgtattagtttaaaacatactaccattttatttttcttcataaaatcccaacattgaataatttgatagaagaagaacttaagaaatactaatgaaactagctattcctttaggaggaaatagaaatcatgatataagcagtagtaattttgtaaaaatagtagtatttgatgaaaaactaattatttaaatcaaaatggttaaaatagtatgtaaaatggttaattccagaaaaaaaccttctatgcaaattttattactaataccaggtgctacatcacagcagagtttttttaattgaaaaaataaaactaagtatagcaatgtcctcccaaaactgagatttggcattactgtcaatataaataaaattattttaaaatctggattattacaagattataagtgattcttctaaaataaggcatgaaaataatttcatgaaagtatgtatatttcatgaattatgtttcttttttattatttatgcaaacatcactggcctatcagcagaatacctagatatgtgcaatagtaattgaattttgtctttggaaagacaaataatcttttcacgtacctttcggttttgtcattatgaagttccacatgtcaagagaacagaatagaatatatcttacttacatttgttatttatatagtatacattctaaatatttacaattatagtgtgttgatctttatttacacttttgaatgaagccccacaaatattaagggttggcctgtccttaaaatttttagttgttacatttcttatccttgcttactttttattttctgaaatgcaatccccaaagatgcaattatacacttttaatatttctctggccctcaaagtagacacaaaaaataaagttttggaaataatcctgtctccatgcttggtgtttttgcctgttcttgtgtcactatgaagaaatacctgaggctgggtaatttataaagaaaagaggtttaattggctcatggttctgcaggctgtacagggagcatggtgctgtcatccacttctggtgaggcctcaggaagcttacagtcatggtggaagagaatagagaatcgacatgtcatatggtgagaaaggaggcaagagagagagaaggaggaggtcctagactcttaaacaaccagatccccagtgaactaactgagtgagaactcacttagcaccaagggaatggtactaagccatttataaggaatccacccccatgattcaatcacctcccaccaggccccacctccaacactggaaatcacatctcaacatgagatttggagggcacaaacatccaaacggtatcacttggtggtaccacttattttcactttcaatttattttccactcaaattcatgccacaaacatcttaaaaggccttagttgttgcctgttcaaccatccattcaatatatctgcaattatatttccaattttacaagactgtcatcattgattggtaacaacatcctagttagatcgtgcactttttagaccatttttctttcttctatgaaattagttttattaaaacagaggagggctggtgaggtgactgctagaatgatggaataataaagaaatcttctattagtttagttttaatggttttttatgctaaatttcttggtagctcatatagaggcatcgtagcaggacacactttatgatactacaatgaatattctgtttaaaagatcatttatgtccctaaagtaaaatacaccacaaacataaaaaaatgactatgaagacaattcacataaaaataatgcacaaacgagaagatctacagagcaaggagggacataccttcttgcaatactctgttattgatatggtgacaatgccaagattgttcatccataaaagattactgacattcttgctgctaaccttaacaatggaacaatacagtaactggagacaaatgccaaaaaaaaaacaatttattcttgtttatttagattctacctatttttctacttcttttatatttcaccaaactcttagaattttgtgcttttaaccgcaaatgggcaaactttgcatttactttggtattaagccaggcagtgaggataggctctccccatattgtgtgtgcatgcatatgtatgtgtaatatatttggtgctggtagagaatgaagattttggatgaagatgttggatgaatttactgccaaaaaaaattccaagcaaacaaaaatctacatagttttagacattcacagaacatgctataaataaagatgtctggtggttaacagaatttttctttattatttgacaatcaatagtgtaattagtgctgattttctattaatgattaaagtaagagtagtcaatattgaagcaaaaattgtatatctgtaagaactggagaacaaaactcctttctataaatttctgctagaatttgatattgaagattactaacttcaaaatatctgtaacaagaaacaagttttgtgtttgtgtaaatgctcttctactagcatgcatattatgattgtgttgtgaaatgagacaatgcaattgcaggtgttaaaaagataaggtaactttttgttcattaatatttcttaatgttacctattaaattctaaaggtggaatatcaatcttttttcttctagtttgtttgctgatttcagtggctggggccagtccttgatttggaggatgaaactcagggtcattattatgttttttaaaaagtttcctttaccttcatcttcatcctatggttaactttgctaccattttaccatttatatctaaggtgtattttttttctagataagtgagatgcccatcattgtcactttcgtgttcactgatagaggcaccatcattattttcttgggaaaccctggtagttttgatgtctgccaaatttctgtgtagattgtaaaactcttggtgacattcaatctcatcttcctttttaaattgtgcatttttgttttaagttttattttcagatgtgaggtttggaagagctttagatgaagtaggctaatattatcagacagttcgttgatgtgacagattacgaaggtggaacagcagatatgaccagagcacttttcacttgtgggtgctggatacggagctgtgacaatgtaaaactggagaaagcacttgatttctgtttaggaaaaatgattccccaagaacaaatataacattgagaattgcacttggggtaataggaagcatataaattaatggcaccaggaggggcgctttgtaaagataacaagcaatttagtcagagatggttgctgtggcagggactttctttggagatgcttgtttccagctgattgagatctctgcggtctattgctttcttgctccatttcaaacaatcagcatgaaatagtgtagccagcctatctgcaggtttgctagtctccaacctgtagacattaatcttctgttctccattccatgaataatacttaatgaccttcaatatccaaatgttgaaattacttactgacacacttattcagtcactaactggtttgtgtactaatgaattcatttgccaagcaatagttagtaaatgaaatggtggtattttaataaccttgcaattctgttcaaagctgatacttcttaactgttttgatttttccattcaaaattatcccgtttgattggataattgcatctggaggacaaaattcttgctggtctctttgttctgagcgaaaatctgacagagacaaactaataacttctagatcaaagttgaccgtaggaatatgagttctggaccgaaagaaaaacttgaaatgatgtggagactatttatctattggtttatattaggtaatattgtcatgtcagtgttaatatcaatgtaaaattccagatatatgcttccttttctatattactgtgggaatataggaagtggctgctctgactaggatttcatagtctaactcccttggatgtaaatgtggtcctaagtcttgttcttactaatggaacgtgagcataagtcatatatctcattctcagctaacaatttagaaagtagatgtgctctctacaaccgatttttcccttcagccagtgggatacaaagaaccagaagaccctaagggatggtaaagacacaagatggaaggagaccaagtctccaaattactgcaagaaggaattccacctatcaagcaagacagctgctttgaaatgttatgttaataaggaaaaaaaatcacttgtattcattaaaccactagcatttgaggtttctttgtgacaacagttcttaataattaatacaggcagagtgttccattatgtaattcatgtccaataaattgtgaacatactcatcatcacagctactcaatggtagataaaattttcttatataatatttctacgggagtttacatggtcattcactgtaaattaggtttcagtatactttgagtttgctttatttcacttttcaaatcagggatagataactgtcatattgcctttcccatttattttatgacagatatgaggttctaaaattttaaaaatttttattcatttgtgagtaattttctgatatttcccatcatgtcagtatagtttgactgctgatattgtagttgatccactttatttgcaaattccaaattagcaaattcacctactcactgtaatttatttaaaatcctaaaaccagtatctggagggctttcatagtgacttgcagacagtgcaaagtagaagaaaatttgaatcacctgatgcacctgttccccatgtaaggcagaacaagggaactatttcttatcttctccttacatacaatcatggccataccatggccttacctacaaccatggccagaggaggtagacagtagggggcagtgcagtgtagggcaagaagctcctgcgctggggctcgttggctgcattttgaatttcaattgtagcatctgttggtggagtggcctcagttaagtcacttaacacttcatttatttactcttgtgtaaatttatttactcttgtgacataaagaaaataaaatctaccaatactagatgtatttaggatttaagattgtaatctattatctatctatgtctattcatatctttatatctattcatctctatatatggacatatatagatttttatatatttatagatatatatggatatgtatattcacatgtctctctagatatatctatagatatatagaaagctatataatgatatatgtccctgtagatgtatctatctatagatacataaatatatttatatataatatataattatatgtatttatattatatacacataattatatgtaattatatatacatataattatatgtaattatatatacatataattatatgtaattatatatgaatatagttatatgtaattatacatatacatataattatatagatatctatatctctctctttctctctgtgtgtatatatagatatatatttcccctacgagcaatggtcagtattgctaattcagcatttacagaaactttgtagaacacaccttctgtgagtaatgagaatcgactgtacaagtgtatcttggagatattgcagatttggttccagaagactacaataaagtgaatatcacaataaagtgactcacacatatttttgagtttcccagtgcatatgaaagttgtgtttacactatactatagtctattaagtatacaatagcattatacctgaaaacacaatatacacaccttaatcaaaaatgtttacgagcctccagtggttttaatcattttgctggtagagagacttgcctcgatgttgatggatgctatcagggtagtagttgctgatgatgattggggtggctgtgtcaatttcttagaataagacaacaatgaaatttgctgcattgattttgatggacttgtcctttcacacaagatttttcttgtagcatgtgattctgtttgatatccttttatccacagtaaaacttctttcaaagaggggttaattttctcaaaccccgacactgctttatcaactaagtttatgtaataatctaaatcctttgctgatatttcaacaatgttcacacccttaccaggagtagattctatatcaaaagaaacactctctctctgctcaactcctcatcccttcacgttttatcatgagattgcaccaactcagtcacatcttcaagctccacttctaattctagttctcttactatttccatgacaaatgtagtcacctcctcccctgaagtcttgaactcctcaaagtcatccatgagcattggaatcaatttcctccaaactcctattaatatgacattaccttctcccatgaatcacaaacgttcttgatgacatctagaatggtgaatcctttctggaagctcttcaatttacatgactcagatccatcagaggagtcactgtctatggcagcaacagccttttgaaatgtgtttcttaaataataaaacttgaaaatcaaaattacttcttgatccagggactgcagaatagatgttgcactggcagccatgaaaacaacattaatctccttgtacatcttaatcagagctcttgggtgaccaggtgcattgtcagtgagcagtaatattttgaaaggaattttattttctgagaattttattttctcatcagtaggcttaaatattcagtaaattatgctatagacagatgttctgtcatccaggctttgttgttccatttatagggcacagtcagagtagattcagtgtaattcttaagggctctaggaatttcagaatggtaaggtttagcattggcttcaacttaaagtcaccagctgcattcacctgtaacaagagagtcagcttgtgctttgaaatttgaaaaccaggccttgacttttcctctctatctatgatattttttccctatataaggctgttttgtctatcttgaaaatctgttgtttggtgcaggtaccttcatccatggccttagctagatcttctagataacttgctgcagcttctacatcagcgtctactgcttcaccttgcatttttgttttatatggatggtttctttctttaaacctcatgaaccaacctctcctggcttccaacttttcttccacaatttcctcacatctcttgtccttcatagcattgtagagagctaaggccttgctctgaattaggctttcacttaaggaaatgtgactttgtttgatctatccaaagcactaaaactttctccgtatcagcaataagacttctttgcttttttaccatttgtgtttttactggagtagcactttttaatttgtgtcaagaacttttcccttttttttttaatttgaataaatgtaagaggtacaagtgtagtttttttacatggacatattgcctagtggtgagtctgggcttttactgtgaccatcgcctgaatagtgtacattgtgaagaacttttcctttgcattcacaacttggccaactggcacaagagacccagcttggggcctgtggtggctttcagcatgccttctttattaagcttaatcatttttagcttttgatttaagctgaaagacatgctattcttcctttcgcttcaacacttagaagccgttgcagggttctaaactggcctaatttcaatattgtgtctcagacaatagagaggcctgaggagagggaacagatgggaaactcaggttgttgcagcagtcagaacactcgccatttatgtattaagtttatgcctcttactatcttccttgagatcactcccttaataataataggaagtgctttgtgtaattttcatggagcttgagaggagagatactagggaatgatttcttcttttttcatggacagtataaatgttttgtttgcacagcatttcaatttcactttcaactactttaagtcatctacatttgaaaatagaaataaagaaaatcttgtaagcaattattaagaaaattataaatatgataaaatatgattttacctattaatgtaagtctaaataggtaaatttacattgagaaattaaaaataataatttatttatctgtatacctattattaactgaaaatttacaagatataggaatttggaaaagatacttttattttttctcgtaaaggaagaaggtggccatgccgcaggctgggaagcatagcctctggcaaagaccagaaaaggcacttcaaaggaggaggggttggggcaggagctttatgctaaacaggttggctaaccatacaaatttaactggttatgagacaagctatgaatattaatgaaggcagttctgacacatgctcattgaataaatgtgcatgttgcatatgaactagtggagagttaacattttttggtttttgtttgagacagagtctcactgccatgcccaggctggagtgcaatggtgcaatctcggctcactgcaacctctgcttcccggtttcaagcgattctcttgcttcagcttcctgagtagctggaattacaggcgcgtgccaacacactgggctaatttttgtatttgtatttttagtagagaccaggtttcaccatgctggccaggctgttctcgaattcctgacctcaagtgatctgcccaccccagcctcccaaggtgctgggattaaaaatttaacatttaaatgtattacagttgggccctatgcatcaaaacgtaaagtagggacgtgaagttactccagtgcacagcctctgtaaactggccagaaccagtccatggtcagcgatcttaggaggagaaagttactgaaatcagtctcttattcaatcaaagctgttgttatggcttgtggaacaggggctggagcgcagttaatcagcatctggtgggactgtaaattgttttaatattgcttatctcgaagccagtgcttgtttaactgctaaataaaaaggaaaaccttgtggtaactagaacctagttcattttgttaagtgcaggtgtgtgactttacccttgccagcatggccttaaaccctgtttataatttagcatttcattacgacaaagagtaggctatgttagtcttatgatctctgttttaatgtaaatgctggttagttgtgtctaaactccaaaacaaagagggtataatgaggcgtgtctgacttcctttcttattatggctaggcactcagtttttaaggtttttctggggttcccttggccaagagggggtctgttcagtctgctggggaacctaggattttagatttagtttacactactgaatgctacaaaccattccaggagctattactgggttagttttaaggttcttagccaccccaataattagaggatattatcctaaaacaatgcaattcaagggaatatttatatcgtagagctttaatttcacttttctgtttgtgagcagaactggcattttaataaaggctcagggcatttctcgtagtgtataattcacaagacaaaaattgaagtataagataggaacgaacttgaatgtaaaagtaagagcatttttatttattcactatttctctttgatcctcaaagtaataagtattttaaattatagaactaagttcatactctgctttacttttccatctcatattttaagctgtctacaaacttagctcatcactggattctggcttggaattgttgtcacttcttattgttttctcttttggtagaatcagtcaaaagaatatcatcccagtagaaagatgtgaccaattgctttaaaaaaattatattttgactgaatcaagaaagtagaaggttcatttaaactctgtagaagaaccctcatcagtctctccatattgcttttgacaatgcctgagagactgttatatattatgtttatttttagagtcaaccaatctcttttaacttagactgcaggatgaaaaaagcaataacactctcagatagctcttaggttactgtgagtgagctgaattatttctttctattagaagctgctgtcctattcttcacttcctacagatttctttagaattaacacagaaaaaaatgttatcttttttgggtctattgatgaacttaatcttttcattattgcatgtgaacttaagtcataataaagcaggctgactctgagttttattcatctttgtgtctgaaaggccattgcaattttatttttctaattaaattgatctagacaacagttcaacttcctcaaacataaatatttcaaaagagcttactgccacaagcatccccttcaaagttaaagatttagaatataaactcttgttgactgttctgcttttgaatgcattagaaaatgccttagggaataaaaggtaagcacagagtttcactcaaaagtatttgctttgtttttccaagtaaattcatgctgaaatgcaaaatcagagtctcatattgattacctttcagtgaccaggcaaaaaaatagtaaagaacatttcaaagtttagagtaggaatatatcagaaaatatctaaaggtactgtaattactgaaatacatacagactcaaacttcaattaacaagttagatttcacaggtggaaaacacctgcttttttttctgttgtccaattctgtgctccatttttatttgacttattttatcactgtgttctgctttctatttatgaacaattggctcttattcaaagcagctgatgcccttcttttgcatataagtggcaactattctgaagctgtgaccacaggaagaaaatgtgtggggtggtggtggccgtattcaggtgtgcattgcttaaagaaacttgaaaactatatatagatgttggaaataagaaaatgatgggatgcataaaaagatataaaataccatttgctattcaaaagcatttatcgctgtctaaatattagctttctttatatatatatatatagctttctttatatagctttctttatatttatttatataatgcacaaagttttagaaaagaggcactgtaaaaataggtaacaaattcaattctttgtacgatagcttcacaaattaagaaaacccatgtatcatgatttggggaattattgccacctgtcagtgatatgttaaagttgatatggatgttaattgaatgtggttagagaaaattatgggatgtatcatttacctattagcttatgaattccagagtcatattaagaaaaagataagtcaagtcacttccgggtaacttgcatggatgtaggagttttttgtttttgtttttgagatggagtcttgctctgtcgcccaggctggaatgcagtggcccgatctcggctcactgcaagctccgcctcctgggttcacgccgttcgcctgcctcagcctcccgagtagctgggactacaggcgccgccaccacgcccggctaattttttttttttttttttttttttgtatttttagtagagacggggtttcaccgtgttagccaggatggttttgatctcctgacctcgtgatccgcccgcttcagcctcccaaagtgctgggattacaggcgtgagccaccgcgcccagccagatgtaggaggttaaagggtactcttctctgtctctctgtcataccttttctttcaaaaatatcttattacttcccagagaataatttgaatggcaaaagtacttcattgatgaaaatacagaaacagttttatttaaaactcaggtgagcatttacctgctggtaagttttgcctcctcacaccttcctccccttctttccccttcttacactcagccttcaccttcctttcttttcctatcttttcttcctcctttactgccctttccttcttcccttcttttactatgtgttcattcttttcttttttttctgttctttcttacatttttttttgttttcttcttttccttttcctttatcttgcctttcatttttctctccctttatttttcccaagctttttgcttttttctctcttttgtttagccactctttttttttttttttttttttttttttttgagacagagtcttgctctgtcgcccaggttggagtgcagtggtgcgatcttggctcactgcaatctctgcctccctaggtccaagcgattctcctgcctcagcctcctgagtagctgggactacaggtgcccaccaccacgcccagctaatttttatatttttagtagagaaagggtttcaccatgttggccaggctggcctcgaactcctgacttcagttgatacacccacatcggcctccaaaagtgctgggattacaggcgtgagccaccgcgcctggcctatttagccactcttcatgtctctttctttcttttcatttttccctttcacatagaggccttacatgcagcactggaaataaactaagaaataagagttattgcctttaaaacaatgtccagtaaaatttcacagaaagctacaaataatgactattcattgtgaaatatatatacgcatatactcttgctgggttccctgagggcagatgttggatcttgctcatctctataacctccttacctgatgctgcctagcacagggaagcgggcagtgttcatgtccttcccagataccagtgtctggcctgctgcacccatcctttctccttgtgagtattgcctgcctcatattcaggaaagctgctcttggcccaatgctaatggctatgctctccaaataatggacttcccaggttgcctcaaggggatataagaatcaagtgtaggtacaaagttatgttttgaacatgagaaacggctgcaccagtttcagttgtcaatttccatgcatcaacattcacaaaattgaccccatgataggtatctgctatttgcttgtggactcctgccacagttgacttcctttgtacacaggtgttagatagaaagttgttgctatagaaagtaagtgagaggtacttggataacatcttagtccatttgggctgttataataaacatagcatggactagattacatataaacaactgaagtttattttctatttttctagaggctgggaggtggaaggtcaaggtgctagaggatttggtgactggtgaaggctggcttcctggttcccagaaggctatcttctcactgtgttcttacatggtggagggaacaaagaggctctctggaatctcttttataagggatttaatcccattcatggactaattacctctcaaaggccccacctttaaataccatcacattgaggattaggtttcaaaatatgaattttgcagacataccctttccatccatagcagatgtctgcgtttctatgggatcagacataagctatgctctagctgagacgacatcctggctttattctgcccccacctcctcctgctcccctcacttttttccttgagagcactcccttaataagttacatgcaccccctttcccttattattagcatcttgcattagtgttgtggatgtgttataattaattagccagttttgatgttattattaactaatgtgcatagatttcattagagtttactctttgtgttgtagaatctatgggttttggaagatatataatggcacatattcacccgtaccgtatcatacagaacactttcactgacctaaaaatctcctgcactccaccattgatctctcactcccttcccccaagccccagggaaccacggatctatttactgtctctatagttttaccttttccaaaatgtcagatagttgaaattattagagaatgcagccttttcagattggtttctttcacgtagcaatatgcatttaagtttcctccatgtcttttgtggcttgataactcatttctttttgttgctcaataatattccattgtatggatgtagtacagtttttatgtattcacctattgaaggacatcttggttaatttcagatttgggaaattataataaatgctgtaaatattcttgcacagatttttgtatatatgtaagtttttaacttgagtaaatatcaaggaacataattatgattttatggtaagagaatgtgtagatttgtaagaaacggccaaactatctttcaaaatggctgtggctttttgccaccaggaatgactgggagttcctgttactccacatcctcactggcatttggtgtttgtcagtgttttgggttttagccaatttaataggtaggtagctatatctcattcttgttttaatttagaattatctaatgacatatgaagttgagcatcttgtcacataaattttgcatcggcaaatgttctttgattaggaatctgttcagatattttgctcattttaaaattgaattttcttattgttgagttttaagagttctttatatattttgaataataattctttattaggtatatattttgcaaataatttttcccaattgtgtcttatttttcattccctaaagaatatatttcacagaacagatttgttgttgttgttgtagttgttgttgttttgagacggagtcttgctctatcacccaggctggagtgcagtggcgagatcttggctcacggaaacctccaccttctgggttcaagtgattcttccatctcagcctcctgaatagctggggttacaggtgcccaccaccacacccggctactttttgtattttttttttttttttaattagagacggggttttgccatgttggccaggttggtcttgaactcctgacctcagggcatccacccaccttggcctcccaaagtgctgaggttacacatgtgagccaccccaccctgctgagacattttaattttaataatgtccatttaatcaattttttatgaatcatatatttggtgtcgtatctaaaaaatcaccaccaaactctggctcacctagattctctcctataggaggtttatggttttgaatattatatttaggcctgtgatctattttgagttaatttttgtgaaaagtattaatgtaaggtctgtctcaagtatttttttcgtttgctttcttttgcatatggatgtgcagtgtgagagcaccatttattgaaaagcttattctttattcattgaattctctttgtccctttgtcaaagatcagttggttatatttgtgtgggtatattccttggctttttatttcattctattgattgatttgtatagaataatctattgtcaatgcaattgtcttaattattgtagatttatagtaaatcttgaagtaggttagtagtatcagccctacaacttgtttttctccttcaatattgtcatattctttcttcaataaatacttattgagtacttgtatttactcttctatgagaaatagcagtgattgtgacagacaacagttctgcattcatgaaatttatcatctagtggggtttattagttctacatgcacacattgacttttagtatttaataaatacaagcatgaaaataagtagaggtacattgcatattataaatctcctggttgaatgttagtgtatagtaacatattcatgtacatgtaagcatgtgtacatgaaagtgaaataaactaagtgccttgattttttaaaatgaactctaatgatattttctataatcttgtctccccttgctttctcagtattttatttaaaaaaaaagaagtatattgaaccaaattcctctgtggaatattaccccgaaaaatgctcagtgaacaatgcactattagaagggatttttatagagcaaatagtaggaaagttgtacacaggaatgcagggtaagaaaaaatgtttcagatgtggtggtgatggctttaacatagagaatcttggcttgaagttccaggaaagccataaggagtgggctgataaggttcaacagtaagcagataaccatttcagtgattttaaagtctaactagagaaagctagtgttgggcatggttaatccttggagagtctggaacatagttgattcatcaaaatgagagaaaaattaaatgattaatgatgtgataatagcgatgaggctaaaaagaacattttttgtaaggttatagaagtattatggcaagaattggtaagcctgttcttttgcaagttgatgataaggcaatattactctgttggtaatctaaggttacagtaaattgcacatgagctgctttgcagggctatttttaatttgggatgaagcaagagaaatgccctaatgcatatgtttttgcaagggaataaggacatgggaaactctattatactgagtcatagcagaatttagtgaaccacatctgtgtcttgcctggttcatagctcaggctaatgttttaacctgctcaataataatcactgaaagacatcggtgcttagatcaatgatatggttagtggaaagtgtgtaacaaccatatttatggcatttccatttcctcattcaattaattaattagagatacttgggattttgtttttgttttgtttttaatgtttcatttctaggcatagaaagcaatatagaaattatgtataaagtgttatttatgctctccaaattctgcattgcaaaaagttaggtaaacttaggaattagatggacttatttgtatgatcattttaaggtatagacagttatcttcactgaaataataaaaacatattatcatgttattaatcgtgtgttttgttatcatatagtgttaattctaggaaccactaacaaaggagttttgagtcatttttctattaacagattaatttttttgaagtaaaaatttccagaaatactaggatctctcagcaaggggaagaaatgggcaaacaaaatgactaggttcttattacataaattatttgattaattcagcttagcaaccctatcagatatatgttaatatccacacttttcaggtgtggaatctgaagcctatagatttttttttaattgctcaagtactcatgccaagtaagtaaaaaccaacattatgcaatacaatttgatggctaaaaagtacccatatatttacatacaaattaaactttttacatgtacttctttcacacaccacaaatacaaatgtatcttctttttcaggtttcttaaatcaggaacttgcagttctcttcaaaagcataaaaggaatgcttacaggttcaaaatattgactgaagctaacgttttcaaattattagttacatgcatacaactataaagctcaggaaaaactccttatatttcttttatacaactataaaattaataagatatatgttagtactaaataagatagcaatactagtcaaactttttaataagcccttaatgttaagaataacattaatttttgcagaaatgatattttgtttataatgtgcaatataccggcttctcatatgtaagctttaaaaaatttttccatgtaaatgctaatgtgtctcttcataattcagttctactcaggaactttaattttgagaatacctctcaatgtcaaatgatcttcaacacaggtgtatctttctgtgttccactcatcttttcttataattctctaggattacaagagtactcatcagcttcaaagatggtagcataaatgaaagcacaagagctaatgctctgggccatattcgattatacagtggttatccaggcagttcataatatgcttattgtgttatttatattttaatctaaatgaaatagagcattttaaaattttttgaactcccaatgatatatttttaggctcccagaattcctaagaacaatcttcactcatccatgactaacctgaggtgtcatgaataatgtccccttgagtcccttcaggaagggagggagcatggtgtgtgtggactccccaagattacccttagtcttgatgacacactgcaaggatgcatggaactgagaaaaaaatcggttatactcatggttatagtttattatgacaaaaggatacaggttaatattaacaaagaaaaagacaaaattagaagaaaccagatgtaagcttctaggcagagatagtagagttgcaaaaggacccacgtagttctcccagcaatgttatgtgacagcacatgctaagtgtcatcaatcagtaaagcttacctgagctttggtgtccagggtttatgtttgaggtcagataagcatgtagtgactgcatgactgacttcagctcctcagactgcagccctgccctgcctcccactcaatctctactcccaggaaaaatagacattcaacataggtcacatggttaaggtaaacttatctggtcagattgatacaatatggcctgaggcctcggacatatagaaacactcttttcaggaattatattcccagggctctgaggttatctccaaggagctggccaaaattcagtcctgaagacagacctttctttggaatgttcaggatttgagtaattcagacctactgagttaaccttttactgtccacataagaacaccattatttgattaaataatccataataatgtttgtcaccacatatttagcttatagaatgtgtcaagccctgttcaaacattaccttaggtttttttctcaacaaatacaatattaaatccatttgctgatgaggaacataaaatcagaaaactaaatttcccacaccacatggctagtaaatattaaagctggtatttgaacaaagttctatttgattttatagtcttgctctactccctctaccatatacattgcagaaatttggaccttcatagtctataggagaaatatccagtaaaataataggacctagagtcaatgaatgcaatatatattgtcatggctttgcttaagcaccctgacaacctggctttaatcctcactcctctagattgctcattgtggaacaatcagtataccaactagaaaataaccaccagaaaaaagactctactttataatcctttagccctttcactgaatctgcttcttcacatgtttaacatttttaatggaagctggacattggaaatgacagattttgaggagcattgattatattgtcttccttaacagggtgttgattttatttgaccaatcagtaaattactggtagatactgttcttcctctgaggatgcatttcttaatatggatctgtttcggttctgttccttgtcctggaatgcagcccttaatacagaatatagtcatttttgccttaaagtgtggcttttctgacattacaagtgagtgtcttaggtgcccagtaagatttctcccatctgctgggtgataacgccaattccaaagtcttccagaatagaacaacctctgatacctcctccattcagcattcagcttgtagccataattctccattaggcctctcacagtatcactctgtacctgttcagttcatttctcagccaaagaccccatgaagatttatgaccaacatatctcctgtccaatatcgtattgtacaaattccacccatttctgcaaattaaaactgcagtctaagcctcctcagctctgcaatattgagcatagctccatgtctcattcactgaaaggcgccccagataggaagccagtatgaagagagagtttacctcctgagtgttcctttcctcaaggatcacagtgtgtgctacttctggttcaatgctttaaaattatacccatataattaatctagtttaatagtcatttactacaggaaggccagtccagttaacagttattctgtcagtgttgaagtcactaccagtatgataatcaaataaaatagtttaattgacatttgtaaccctttacaatttaacaccagcttgcttttcctgacctgtctcctctattcacatcagttgagtatgtttttcacttctcaaacacttttgaaactcagtgcatttaagcatatccttcttttttcttgggatgtgttttcctctcttccatcaatcttcctcagtttttaagacccaggaaaacttaccgcttcccctctgaagttgttcccagccactcccactaagtctaaaatcctgtgccacttacctatattattatttatatcatccacagaactttacaactttcataggtatttctgtgtaaatctatcttccaaaataattttgagatatttataaaaacaaatatcatttgtttgtgtagagcaggtattcagaatttaaaaaacatatctgatggtattttttgacagtatgttttacaaaatcgcttatattattaatgtctgatgctattacttaaccactaccactatatgtagtgaccactggccactaatagtgtttactatgatcaattttattaaaggctttgctttaattatttaattatttcacttattctttccaatggtcttatatggaaggtggtatttcttccatactaaagttgagaaatactaggtagacacgaggtaaagaaacttgtggacaataatttagcaagcttgggataaccagtatttcaacctagatttttccattgcaattcacaagttctatactatggcaatttatgtaacaggcagaggtcttcagaaataaattagaattttatttgagagataatttttgaaatgtcacattccattattagcatattcatatgtagaattattgaagaagataatatgaatgaaagtaatttgtctttggtagtagtttttcattctttagggaaaagcattaccaggccattgatttgagatgagactgcagaaacttagaaaaataaaacctcagtgtgaactgagcatctgtttaatcatgtattaatgaaatttatttaaagtctgaaatattctaaatacatgttaatttatttaaattctgaatatataaaactgtttttgagaatttggaaaatatattgtaattatcatattttagaaagtaagcaagcaaatactagcatcttacttaaggagaaatgagatgaatagactagaccaaggctttttttaaacgtaaatgacttatggtattgaaattatgccttattagaaagtcgactgcattttataaagaatgtcatattttatgtaataatgtaattttaaatatcttgactttagtaagactgaatattttcctttgtaaatatttgcttaaattatattttgttagtggtatagagtcaactgatcaaatataataacctaaaaagtcttaagtgtatgaatgtcatttattttattagcccccaaattatctgagtttttctcaggacctatataattagattttgaattagaatgtattgattataagtgaatacttcaaagtgattgatattttcaaaatgcatattgtgaagaccaaaatatatttgacaatagagatatggagtaatgtgtcatctgaagaaacagaaattttaccttacaaactcttatttcaaagaattttgtatgtaggaaagttaggtatctaattcactgaaaactaactagcattggcttacaggattgaattgaaggcagacatgaagttgcgtgaaataccagtcattcaggaagtgaatgaaataccatccttgaaaggagtacaaggccctagaattaaaaatggtgataaatatggaggattctcttttatttcacttgactgaagaaactaatcaataaacatattttttatgatcaatgtcaattgcctttttgggatctattgtagacctctgtgtttaactaatataactatatggttttctattatttcatatggagagactagaagagtggtgtttttgtaaataaaagaaatagaatttctgaaagaagctaacttcaattcatgtatttttggtaattgctaccctgttttctttaaaatagctaagacattctggctctagttttttgccttcagactttttgatctgttctcattacattcttggtgatctatttcatctttctgtaattcagtagctaagtaatatgttacaatagttgttctaaagtttctgtaaaggctttactagattattaaagttaacactgagctggatattcatcattagtcaagaaaaaaattataagtcctccagagtgaaaactcctagtaggacaaagtgcatgcattaaataatgataatacctgaggagaaaaggaacactttttttttttttgagacatagttttactcttgtcgcccaagctgcagtgaaatggcacaatggcagctcactgcaacctccgcctcccaggttcaagcgattctcctgcctcagcccccaaagtagttggggttacaggtgcccgccaccatgcccagctaattttttttttgtatttttgtagagatggggtttcaccatgttggccaggctggtctcgacctcctgccctcaggtgatccacctgcctcggcctcccaaagtgctgggattacaggcgtgagccatggcacccagaaggaatacttttaataccacttctaaagtatgtcactgaaatatctttcatagtttgttttgttgattatttgtgaaaatataaaattttgtaagtactttaacattctcactcttgtaatcctacttaatatcttatctttaaaggaaataattatctatagaataacttctatgtttataacacagatttaggttctgaatatgattaaattgggagaaacagtggctcgaatataaaaggtcacgattatctttaaggaaaagaaattaagaaaatgaaagacaactcagtctatgataaatatgctcacatatgaggtatagtgattaaattcttcaggaactgaaagaaattagatagcaagatatgctagcatagtcagaaattttatttcagggtacatacagattaaacaagaaggtatgtctatagtgtaacaaaataacattggaagctgtaaattgcccactgaatctttcctgatagtcataccacacagaacccaaattaaacctagtttactttggatacctaggttataacataattaggttcatattagtcctaataaagctaggttttggcttcatttttaagagatgcaatatttaataacacttcccccacagtccaccttctagtttcttacctgcaaggtactgaaggcacttgtgccacttcctcctgctagagattgaaaaatccactaactctgccttaatgagaaagaccaatcttgtccaaacaaaatttgaaatacttaaagataattatgctgaaaaaaatattttaaaaatggagaaaatgggagccagtgaaaagagccataagagaaaagatgggaaacagcacttaagaggtacatataagcattatttgatttgacccgcctgaccagcatgaagtaaccccatctctactaaaaatacaaaattagccgggcatggtggtgtgcacctctaatcccagctactcagaagactgaggcagtagaatctcttgaccccgggaggcggagattgccgtgaaccgagatcacgccattgcactccagcctgggcgacaaaagtgaaactctgtctcaaaaaaaaaaaagatttaatcttggaaacctagaaaaaatgttaagggactgctggcttattcccttgataaatttcaagaaacctggtttctatgagtcaagaaatgaattgtgaaatataatgagagacagacatacaaatgggtgctggctgaaaggtgagcagaaatacagatagggtgagatgagaaagcaacacagaaaaacagtaatggtatgtgagacaggcttatgagaaggtcttcgattgtagaggaactaatagaaaaactgaattgatcaggaagaaaaatataaatttcaaaattacaaaatgatgatatccatcagtaattagttccagaaagtcagaattaattaaaataggttgctaaatgatttttttagagctgtagaaatttaaggcaatcttacatccagatagtttagagaatgttttgtatttcaaggaaaaaagtttttctaaatgaaacaaagcagaaatggaaggatccagttttcaacacataaatatggattgtgtctaacttaatctcttaaacattagatgccaaaagaaaatatgagcaatattctcaggcttttgatgagttatttgagaaggcaaaacttcaatatgcaaaattcaattgaaaagtgagtctaagaatgaatgcccttgctgaaatcagacattttcgtgattgttttctgtcaaataaaatctttttcatgattgcattctgtcaatacatttcatgattgtgttctgtcaaacttttacgtaacaaataagacacttaacaattcaacaattactagaagtaggtggaaggcctcccaaattattatgaagagttggcataattctctgttaaatataaaaaaggctgttttcccaaactcccactaaaaagagacttgttatcaatagaaaataaaggaccctaataatggaattgttatcaatagaaaatgaaggatcctaaattaaataataactaatagaatccagcactgagttaagaagaggagcaggtaatgttgtggtgttttaaaataaaaaaattggacaatatactgtattatataatgtctttcataaatcctctaaggtaattgatataattcaacatcaattaatcaattaaatgtttatttttctttaatttttaaattttttttcttaaatgccagacttacttttatatgatgatatcatttccaattagagtcaatattacagtgaaatattattgaagaaaaaatatatttaaaagctagttataatcattactatttaacattgacttggaatacaaaatgaaggggtaaaattatctcataggaaagtttcttttttctctctctctctttcaaatagtcgattgtatgactagaaaaccagaaaggctcatttgaaaatgatttgaaattatgagattataactgttttagtcagttcagcctgctgtaacaaagtaccatagaccagatgactgacaaacaacagaaatttatttctcacagttttggaggctggaaatctggatcagggtgccagcggggtcgggttctgttgaagacactcttgcacattgcagactgctgacttcagtctgttgtgtcctcacatggtggaaagagggtgagagcattccttgggttcttttttcataatggcattaatcccatttaggagggccattcttatggcctaattaactcccacaagccccatctccaaataccatcacattgggcatgaggatttcaacatgaattttagggagacacacacattcagtccattgtataattacaggtatttacaaaataagtataccaacataattagcatttttataaactaataattattatctactacatttaagaaaatattctattcaacctggtaaaatacttttataatatataaaatatgataagtttaggagaaaatatatagaccctagatgatgaaaactagaaaactctagagaaaatgaagtaaatacaaaataaactatggataaaatgaaagggataccattttgagaggcaacattttcctggatgggaacattcataatgtcaaatgttggttctccaacaatctaaaattgataaatctattaattcaatgtttcccaattcagttgacaaaagggccctaaaggtcatcttgtataataaatgtattaaaatagtccagaaatttctgcaaaaaaagaattagagcacactttcttatctggggaaacagaaccactattctcacaaatgtcagtcaaaaacctgggagtcaccagcgatttgtctttgctccttcacttccaatgtccttctagtcacattttccattctgcttacaaagtaactcaaatttaccacttgtttccatccccgacacctcaattctaaatcagaccactgttggctttcacttacatctgtgcacagctattcatcagtgtctctgcattaatatgtttccacacagtagccagtgatgttttgaaaaaatcaaatgtcatcatgtcacttccctgcttaaaattccatgtggatccaacagatgtcttcagatgcagtccacaatttttaatatgacttaagacagtgttggcattaaaatatattgatgaaattaataaaattctgtatgatcttggctctgcttacctctctaacagctcactactatgctcattcacaatttgctttattcatactaacattattcatttcctcaaaggtctttcatttcagggtcttcatttttgctcttcctgtacctttctttttctctttgtttaacctttgggtttaaatctagaaatctttaattttgaggtgctttttttttttttttgagacacagtgtcactctgttgcccaggctggagtgcagtggcatgatcatagtttactgcagcctcaaactcctggtctcgagcaatcctcctgcctcagcctcctgagtagctgggactgcaggtgtgtatcaccaagcctggctattttgttttttcttttagtagagaaagattctcactgtgttgcccaggctggtctcgaactactggcctcaagcaatcctcctgcctcaaccttccaaaatgctgagattacaagtgtgagctacctctgaagtgcttgctgaattctctgcatttcccattttaagctttcttcatgtttgtctgctccttaccctacgattttgattcgcgtctgtaaacaatagatatctcttttattctttcattccaaactcttgaaatcctaaacaacctgtggatgacggcaaagtcgtctcttctcttctcctgaccctgaatcatcccctctgaaataagtggctctggagtgaaagaagaaaatgcaggacttgacacaaatatccagcagcaaactttcttttctgcctcaggaaattatatttcacctaggacattttgctattgtttatcaaatattctacctcccttgaatcatcttggaacacaggattcttgaatcgagccttctcctcagtaactgaacattctttctttcttttttttttagacggagtcctgctctgtcacccaggctggagtgcagtggtgtgatcttggcccactgcaccctctgcctcccgggttcaagcgattctcctgcttcagcctcctgagtagccaggattacaggcgtgggcccccacctggctaagtttttgtatttttagtagagacagggtttcaccatgttggccaggctggtctcgaactcctgacctcaggtgatccaccctcctcggcctgccaaagtgctgggattacaggcatgagccaccgtgtcttgcctcaaaattcttttctcaactttcccagagagagagcattccgcctcttctagcttaacaacttcatgtaaacgggaagatataacagggtagtagaaaaatctcaggagaaatccaattacctcagttggtatagctaaaagatttcttcagacttcaagctatggggtcaggactatgtttttataattctcagaggaatgccttgtccctatcacagggccaggctctgttaagtaagtgataaacgtgtatagaaagaaagagaaaaggaaggaaagaatcatgtcatacaattagagaataaaacaggcttcttaaaattcaattgaggagctaaacaaaatgaataatcaatactctttaaatataataatttgatttatttcttacaaatgtctctaaggtgaattggacttcttttgcagcttttttgtctgcctcttcctcttgcttggcacacccctgcccatcttccaatattagcttaaatattaccaacctttttgtttttctcccagtattctggatgttttacccatatattatacctttcatacatcttaacaaatttttactgcattgcaattttaacatacctgctatcttgcctcccaaatacatagaagattattgagtccattgactcaagtttcatttatatttctgatatggtttggctgtgtcctcacccaaatctcatcttgaattgtagctcccataattcacatgtgttgcgggagggacccggtgggagataactgaatcatggaggcagtttctgccatattgttctcgtggtagtgaataagtcccccaagttcagacggttttatcagggtttccccttctgcttggctcattctctcttgcctgccatcttctgccatgattgtgaggcctccccagccacatggaactacgagtccattaaacctctttttctttataaattacctaatcttgggtatgtctttatcagcagcatgaaaacagactaatacatttttatcccaacaccttgcactatctggtgagggaacatatttaataagtatttgttgaatacagaaatatgttttatttacttcattttaatctgatatgacggagaccaagagatcatgcaggacgtattcgcttcttcttcactggaagatgagcgttttgtaaatagctgcattaccacctggactaagattatattctgcagttccctttacaatgagtatgattatgtggctaacttcaggttaatggtatatgcctggaagtttcatgaatgatgcccagaaagtatccttaagggagataatacatccttcttgaattccttctttctgtttgctggaatgcagatacgatagaacacaaagaggcctcttccagacgttgatgtggtagatcaaatgtacccatgcccttgatgacaaactgcatttatttacgtaggacaaacataagctcctatctagcttgaactactatggcttagggcgctttacctctcacaactaaaactaaatcttaaccattgatataaatatcaaaataatttctgttaagtgtattttttttttggtcattggtataggttgaattttgtccctcaggaattcatatgttgaattcctaaccctggtgcctcagaatgtgactttattggaagtaggatcattgtagatgtaattagttaggatgaggtcctattggagtaaggtgggtcactaatcaagtaagactggtgtccttataatagagaaatttgcagacagacacatactggaggggaggtctatgctgagattgcagttatgcagctataagccaaggatcttctagagcctaggagggaggcttggaacacatcttcttttacaccttcagaagcagcatgaccctgctgatacttcagtcatggatttcttgtgtttattgagatagtaaatttctgttgtttaagcctctcaaattgtggtaatctgttatagaagctctaataaatgagtacatccatttcttccctagtaatttaagatgaaggaagatcattacacaattaaaaataaaactaatttactttagcattattatattaatgtgtaataataaaatagtgaacaactacattaaaatatgtacaggtaaatacagtagtcccttcttatttgtggggagtatgtaatgatactcccaatgggtatgcctgaaaatgcacacagtacagaatcctatatttatcatgtttttcctatacatacctgcctagaataaagttcaatgtattaaaaaattacacatagtaacagactaacaattactactaatagaacaattaaaacagtatactattataaaagttatgtgaatgtgatctcagatattttctgtaacattttcagactgtagtcaactacaggtcactgcagaaagtgaagctgtggataaggggggactgttataatagaaacaatatagtcaatcttcaatcctcagtgcttcttttgaccattccccccaccccaactagaaaatgcctttcactcccttcgcccctcattaaccttcagcatgacattagttatattgcccgcatccttgtatggaattactaaataggaagaagttaagcaaaaatgtataatgaatgtaagaaagcaatggctctgtgcatactaccattaaaatagtgacacctatataaattatatttaggtcccgaaaaaaacactacaatgattctgtttctttaactcagatcactcaaatattatgttctaatggttattagatttgtcatctgttgtaacaattacattatacataaaatttaataacaacgtagtcaacatgagccttcaaaagagctctacaagttacctgttttcttattaagctaaaagagtagtagagagaaataaatgcagttatgaaagctgtgtgttataaataatccagtgttgcaccctccacaatgatgttgtccatgaactctgaatgtaaattgtagattactttgaaataactaggttagcaaaacagatttagttacaagccaggtgttttcttaagtatgtttagatgcttttttttttgcaactttgttagatatactttgctaaatatatttaaatgaatctttgcttttgtgcacagagcaaagctaatatgttgcttcatagtgtgttggagaaacattttttatttcttgccaaatgagatcattcatggcacacctgacaagactttttcttgaatcatgcctgaagccgtggctgaactatggcctaagccaggtagctgtatttatcacttaaatgtattgccttatattaaattgattttatatattatatacatatgttattctaaataatggcagtttttataaaatttctatgaaaatcgttcctaagaaaagtaatatttgaggtaagatgcctaaagttctatactcaataaagctctaattcaataaagaaagggacttcattcatctttttacaccttaaatatctaggctgccataacaaagtaacacaaactgagtgacttcagcaattcaaaatttattgtctcacagttctgaaggccacaagtctgaaatcaaggtgttggcagagccacactccctttggaggtgctagggaaagttctgttccaggcctctcttctagtttttggtagtttcttgtatttgcatattgttctccatctgtgtgtgtcagtctgtttccaaatttgcccctttttgtaagaacaccagtcatattgaattagggcccacctgaaagatttcattttaacttgaatacctttgtaaaggtcccatttccaaataaggtcacattctgaggtactggatgttaggactccaacatgtcatttttgggggacataattcaacccataacgctctctacatctggcaagatgattgacatggagcttacatccagtaaatgtctattaatagatacacaaatgaattatgggagggaagatgattgaattaaatttacacataaatcgtgaatcctgagatacttattactatcataggaacaagttatatgtgcatatgtgtgcgctcaaggccagcatttaatattggttacagcaaacagaaaaatttttaggccatgcaaggaaaaattcagggatacagccagttttgcttattttcctttgttctatattttaaacaaatgatcatctgttcttttcatcaccagaagaaacaacatattggaccttggcagaaccaatccattagagtaaatccaatgcattcattgatatttactatgttgtatttgttcaatataggatgattgaacgaacttgaatctactataagttcatttatcttttctacgccatatgtacaagttacagattttgtgaattaaatggagataagaataaaattgtgttttgagattttaatcctgcataatttgctttaaatcaagagaaaatttaggagtaaaagcagcagagggtatatttctgtatacccatcatgctcagaatcctgcctagtgtggaaggcaagggtgtaatttgatgagccttttcttgtgttgcctccttaaaggcagttctgaaaactgtatttcttcttggattgatttttagtgtctataaaaactttataatagtgatttatcaatacttctactctctttataagtaattatctcaattacctataaaaaagttatatatgggttctactcatatataacttgtattgtatctgatgtgttttgttaattctatggatcaataggtatatcaagatttcagactgtacttaactatacttttaccagtcttaggtaaggctatatagatagcctttggtaactgctgaatgtggagttgaaggagggacatgacattactattaggttattgaaatgtcaaaaatctttcaatttgagggaaagaaactgaaattaacatatgatcaggaagtcaggtgtttagccaggcttaggaaaacctggaaccaggtgttgaatgccggcagaattctctctttttattcatgtctttttaatcactgttttttagtttctgtctattaacttcctccttttgcactgatgacttgtgttcttcatgtgcacaaacatggttaataatagatttgacacaaaccttccacaattgttaccaaaaacaaatcaaggactgactctcattttttgttttttgtttgtttgtctgtttttgacacaaagtcattctgtcatccaggctggagggcagtggtgcaatcttggctcacggcaacctccgcctcccaggttcaagtgattctcctgagtagctgggattacaggcatgccccaccatgccaggctaatttttgtatttttagtcgagacagggtttcacaatgttggccaggctggtcttgaactcctgacctcaaatgacctgtccatctcggcctcctaaaatgctgggattacaggcatgagggactgcatctggcctcatgttctattttttaaatttcctagggaaaagtcattctagggaaaaattttcattggccagaattgggctatgtatttattcctgatcatcaaccatggctgggagatggggtcccgtaaaatcatggagacacctggtccagccatagggagttgtaggaacagacacttgcagcggaagtattgagtttttgtcctagaacgaaaggagctgagacctaaaatactgtgatttccacagaaacaaaccaacccaagaatctattttaaaaactttctcattctgtaagaagccttgtgctagatcctcaggaaataaaacattaaatatcacagaccctaacctcaaacaatgtacaaacttttgtgagaatggagtaagagaatggagcaagcataattatcaaacatctatagggcaacgaggacatttcctctctgttccttaaaatcaccctgcagaaatgtattcgtttagctgtattataggcaaaaacaaaacaaaacaaaaaacaacaacaacaaaaactatcaccatgaaatagctttacatagaacagtagatgggttcaaaggaatgagagaaatcacatttaagataaacaggaaagggttcacggggaaggtaatgtgagcctttagcgataggtactattttttgatgatgataatgttaccaggaagtgtgggggtccttggttcttgtcttcttggaggaaataattcagccaagagaccaactagtaaaagaagcaaagggcttattaaggaaataagagtagactccaagagaggaatggactgaccgggctgggagcagcccagaaagttctctgttgggtttttattctgctggactatttctttaagttcccacctctgtctccagtctcctcccttgtctttttctactttcctaattctgtcttaagtctttgccttgtccctgcctagttccctcccaggtctgtgggacttccccttactgtcagttgatgcacatgtgtgagcacaggtgatcaatacgaatcctacctaacagcagggcagtgttgctcattaccaccaccccaggaaggttgtatagtggttaaatctgtgcttattgttcttatgtatctcttagaattccattttgccccgtttcccttcttctcagcatgtagctagtgacattctgacattttaactgtggaatgggcaattactgggcaccataaggggcattttgggtgttgctttctgcataggaattttccctcctttctgctcatatctagtatgaatattttgggtggtctctggggcatgggattttccagagcttcctcccccaggtgctttatttcctgctcatggctaactatctgcctactctaacaataagattacagactaaaaccctggggttaaaaaccatgttgtatatttgggcaaaaatgaattatccaatagaggttgaatattgaggcaagtcaagagtaggaaaatagtttaaaactatgtttagttattttaataggaaaataatattaccctacttttaatagataaggattagtagacacaaatgtaaatatataggtgagataagaaggttctgagattctttttgattttctgttcaataaacggattcttagcaaggctgtggcttctctgttactcattttaaaagtagaaatggcattgagatttactgatgaatcatgtgctatggaacagattctgatattttaattatctcagtttgatgttacagaaagacgtcttaaaacaaattgcgtaccaattcttaattaacgacactataatatggtttattactagagttgtactgaagatacacggaggcaaaatgaaatacagaactatacaaatcttttcaaataataagtactacaaataaaagataaatgtcatctacattagtctgaattaacttgataattactttatgactcattttggcattatcactgtttatttagtaaaatatttggttagttttaagagttgaagtaacgtgttagcaaagttagtgaaattgcagaaacaaaccgtctaaccctcaaaaagtcacatgaacggtggaagctaacttgtaacaatgggcagagccatttgctactggaaggataatcagcctcaccaagtcaacttagatagtaaccttagttaagatagtcattttaatgaaaaaatggcatacatcttctgagttgtgaataagaattgtcctcaatcacatctggaattgataaacatatttttgttcagcaagcagagaattacttttgtgaattacatatttcctcaggccactcagccttcggaggcaaccaagggcttatgcatggtaattataatttgatttgattcaaaatttcaaccacgtttgggtgatcttccaaaatagcccccagtctcttacacttcacagttgatgttggaatgctctagtcttgtaggccttttgattattttttctgcttgctctgttgctcctagtttccttaatcccagtgagctactcgaccgccctcattaggctgagaatgtttattggcttaaaatgtatttgtagacccaagatggagctgtctctgtttctccactttcaaaattcagtattagtgttcacagaagttacttttcattcattccaaatttccttcaccatttctctcagaggtccatagactccttgcagacacaaaatgttctggaaactacattaagtgtggctacgaattacccctttctctgagattcaaaatatgtgtaaatttagtcttttcagtcttttttctacacaaagaagcagccctatcttaaatgccattggtagaaatgaactactgcagaatattgactctggatatcagaacatatttcattttaaaccataaatcagctaccacatagggctaagtgaggttcagagggtgtcaagcatgaatccgagatcatgacaggccttcatagaaagtgcccaactgtggcaggcagtcccttcattatacctgtccccagcctcagcattgtggtacagttaaaaagtgttttgttttgtttcttttttaccttctttcatacagtaggagcactcaaaattacctaatgtatcactcaagtgaaaaaaaaaaaaatcaggataacccactaagtcttaactaagtttggctgccttttaagtactatgttaatattggtgatgcttttccggaaacggaactgcttgacctctttcttctttattatagaaaacaaaggataatgagtcaggcagaactaattttaaatgataacaaaataatgattaaaaaccaagttaattttgcatacatcgattgatgttgaaaatgcactaataaaatgactgcaaattagacattgtaagacaagataaacaagcaaaatgagactcatctgtctcagttgcaaaatgaaacactcaaatccattgcctctatcattttgtatttatgtaatactgatcacatcaaacattattctgtttataaatgacttcatatgtgaaacaatgagatacagtggaactgtttataattctagacttctgttcagagtagaactaacaagtgtaatacaggctaaatagatagcatcagtcatttgtgtttttgtttcttggttatgatttcaagatatgtcatatctggatagttaaccgtgtaatttataatccaaaccaggaaacttttgagagtgaaagaagaaactacttatgattatgttggggcaatatgcatctaccctgagtaaaccaggacaaatagtaactttatagacttgtgtaatgaggctttattctatttagctacttttgttttgacagttttgttatattttaattcatgtaaagatgccaacaattacagaactttaaaatcagttagcaatttctaccctgtctctgtacatgtttcattgctttttttcatctattattatcaaatttcagagttctttgagcataaaagtcttcattctaacataaatagtacatttctatttggtgtcaataatacgtatacataaacccttatcttccttcatgtatattatttttttcatatcgcaagacatctttaaaatataaaagcatttttttattgcttatgtctctagttgtttttataatattgttgacttggatacataaagaaatgatcgatggttcatgatatggtatggctctgtgtccccacaaaaatttcatgtcaaattgtaatccctggtgttagaagtggggcccagtgggaggtgattggatcttgggggcagtttctcatggtttaacaccattctccttggcactgttactgtgatagtgagttctcgtgagatctgtttgtttaaaagtgtgtggcacctccccacaaccttgcttctgccccagctatgtaaaacgtgtctatttccctttcaccttctgccaggattacaagtttcctgaggcctccccagaagcataagccactatgcttcctgtacagcttgcagaaccaggagccaattaaacctcttttctttataattttctgagtctcagttattttttatagtagtgcgagaacaaactaataccgtattgaagagaatcacagaataggatgtgattaacaaatttaattcttattgagaattattatttgcaagcactaagccatgagcttgtgcagatattatctaatttttgtccttaaaaatgatgctttgagataggtatgttatgttaattttcccatagaaaaactgaagtgaaagaaaaagtttaccccaaatgacagagcttttaagaagtgaaaatggcatatagaagcaggttcttatccttactattgtgctttttttctacatttttatagaacctgcacgttctatacaatctgcaaattctatatatagctctaaaacctaaagtagaagacggcattaaaaagtcaaattagtgttacagtagccttgaaaataattctgtaatatatcgatcacaatataaaaatggaatataaactcaagttattattttagtacacatgaatatgattagacaattcatcagtttgttcaataaacaaacaaccaatatccactaggaaacaaattttaataaatcatatttcttgtttaaaaaaatgtgcttcacagaacccacaagttgttgaggtaatagggaaaagttatctgtcttaaagtttagtttcaatgtcagggctttcccagaaatattagaaatagttttacctgtttcagctcatgacaatacataatagagcctaagtacaccagctttggcagcctagaagacaacaaagtttatctcaaatctcaacttggattggaggaacacattcttttcaaacaagtattttgttaaatattttgtttgggcaagtatcttttcatcctgaagaaatattaatatattctttattaattgttatgtattaataaacaaccattattgaggcctatctcaatggtggtccatttgttaagagcttactgttatagaaagtaatcagtaacatcatccaaaaccaccctcaaattgtggatgccatacatctaaggtaaaattctaaaaaggaaagtcttccatgtttcatttattttagatccaaggagttcttctcattaacatttcccttggtctttggtgtttgtgttcctgaacctcctcttgttcagcctgatttgtagccttgctgctgtgctatgtttattactgtactaaaacaaggttactttgtacaaataaccagatgcatcctctaagtaggtctctaaggaatgccagtaatgtttcctgaaacagtcatgcattaggcgtgtgaagtctgagaaagccgatcacagggttatcttcccaccatatgaatcagatgtttgttattccttattctgctcttcactatattgttaaatgttaagaaacgattgggaagaaaggctgttaattaacaaaagacactggagaatagatcacccaaagggtagggaagccaattaactggaacagtgagaaacattgtgtgttcaaatccagaattgtgctgaagcaggcacaaaataacaacactcacaagatgacaaaatataaggtgggaagagagtcagacgaaagtagaattgtaaaaggcaaagcagaaatgaaaggtcaatccctatagagcaggttatttacagaactcagtaaagggaaatataggcttatagtaagaagtaactaataaaaaatggagagagcttccccctctgcccaaggaaaatataacacatttattacttaaaaaaaagaaaaactgtcaatagttgaaagtcactttgtcaaaattagtagcattattacaatatatttttaagtccatatggaccagattgtcaattgtaccctgtactaagctcgaaactaaggctcttgggcatttttttctatctcaagtaagcaatgtgaacaagccaaagcagttctgtgtgtgtacaaaatggctcccaccgagtatgtaagaattttcagatcaaatatcttcataatttttaacagttgtgaacaatctctatcccttttcagtttcattcctcactgatgcccctagccttgcaagccaaagagcctgtagagatttctgcggaataaacctgcccatcagaagacggaatccaatacattaatttcattaacatcttctctaaacaactggcctaaacaataattattcacagaatgaagttagcttgttagtatagacttttttatatagataatttaacatgagaaatcttgtgtttttaaatctcatgatatggtatggctctgtgtctccaccaaaatctcatgtcaaattgcaatccctggtgttagaagtggggcccagtgggaggtgattggatcatgggggcagggaggctaggccagtctctctctttttcatgtttttctgcctgctttatatctctggcagctgattagattgtgcccaccagattaagggtggatctgccctccccagcccactgactcaaatgttgtctcttttggcaacaccctcagagacacacccaggatcaatactttgtatctttcaatccaatcaagctgacactcagtattaaccatcacatgtattaagtggatgcttaagggatttagggaatactttttctctatggactgtcttcttcctagtttcttgctaaagaagccaagaaagtttgatgttactaaacttagtagtggtctcttcttccaatttttccttttctgaggcaaaaaaccttcatggtttcaccttagaagtgagtagctgtaaaggaatcttaattaaggcaaaaatctaaaatgtgtttgtttagtagtatatgtaatcacattcaatgagatccatatgtgagcaaaaagtaatgaatgcaaatgcttttagtaattgctttctttctttggttaacacatccctaacaataactgacaatataaatttgacctttgagaattatctcccctaatttcccttatttcactctctagttctcttgataccatctgttcttttccttcttcttccttttattttacttttctttgtctcttttctggaaatacattgaacatctattttcttgggtgctttcactgagcttcagtaaatacattcaatgttatttctatttattcaaattctataaatatggaattctgactacagctatctttgtcatttcgttgtatccttccatttcaattatttacagtgtacttgcctgaccccacacttactttttataaaactagaactaatatgtggataggagatgctatagtgaataaactattgtattagggttctctagaggaacagaacaaatgagatacaggtttatatgaagggtagtttataagcagaattgactcacacattcacaaggtaaagtcccatgataggcagtctgcaagttgaggagcaaggaagccagtgatggatcagtatgaatcccaaaacctcctaagtagggaagccaagagtgcagcctccagtctgtggccaaaggcccgagaacccccgggcaaactactggtgtaagtccaagagtccaaaagccgaagagcttagagtctgacgtttgagggcaggaagcatccaacacgggagaatgatgaaggtcggaagactcagtaagtctagtccttccagcttcttctgcctgcttgattctagccacgctggcagttgattacatcttctttggcaacaccctcacagccacccaggaacaatactttgcatcctttaagccaatcaagttgacactcaatactaaccatcacaactatgtttcgggtagttagtccgttgtagaaggactttccaggaatagtatgtgacatttatcttaacagtaaattggtaatgcaattacaactaaaatagaaagtatcagctttgggatcagttctcagatatcaactgtccatcttagaggctgatttaactccaggtgtgttttaaattctcttgtactttgataagcttttaaaatacattggtggctgggcacagtggctcacacctgtaatcccagcactctgggaggccaaggcaggtatattacctgaggtcaggagttcaagagtagcctgacaaacatggtgaaacctcgtctctactaaaaatacaaaaaaattagctgctcatggtggcgcaccctgtaatcccagctgctcaggaagctgaggcaggagaattgcttgaacctgggaggaggaggttgcagtgagccgagatcctgccactacactccagcctgagcgacagagcaagactccatctcaaaacaaaagtaaaaataaaagtaaaataaaatacattacttttggacagggaacatgtctttttcagttcattgatgtgctccctgcttgtctccccatgcatcagcctgcttcatttatttgtgcgatttgcctgctgataagagagtaattgaagttaagtcttcttcttccacttggtggtatgtgcttaggcatattattttgacgtcagttcttttttttctgaaacacaagactgaaaataggtttgtctgaggatctaaattatacatgttcttatatatgtgcttttcttttcttttttttttttgagatagagtctcgctctgtcgcccaggctggactgcagtggcgctatctcagctcactgcaagctccgcctcccgggttcacgccattctcctgcctcagcctcccgagtagctgggactacaggcgcctgccaccacacctggctaattttttgtatttttagtagagatggggtttctccgtgttggtcagggtggtctcaatctcctaaccttgtgatctgcctgcctcggcctcccaaagtgctgggattacaggcgtgagccaccgctcccagacatatatgtgcttttcttagaagtcatcaatgttcaatctctcacaaaaatgtgtaaacatttataaacccatttatatttacatagaatccatatttctgttatagtaacatattttacaaactattttctctctcgaaaagttgcagttagctttatttacagttatttctttgacagatgaattcctccttgcctctcaactgaaacctgtctgaggccacagtgacctcctgaattaccaaatctttgccttttttctttcatgtcatttagctttgctattatctatggccaaatatttttcctaaagcattgaaagatctcatgcttagactcaacattttttaataggaagaataaagaaaagtagtatttattaccgactatgtttcaggcctccttttaagttctttacatgcattaactcatttgttcttcaaaataatctaatgtagtagataatattagatactgttattatcatcttagagaaaacaggcacaagaagcttagtgtcatgctcaaagctttgcagtacataaataatgcagacaaattacttaaatttaagatatatacatatatagtatatataactatatatgtagttgtctgttggagtcagtctgttgaagatatacatattcatttcaaattatatataaaaatatgatatacatgtatatacatgtagacacacacagttgcagacaacaaagaacattttgggtcatttgtggtaactaggaaataactgttaatgacaaaagacagctaatgtatttaacaataaaagaatttatctgtgcaagaatgtgttgtttaggctgggcacagtggctcatgcatgtaatcctagcactttgggaggctgaggcaggctgatcatctgaggtcaggagttcaagaccagcctggccaacatggtgaaactctatctctactaaaaatacaaaaaattagctgagtgtggtggtgggtgtctgtaatcccagctactcggaaggctgaggcaggagaattgcttgaacccaggaggcggaggttgcagtgagctgagattgtgctgctgcactccagcctgggcaacagagtgagactctacctcaaaaaaaaagaaaagaaaagaaaaagaatgtgttatttagtgtaaaattaaaatacagatttggggatttggggacccttgtgtataattacatggtctcgcatgaagtctcctaaccaaagattgggaatgctaatgtagctcttagtcactgtctcagctatcattattcacgttacctctttaggttcttattttttctttgttttcatgtgttaatttcatgtcatttgcccttcactagtccctctatttttccatcatactttgttgatatgtatttctcacaaaccaatacaaaagagtaggaaaatatttttgtctacagagttaatcttgatatttatgtttatacaaattcatttgggggactcttcattggctgcaaatgctcactgggctaaatttcccataagtattttaatgcaaaatttctcatttcatttgttgtgcagatgaaaattataggctaggcatggtggctcatgcctgtaatctcagtgctttgggaggccaaagcaggaggattgcttgagccttggagtttgggagcagtctgggaaacacagtgagaccctgtctccgcaaaaaataaaaatattaacctagcacagtggcacacacctgtgttcccagctactgtggggctgaggtgggaggattgcttgagcctgggaggtcgaggctgcagtaaggcatgattgcaccactacactccagcctgagtcacagtatgagaacctgtctcaaaacaaataataaaataaaattaaattaaaattgtaagtacctttatattagtattgattttaaatatcattttatattcttctgagaagtcctcagtcaatctttggagtgcatataacatattgtagaaaccaaattcacttctgtggaaattaactataaactgacaataataaagagatgtagacaagtagaataaggctgttagaaccagaaaaaattgtagagattctttcattaaaccatctctttttaaccacataaagttgctaaaggataaaatatctacataattaaaaaaataccatcataaatttgttctttaggtattttaaggtagaaaataagaaacttaataaaaatcaaacaaataaaaatataattcaatttatagtgaacaaaaatattttaaaggcaaactcaaaaaaagcatttccaacaattttagaacatgataaattatactgttacctgtgctgccattatatcaaagtaaccagtcaattcagtcataattgaatcataatgacaaaagagctaatttattttcttcattttttcattgtaaatttgacattttgtaaaacttactacagacaaaagactgagaagatgtataattttctcacacctgtattgattatataaaaatcagtgcattttagtttatgagtaaaaaaggatttcatatttcttatgttaatacataagtgtattagtccattttcacactgataaaggcatacctgagactgggcaatttacaaaagagagaggtttaatgcacttccagttccacgtggctgtggtggcctcaaaatcatggcagaaggtgaaggacacgtgtcatatggtggcaatcaagagaaaagagcttgtgcagggaaactccagtcaaggaagtttgtgatggtttattggagacatattaatatcatcagttttaaagttgagatgtggatacaaatttatcaggtagacaaatgtttcctgaaacaggtaaatagagtatgaagaggtggagagaatataataatccaggaaatggaaaagccatagaagtatgtgagcatgatgagtggaaggagctataagtagttcaacatgattggaacataaaattcaagataaagattggcatggatggaagtgaagaagtagattggaatcttagtctcttttgtgctgctgtgacagaataccacagactaggtaattcataatgaacataaatttattttttcacaattttgtagactgagcatttcaaagtaaagttgcctgcatctggtaagggcctttttgctgcattatcacatgacaaatggcagacaggcaagagagcaaactctccagatgaagccctttataacattaatccctttgtgagggaggaactctcatgacctcagcaccacctaaaccccacctcccaacatttgcgttggggtttaagtttcaacaagggttttggaggaaacaaaacattcaaaccatagcagttgggatacgatcataaagggcaaagattttagattgatgctataggtaatggaaatcattaaagattttaggtggtgaagggacatgattttacaagtagactacaaagatcaccttggaagcagagagaagtatagaataaaaaggagaacttttgaagaacataagattactggattgtatgtttgcaaggaatactacttgaagaggctcctgtgggaaactagggtaaaagtcagttgtgctaacacagtggtaagataattataaaagaagggacaatgagataaatgaatgatggagacaggagctgtgggtgactgtcaatggaatttatgcataatatttttctaaacagatctttggtaaaattgtttcaaataccactttcctataagctgtcttctggtgatgttgctttatcttgaaaggtatgcaatttcttcttaacatgcagcagaagccatttgaaaaaaaacagtaacatataattcttttctggaaggttacttgttcttcctcccactagggtttttctcattgtcaaacaaacaaacaaaaaataaacgtaatttacttatgactacattttactcaaataaggtcatagtatacctatagctgatagattggtgtatgacatgtatttctggggaaatagatccactaataaagagtactttgtagaattgaatgtttagtctttttgtttattcttttgctttttgttttgctaactagactatgttctgaattaatcaaagttgtttgacaaagcaatacttattgcagattgtttttgtcagttttgtaatgcttgttgacattactgcaatgcaattttatgattatatcttttgaacctaaacgtcagtgagaatttaataacttttccccctatgtgcttctaaaattatataacaggtgattatactaaacataagcttcaatgttaaaaaaagcacaaatatattatgttgggggataatttacttacataactttaaagttcagcaacagtgatagcttctgctgaggcttactagatcaaatcttaaaaactatgtttctctccacctttttgcttagtttgataggagcccttattgacgtaaaatggttgtagcagttttgataactcatatcctgacataatcaaatcgagaggaagagaaggactcctcagttagactctttttgggaatgcttgtcaaacagaaactaggttgactgaatcctcaagtctgtcagggaatattctgatgggacagatgtaaaggaaataccaattggcaaaatctaaacaagccctacccacattggtcaaaccccacttttcttcaaacttgacagagaaaaaagaatttatgcagtgtcctaaagaaatccagcctttcctttgaaagaggaaaacatggatgccagaaaacatagcagccacaaaaatttaagcaaataatgcttctcctgaatacagacagaatacctactaaagaagtgcatatgtatctagaaaaatgaccatgatataatttttactaccttggctaggagtctatttgaattaaaacatgccagtgttttactctgtagaccaaacacgttctatgatttgttgtatagttctttgccaaaaaataagtgtgcagtctgaaattcaaaacaaagaatttccttcttgatccacacttcaaagccttgctacttcatatgatccttaaagaaaaaagaaaagaaaagagaaagaaaatcacaacttgctggggtctctagtatttagcagctgttaaattttaatagatgtcagtagggtactcagttaaaaagcaacccaagaaacatcataaaaaaagatatagtctttgacataataggaggcatgatttttttatagctgaaaacagaatgacaatttctctgttcaataaaataatttgaagtcaggaaaatatttaacatcgtcaagttaatattaaaataaatggaatatattttgctgataaacaagtcatagtaagcattgcttcagtctttcattgacctggttgtataatcatcaatttttcatctttggattcatatcattattttccagaaaattgtgtgcttatgttagccatacaaacttaaaaggatagcaaagaacctgaaaggtttgaactttcatgaagttaatgacatatatcaaatcaatctaggctgagtctataagaaaatcagctcattaaataagatttacatttctgaagattactcagttactttttctggatgcccatcatactgaagaatcacattattcgtatgttgccttattttaatgatttaggtttgactgtccttatatttgggtacctaaagtgatgagaaaaaatgagtcgcaatggagaaaaagatgacaaactttcttgtaacatagatgcaatattgacatattaacaaggtgaaaaaaatctcacttgcattgccaaagatgctttcgaataagttatcactatgaagtttatagcagagcagttgcagtgaacaggtgtgatgtaaaagtcaagtcattttctaagactcacatacggtatgttttgcaaatattctaccacacttggcaatgtggaagaataaatgtactaaaagctttccaatattttgacagctagcatatagtacccaactgttaatgccagtggaaagtccaggagaaagactttaattcatttaaaattaatttcaaaataatgtatgactgttattttaaaattatagaaaggcagaaatattctaaaggaatagttaaagtttctgtgtacttacatcccttgtcctactccatttccatgtctataccaaaagcaatcacttttaacagctgaggtctatttttccaggctttctctatatgtatatatcatcatttccaagacctgcaaagtcaagtggtttttataaaaccatatattacattcttctaattttcttctcttcagatatactagctctagaggaaaatcagaaaatcagaaaattctttccttcatttgtttcttttaaaatcccaaaggatatttgtgatagtcaactttacattatcaatatggacactataatttttatacaccttcatttctaaagctttatgtaaatgacatgtactctctctatattttaatttccctatctgtttatagaaaagttatgtcctatcttcttgaaagatatgaactgagggatgaataaaataatggagaaaattgccatataataacctgatggcaatattaaaataaattctaatgaagatcttcaaattattttattgcaataagcattataattttctttggcaataagcattatacttgtagttacttccagctggtacacttaagattactttttattatcacccttgtatgtaacattttttgtcatagaaattaaacattgaaataaccaatgacatatagtcaaactctctgttaggctgtgcaattccagattctagagaaaggttaggggtggaggtcccatacaatatcaagtcattaccggtaaaattttaaagatgattaaatacagatttcttgttttgctaattagccttatcccttcttattgtgttcttgttactgctaaataacttcatgttgtcgtcattacaataaaggtcacattctggtcctgttactccaggtccttccagccagctactcttgttcccaaagcccttctcctactcaggcttgcttatttcattctctgttatcaattaccagtaaaaagtgattccctgatttaaaggaacttactcctaccctgacgttataggaacatcatggtcaaagattcatgattccactgacctaattcatgtttgctactttagagagtgaagtcattgtgaaactagaacagatgtttttctctaagaccaaaagtctaaaacattttctttcagaccactggaggcacatatctagggtaaccaaggcagccaccttcagggtggttggagccagcgttcttggagtctgtttcttcaatccttttgtcatgtttcattctcacacctggctatgcagccttgaagaatcttgaggaaagaatggacttaattaagcattttaaaattatttgtatgttgttgtactaatttctgcatacatgtttagggaaacaggtagattgaaaaaaagagagtttgaagaaatcattgtctcaatgttagtcctgtttaaaaaaaattccagtgatttctgtagtgtcatactggagcaaatttcaaagtctttcgaccatcagttcaaagataaaactagataatctgtgttcattttgtgctgtagtgagtatttttgacattgggaaaatcttacaaatgtttaggaaaagtgtcagagaatttccctgacagtgcttttatggtatctgtaggttaaagttgccaggtaaaatacagaacactgagttaaatttgaatttcagttaaactacgaatactgtttagtataagtatgcccactacaacatttgaaacatactaaaacatattcactgttttttgaaattcaaattttactgaacatcctatatatttatttgctaaatctggcaacgctattacaggttgagcatctgtaattcaaaaatccaaaatctgaaatgctcacaaatccaaaactttataagtatcaacataatgccacaagtggaaaattccacacctaacctcatgtgacagataacagtcaaatgcagtcaaaactttgtttcatgcacacaattatttaaaatgcatcaggctatttgtgtaaggtgtatatgaaacatgaatgaattttgtgtttagacctgattcctatccccaagatacttcattatgtgtatgcaaatattccaaagtccaaaaagatctgaaatccaacccttctggttttaagcatttcaaataagggctattcagcctgtgtatgtggtggtatcccccatatatagaggatggggaaagatggttcaagcaacaatagcttctcaaggtggcatgttcaaattcctctaaacagggacacatgtgtatgctacttttcctttgataaaagtataatagttaccattaaaagagaaatgaaaaggaaaagtaaatatcccttacaaatgccaaaattattctaatgaacaatatgaatcaggtgttatgttttcttctcatcatcctcctcttcataatgatagtaacaataacatttataatataataattacaaataacgttttttaagacaaagcctctctgtgttatctaggctgaagtgcagtggtgtgatcacagctcactgcagccttgaactcctgggctcaaatgatcctcccacctcagcctcccaagtagctgtcactacactttatgacacaacacctggataatttttttaaaaaaatttgtatagacgaggtcttgctgttacccaggctggcctccaactcctggtcttaagtgatgctacaacctcggcctctcaaagtgctgagatttcaggcatgagcccccatgctcagccacagagaacatttattgaaagttttctatcaagcacttttaattagctgcaacttttaatacttaccctgctggagtgtatggcccaggaaggaccatatctgccctgttcattgctcatttcccagaaacccatgcagtatctgacaataataggtagtatgtgtttagtgaatgaaaaaaaaatgaataaatgaggtaggaattattatcccggtttcacaaatggataatgtgcggtttattgatgttgaggtctttcctcccaaacagaatttaagttacagtgcctaagcagaaattcaaatgtgtttgacttcaaagacggcagactgcttcaggaattaatccacatccataaggggcaggaattgttgctgaagggatatgaactccttctgacttataacatactagctcatatgcaacctgcttgcaaaagctgtctccttagaacctcaaaacaactatgtaagatggatattactatcctatttttagtgaataaactgaggcatagtgactataaaacctagatccaaacatgagtctgtctttctcagtaaaatgaataatagtaccagtgtggtaccttcatatgtaagaaaatatattgtgtttcaggaatagagacatcagaatacaattaggttaattttttgtcacgtattttacatagatgtagaaaatagaaaatgcccaatatctgtgttcctgaatcaacatttttatttatgtaatattattgaatattagacatgccacagctagttgggatccccttaattgaagcaaaatgctttaaaaatgaggaaatatatatttaaaaatatttaagaactcgtaagtttaaacaggtacttagaaaaatcacttttcctctaagtctacttactagttctctgatactaagatacaatgccatgatgaagtagttcatttctacagactgctaaactgaaaaacaactatttcagatcatgttttcagggccatagagtgggatagccaagagagaaggctgtgtttgtaagccatagtcccacaattcagtctcaaaatacccaaagatcttcctttcctcctttgcccacccacccacccctctctagccaaagagcttggggttgaaactaaaccagaacacatcatcatcattatttttccccaagttgctatttaagaagtttagacgtgcagttgcttcatgttgatgatgcttgctattctctcttgggtaaaataatcggatgtagtattaagactgtcactaagaattgttcatgtataatttatactcacaattaaaaagcatttttaaccaagtgtcacaacacagtgacaactaaattagactgtgatttacattaccatgtgctgcacttgatttagtgtcactctagagaaattgacaaacaacccatgtagagcaaggcagaggtcttagtcaagatagggctcactccccaggtgggaataaggtgagggatagccagtgcatgttgatgccattatgattaataattaatattagaatatgtacagcaatagaagtgcagcccttttagtaattgcacaagactactctagataggcatagtaagtagttaattctttttacaatataattaaaatgaaagtgaaaaagtaactgtagagaaagaaaacataaatattttctttaatgtttgaaattttttgaaaagatggaatcttgctcttttgtccaggcctcaagcaatcctcccaccttggcctcccaaagtgctgggattactggcagaagccacccaacctggcccaactgtttcttttaaatatgatgaaatcaaagttaaatgattcaagtgacaaagttgatactgaatcgccccaaaatagcttcaagtgcatttttgaaggggcctattgtcacaccatgagctgaaagagttccaagggacttgtgtgcttatttgagacatgtctggcaaagactgacttttttttttcatggaaattcaaggataaaataaaatacataaattaaaagccaaagatacaaggcatggaataagatggatattctagagaaatcacatgactaaatgacatcataatagaaatggaaaacaaaacacaacaaaaatgtgtggtggtggaagaagtgacctggaatattaaaagtcagacagaacacttagaagagaccatatatgatttaattttaattattgttttaagtagtgatgaatttggggactgtaatgtctacatgagctccaactagacatctttataagtgacaactgtaaaatctggacacaatatcttgaagcagctactagaattaaaaatattaatacaaagtcttctgtggtgtccatgttcagaagaggagttatatttgcgttcactctttctagcctgggagtagggactgttagcagtcatagatgagcagaatcccttgcgtgaaaaaagctccaattctctggtctgggaaatcaaaatatcgagtcatggcaactctgttttctggagtagggggaggggagtatctagaagaggaatatctagagatggcatccccaaatttaatctgcctgcatctgtgatagacctctgagtcgtgtatgcataaagcagagtcagagcagtttagctaaggcaaaggatctcaggtgaggaccgagttgctgtccaagactaagacaagacaaaactaactaactgaaaattactcatggaagaagagagtatccagtctccacggcttaatattcatgacgtctatgataaaatgcagtcttatgtgacataagagaagcatgaataaagagcttattctcaaaattaaaaagaaagaaagaaagtgaagccatttctgcaatagatgacttagacactgaaattagtaggaaagaaatttaaagtcactattttgaccatactcaattacataaaagaaaatacttctccacttaatgaaagatgggaaatatgagcaaagaaataataatgattaaaaagaccaaatgtatcttgatttttaaaaatgcaatagtgaaaaaaaaaacagaaaacaaaatgactaaatagaattaacagcagaatggagtcagcagaggaacaagtcagtaaacctcaaaatagatcaacagaaatgctgaaaagtaaataaacagagcctccaaatattgttagatactaaataacctaacataagtgtcattggttgtccatcagggaaaaagagggaaaggcataaatatatttaaaacgtaatggttgaaattttctaaaatttgaataaagatttatattacagatttaatgaagaatacttaaaatgaaaaatatctgggtaagcataacattctgttttaattatttattttattctttccttaatttcttaatactgcatattactgtttaaagtaaaactgtaatcattgtcttgtaaacatttataacacatataagtctaatacacatgacaacaatagcctcagtcatgactgggaataaattgacctacatggtgcctagatttctgtattttatacaaaatgatagtacattaattctaagtagacagttgtcatagtctgtccatcctactgtaactagatggcttataaatgacaacaatttatttctcacggttctggagcctaggaagttccagttcaacatgttggcagatttgttgtctggtaaaagccaactttccaattcacagacagcacgttctcactgtgccttcctgtggtggaaaggataagaggtctttctgttggcctctttcgtaacactaatcccattcattatgactctgcccacatggcctaatcacctcccaaaggccccacctcctaataccatgacctggggattaagattttattgtatgaatttgagggggacaaaaacattcagtctgcatcaactgtgaaaattaagtatgtagactgtaatctattatacaaccaataggaaattaacacagagaagtatagtttaaagccaattgaaaaattaaaatttaattctaaaatttgtacaaactaagaaaagccaaggaaggaaaaacaaaagccaaatgggaacaattatgaaacaaataataaaataatagatcaataatagaccgcaatccaattacaataaattatattaaatattaattaactgaaaatcacaatgaaaatgtacagacctcatttttatctaaataaatcagaaaaagaatagaaaataaagtgtaagttagagacaaaagaaaaaatctagaaattgagaacagaagaacaataaaaataagttattaaaaccaaaggatcattgactcttgtcaggggtgacaagttaattcattgtggaatggatagtcttttcaacaaatggtgatagaagattggcattcatatgtaaaataaggaacctctatctttatcttattcattacacaaaaattgacaatctttaaataaaagattgtagaatcaaagtgctagaatataaattgtcaatgagaagacagtggaaaatatttgtggcattgtgttagacaagatttcttgaagagcatagatacaaacacacacaacagagggaaagaaatggttaaatggactttatccaaattaaaatctattattctttgacaattcaccatttaaaaaaataaaaggtggctgggcgctgtggctcgcgcctgcaatcccagcactttgggaggccgaggcatgtggatcacgaggtcaggagtacaagaccagcctggtcaagatggtgaaaccccttttcttttttcttttttcgagacggagtctcactctgtcgcccaggctggagtgcagtggcgcaatttcggctcactgcaagctccgcctcccggtgaaaccgcttttctactaaaaatgcaaaaaaattagccagacatagtggcaggcgcctataatcccagctactcgggaggctgaggcagagaattgcttgaattcaggaggcggaggttgtagtgagccgagatcgtgccactgcactccagcctgggtgacagagtgagactctgtctcaaaaataaataaataaataaatggaaagtcaaagactaggaacaaatgttttcaaaactatatctaacaaaggatcgtttccaaaatatataaacaatatttatgattcagtaagacaactcaatttaaaaatgggtaaaagttttgaatgtgacatttgacaaaagatatatgaaaggcaaataaacatcagaaaagctgcttaccatcactattcatcatagaaatgcatcttaaagttacaatgacatacccatattaattattaaaaataaaaagacttataataccaagtgctggagaaggtatggaggaaatgtattctcatacatttctgatagaaacacaaaatgatacagccacacacattgaagtagtttgacatttaatcatacacttagcatgcgattcaacaatcttattcctaggtatctacccaagagaaatgaagacacatacctataaaaagatgtatgtgaatatccttaaaactattacctataataactaaccactagagacacaaatatccatcagctagtgaatgataaataaatttttatatttatattatcatatactaatcagcagtaaaaagtatcaaagtactggtatataaacaacttgtatgaatcacaaaagtatcaacctatgtaaggaagccagaagaatgatgaaaacactccacttgtccatatttttgatattctagaaaagaaaaaattataggtacagaaacaaacctatcagttgcctggatctgggagttgggattgagtgcaaaatataaaaggtgttgtaggttgtagttttttttaattttatttttgtggggttctagaaatgtttgatactttgtgttcatagttacatgataatgtacaactgccaaaatgcgtcagaatgttagcctagtgaatatttttgtatataaattgtatcaaaataaactatggggaacaataagctatttgcatgagcatagtcttggtattaaagaagcaagcaattgagtttcaatatagatttcttttttctgtttttgttttgtagttaaacagcatatatttagtgaatacattcaggggcattttatcattttgatttctgatcattttgccaatggaaattgtacttttagtattacttttatttagtatttattaatactaaataaaaatttagtattaatatctatacaaattaatttttaaatcatttaaagatgaaaacattttccagcagatttcaaatgttcagaacttgaattaaaatgtaattagcactgaaaagttactgtttgtgttaccctatggcaaaggctcccaaggtggttacccctaatgactagtagcgtttaaaaaatatatttttattctcattcaaagtatttcagtcttcctgttacattatggctttgtgtgtttacagagtttattctatattggtgaaccagaaacccaactttttatcaaatcagctctgagtctagaaataaaattagaaaactaataaaagtagagatgtcagggctcttgccattttcctagcagcaggaaaatcgtttatttaatgtatcacggtctagtattacagatattaaaatagatggcaaaatttatgttacagactccattttgagagaatataactcagacatatgctttcctgaaattcaccatttagaatttatcacagttaaatcacatatttatgtatgctatacacatagaacaaagactaattgctaggaatctaaattggaaaaccctattgtttgagtgtcatctgctaatatttggacctctttatattgacaaacccaaaagcagcccattataaaaatatggagaattcgtgctaaaaaccatttcacttattgcaggtctttcttaacacaattaactaaaagcatatcattttccatgtaattgtttcaacaatttcttatcatacttgattacaaaagtcattcccttccacaccctacttccctctatgtgtctgtcatttggtaagtcaagacctctttttgtaatatgaatgcttaagatgggaggatcattttattctttgacttctattctgaatatatcaaatatttatatgatcttattaaactaaatgagggttatggagtatagtgtcaccaaaacaataattattgaataaaatgaatattttcttcctctaaacagatatttatatcatgtcatatttactatagaaaattgtattataaaaaagatggggttcatcgtcttgggtttaagtagaaaaatgttctcagcagtcatcaattttttcatgaatacacaattcacgctaaaactttcacatatttgaaatcatcccacaagtctcatacttagtgatattttatttatttatttatttttgagacagagtctcactctgttgcccaggctggagtgcagtggtgtgagctcggctcactacaacctctgcctcccaggttcaagcgattttcctgcctcagcttcccaagtagctgggactacaggtgtgtgccaccacactcggctaattttttgtattttttttttttttttagtagagatggggtttcaccatgttaaccaggatggtgtcaatctcctgacctcgtgatccacccacctcggcttcccaaagagctgggattacatgtgtgagccagcgctattttaaaacattagaaaacacatggcttttcctgagaatttcataatctgatcaaggatataggacttatatgtgaaaataattatttaattattaatgataaatatgtccttgggtaaatgaaacaagaaaacaatcaattgagattgatgttggttttgaaattacaaaaaacataggaggttcaaaatataggaagaacctcttaaggttagactattccacaagaattttataaattatagcatcaaaaacagactaataactaaaatattagaatatctttcagaaacatggatttgattaaggaggcaatggaaaataattgaatttaataatgatgagggcaaaactatggagcaggatttcagagcacaaaatgtccaaaacaggccaggaagactgataataaaggaagacaaatagagctaatctgagacactattgcagggtgctgaattaccctgatttaaagttggggccaagagaacaacaaagatttggagtagcagtgatcatactaggcctactaaaagacggaaatgttgatactgcttaaccagcaaatccctgcccaccctctacctccagactatatttaagaagattgggaaggcaagatacagaataaaatcttggtgacaagagactatagagtacaacaacagagggggtaagaaaatgattgaaccattttccatatgcggtagctgggcattagaagcccccacaaaggccttctgaagaacatacatgaacctttccagtagcaactagacacctaccaccagggagcatctgcaccctgagaagctggccagagaagccatgaaacagcagggaaacaattacaactgagggaagtaaagtaaggaaatatttttctttcctcctcccccactccccttcctcatgtaatcagagcaattgcatggaggtgggcaggaggcatctcaggaccagaccatgttcatgttttctttatttttctacctgctagaatgggaggagaacagaataaacagacagtttcagatccctggagctgcagatgtgaagagtgatggtgaagagaggctgtctgaatttgaatttgttttacaattctaaactggatttttaaaagtgtttaggaagttgtaaaattcatccaatatattaatcaagatatcttctaactagcagagaagagtgatttgacataatcatatgggagaaaaaattaatattgtctcacacaaagttgataatattctaatattatagttaattttataattaattaattatacaaattaatctgagggaaacaaatccagataaataactggattttggacataaaagagagcaaaactaaaacatgcatacagctcatcattctgatagtctttaagattgtattgctatataacatttagagagataagtgggaatgttgctagttcaattttatttaagtttgtgaacttcaagaagcagtgttatataagcaacaagaaatacacagctcaagcctgacagctcttggctggagatttagttcccataggtaagaatctaattgaagccttaggagggatgagttgtgtgaagtaagacaaagagaatgataaacaaagtgataaatcttccatattcaggaggttgtaaaaaaagagagaggtgggaaagtatattatcacagagtgcaagaaatgttaatattagaaattcaggtgtctgcaaatttggaagtgcagtaaaaatcaaggaggaggatgaatgctgatttcatcatcttcaagagcagattcatttcatgaatgagactagaggcaccattgacaatttgatgacaggcgaggacattcagtgacttcatcaaggaggttgactctgaaagcaaggagaatcaacaattgatgttttgaagggacacaggaatcaggacagatgatgtatggaaagagattaatgaaagaaacaaactggcaatagccagtacagcaagggagtagagaagttatcagtgagagggtagggaggctggtcattgaaagaagcgaagtgaatatgatatgaaaaattcaggatatgaattttcagggttcagaattttctctcttgtaggacttctattcactaacattgaaaaaggaaagatatgaatagacagtgtggctaatctagacgtggacattaattggtttatcttggagggacagaaaatggaaaggatacttaacatatagtaaatatgatagttttgaaataattgcttctagtaccctatcaagaaggtcaatatagttactggtattgttctgaattatatattttaccacagtagggaggagaaactatttaggaagataaactctattatgtcattcttcattacaatcattacagctattcatgcagtcaaagacgaagaaggagtctaaaaacatcaaatggaagctcatattctaactcaagtggaagtacttaagaacttaaagagattgatatccctttgaaaatgagaggtgagaggggaggagccaagatggcctaataggaacagctccggtctgcagctcccagcgtgagcgacacagaagacaggtgatttctgcatttccatctgaggtaccgggttcatctcactagggagtgccagacagtgggcgcaggtcagtgggtgcgcgcaccgtgcgcgagctgaagcagggcgaggcattgcctcactcggaaagcacaaggggtcagggagttccttttcctagtcaaagaaaggggtgatggacggcacctggaaaatcgggtcactcccacccaaatactgcgctttgccgaagggcttaaaaaacggcacaccaggagattaaatccctcacgtggctcggagggtcccacgcccacggagtctcgctgattgctagcacagcagtctgagatcaaactgcaaggcggcagcgaggctgggggaggggcgcccgccattgtccaggcttgattaggtaaacaaagcagccctgaagctcaaactgggtggagcccaccacagctcaaggaggcctgcctgcctctggaggctccacctctgggggcagggcacagacaaacaaaaagacagcagtaacttctgcagacttaaatgtccccgtctgacagctttgaagagagcagtggttctcccagcacgcagctggagatctgagaacgggcagactgcctcctcaagtgggtccctgacccctgacccctgagcagcctaactggcaggcaccccccagcaggggcagactgacacctcacacggccaggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgtagttcctcaccagcaacagaacaaagctggacggagaatgactttgacgagctgagagaagaaggcttcagacgatcaaattactccaagctacaggaggacattcaaaccaaaggcaaagaagttgaaaactttgaaaaaaatttagaagaatgtataactagagtaaccaatacagagaagtgcttaaaggagctgatggagctgaaaaccaaggctcgagaactacatgaagaatgcagaagcctcaggagccgatgcgatcaactggaagaaagggtatcagcgatggaagatgaaatgaatgaaacaaagagagaagggaagttcggagaaaaaagaataaaaagaaacgagtaaagcctccaagaaatatgggactatgtgaaaagaccaaatctgcgtctgattggtgtacatgaaagtgacggggagaatggaaccaagttggaaaacactctgcaggatattatccaggagaacttccccaatctagcaaggcaggccaacattcagattcaggaaatacagagaatgccacaaagatactccctgagaagagcaactccaagacacataattatcagattcaccaaagttgaaatgaaggaaaaaatgttaagggcagccagagagaaaggtcgggttaccctcaaagggaagcccatcagactaacagcagatctctcagcagaaactctacatgccagaagagagtgggggccaatattcaacattcttaaataaaagaattttcaacccagaatttcatatccagccaaactaagcttcataagtgaaggagaaataaaatactttacagacaagcaaatgctgagagattttgtcaccaccaggcctgccctaaaacagctcctgaaggaagcgctaaacatggaaaggaacaaccgatacgagccactgcaaaatcatgccaaaatgtaaagaccatcaagactaggaagaaactgcatcaactaatgagcaaaataaccagctaacatcataatgacaggatcaaattcacacataactatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaactaaaaaaggcaggggttgcaatcctagtctctgataaaacagactttaaaccaacaaagatcaaaagacaaagaaggccattatataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacgttagacagatcaacgagacagaaagtcaacaaggatacccaggaattgaactcagctctgcaccaagtggacctaatagacatctacagaactctccaccccaattcaacagaatatatgtttttttcagcaccacaccacacctattccaaaattgaccacatacttggaagtaaagctctcctcagcaaatataaaagaacagaaattataacacactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacatttaaaagaactagaaaagcaagagcaaacacattcataagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaagggaatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggtccagatggattcacagccaaattctaccagaggtacaaggaggaactggtgccattcgttctgaaactattccaatcaatagaaaaagagggaatccttcctaactcattttatgaggccagcatcatcccaataccaaagcctggcagagacacaaccaaaaaagagaattttagaccaatatccttgatgaacattgatgcaaaaatcctgaataaaatactggcaaaccgaatccagcagcacatcaaaaagcttatccaccatcatcaagtgggcttcatccctgggatgcaaggctggttcaatatacacaaatcaataaatgtaatccagcatataaacagaaccaaagacaaaaaccacatgattacctcaatagatgcagaaaagccctttggcaaaattcaacaacccttcatgctaaaaactcttaataaattaggtattgatgggacgtatttcaaaataataagagctatctatgacaaacccacagccaatatcatactgaatgggcaaaaactggaagcattccttttgaaaactggcacaagacagggatgccctctctcaccactcctattcaacatagtgttggaagttctggccagggcaattaggcaggagaaggaaataaagggtattcaattaggaaaagaggaagtcaaattgtcccagtttgcagatgacatgattgtgtatctagaaaaccccattgtctcagcccaaaatctccttaagctgataagcaacttcagcaaagtctcagatacaaaatcaacgtacgaaaatcacaagcattcttatacaccaacaacagactaacagagagccaaatcatgagtgaactcccattcacaattgcttcaaagagaataaaatacctaggaatccaacttacaagggatgtgaaggacctcttcaaggagaactacaaaccactgctcaatgaaacaaaagaggatacaaacaaatggaagaatattccatgctcatgggtaggaagaatcaatatcgtgaaaatggccatactgtccaaggtaatttacagattcaatgccatccccatcaagctaccaatgactttcttcatagaattggaaaaaactactttaaagttcatatggaaccaaaaaagagcccacatcgccaagtcaatcctaagccaaaagaacaaagccagaggcatcacactacctgacttcaaactatactacaaggctacagtaaccaaaacagcatggtactgttaccaaaacagagatatagatcaatggaacagaacagagccctcagaaataacgccacatatctacaactatctgatctttgacaaacctgagaaaaacaagcaatgggaaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacatcaaaagcaatggcaaccaaagccaaaactgacaaatgggatctaattaaactaaagagcttctgcacagcaaaagaaactaccatcagagtgaacaggcaacctacaaaatgggagaaaattttcacaaactactcatctgacaaagggctaatatccagaatctataatgaactcaaacaaatttacaagaaaaaaaacaaacaaacccatcaaaaagtgggagaaggacatgaacagacacttctcaaaagaagacatttatgcagccaaaaaacacacgaaaaaatgctcaccatcactggccatcagagaaatgcaaatcaaaaccacagtgagataccatctcacaccagttagaatggcaatcattaaaaaggcaggaaacaagtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgaacacgtatgtttattgcggcactattcacaatatcaaagacttggaaccaacccaaatgtccaacaacgatagactggattaggaaaatgtggcacatatacaccatggaatactatgcagccataaaaaatgatgagttcatgtcctttgtagggacatggatgaaattggaaatcatcattctccgtaaactattgcaagaacaaaaaaccaaacaccacatattctcactcataggtgggaattgaacaatgagaacacatggacacaggaaggggaacatcacactctggggactgttgtggggtggggggagggaggagggatagcattgggagatatacctaatgctagatgacgagttagtgggtgcagcgcaccagcatgacacatgtatacatatgtaactaacctgcacattgtgcacatgtaccctaaaacttaaagtataataataaataaataaataaataaaaagaaaaaagaaaaaaaaaaaagaaaatgaggtgaaagctaaggaccaaaactttttctgaaatcattaactattttgtgcaaccacagtgatgatgatcatatttttaagacatttatacagggtagaaattatactttgaaactactgtatattatttaagccatagatgatccagggttataaaagagagaaactcagcagtatggtcttgtgatcaaatattctatcatctgatgctggctttcaccttgaaatgtgatctatgaaagatcatcttacttctattttcatgacctcatccaatcttaaaagtaaacattataagcttagttgctaagctcttgcacataatgttataggacacagaaaataaattattgttaagcattttgtacaagccaaaggtctaatgtaactgaggacggtagaaaaatccatgaataggaagcttgccaatgttattttacaaatatttgactcgaaagtttgccatagacttttgaaaatgaagaagaataggaagtctagcaattagaaacaaatctcctttgaaggatcttaacatgtaagcatttataactccttgtattatattaaaatgcttttctatttgttaaaaaccataatgagtgtatgactgcattgtaaaccatatcaatatcttgtaagtgttcagtatttaggcagactgcagtttgctgtagattaaaataatagtcaaagcatcaaagacaaacaacgtgactattttctatatttggatatgattttgaaatactggcaatggctttgatttttggaatatgaacaataattgtgaagatttttaatatatcaatataataaatatgaatacatgaataatgtattctgcaagctttattataagtcaattgtcctttcccttttaaaatagtatatttcttttctagaaacacttagctagcataaagctttttagtaatctactgctttgctccaaccaaaaacaaaacagagcaaaacactttaaaaaactgttgttaaaccgttgtttatccttctcccctttacattttttaccttcatctttttaataatctgaattgcgctaattttttacccatatgcgcagatttttcaatgttttgaaagtaggttttgtaccacaggggagaaacatgtcacacaatggcaaagtagaatcaggcaaacagattgaaagaaaaactggtgataaaaaaaagacccaaaaccaataacaactgtataatatataaattatccttattcttttgacgtgggttttaaaatttggaattatttgtaaaatttggaaatgtctttttttttaatcattaaagcaccctataaaattaaatgctaaagacccaagttataaatgacagaagtctacattcttaaaaaaaaaaatcagtttatgttacagtggaaagagatgtctgtataagtattaaccatcttaccctgttcgccattttatagattttgaaagaatacaagctggaacaaacattatcagacttatacttcttatggttaacaatccaaacttgtaatataactcaattaattatagccacttcaaagtaacatttagataatataatcatgttttgtgagaatgatatttttttcttaatcaacaggttggtactcataatatttatataccatgttaatggcatataaacatgcagaatttgtactaaaactattcaatgatttttttatgtcaatgctatagccacttttagttattcaaaatttgcacttggacattcttctagttctttagttattgatattccttaacaaattattcctaatatattccagtaattcaaagagtaaaggtacaattttaagagtcactaatacctctgttatagtttttctatcattagtgaacaatgccattcagataaaatgctgttggtcctgagaaggagtaaacaatatatcacaccacctgtatcttttttaaaaatttattttcttttttatagagacagagtctcactctgtcacccaggctggagtgcattggcacgatccgggcccactgcagcctctacctcccaggctctgtcaagcctcccacttcagcctcccaagtagctgggactacaggcaagcatcactacaaccagctaatttttgtatttttgtagaaatgagatttcaagcatgttgctcaggctggtcctgagctcaagtgatccacctgcctcggcctcccaaagtgctgggattacaggcgtgagccactgcgcccagcccctccgctaagctttcttggagtatcatgaactaagattcccttcagtcctcatcctgaagaaatgcaacccctgtaggaaaactctgacgagaaagtcagaaaagcattaagttaagcacatagagtctgatatacgtgtgctgattccagtgcacaaagttgttttgacatccagggatatcagtcagggaaagaggataaggaaagtgtagatgagaggcatttgaaacagaattcccaactgtccatattatcaaagtctatgcaaatttcattttgctgtggtatataataataaataaattggggcatcctatttaaatttattatatttatttatggataatattaaatggtgtattcatgatccaaaattaattggagcattccaatttggatattttgctgttttcctaagaacagaaattgatgattgacttaaaacatccatacatttttaattattggtaattggagaaaatgaatgtctcctttaaatttaatcaatgttttttaatcatctaataataggttcttgatatatccatttgttgatgagataatcccatctacttagaattcttctgcttaatcttaaaaatactgagttcaagcatatctttttcattaaactatgaaaaactaagctcatcatataatgtttattaataggacaatcactaaaggaaattaaagaaaataatcaatgattttctgctaagatgctaaagtagatcctttatatttatagactgtggttctacaggtactctgaattataatatgtctttttggcataacagtaaaattatatttgtcagattctcttgttatttttgctgcagtaggagtgtgacattttgccatttcttttaatttgaaagatctttaaagtctattctacagtaaggaaggggatgatatttgacttgtattcatgtgtcatcatattttcttattcttttctattgatatacaatagttgtacatattttgggggtagatgtgatatgttgatacatgtatacaatatgtgatgataaaatcagggtaactgggatatgcatcaccacaaacatgtatcttttctttgtgttgggaacatttcaattattttcttctagacatttttgaaatatacaataaattatagctaactatagtctccctgctatattattgaatactagcttaatccttctaactggttcttttacctggtccccaacttttcttcacccctctccttcctccacccttcccagcctctagtaaccaccactctaccctttaccaccatgagatccactttttcagtttccacctctgagtgaaaacatgcggtatttgtgtttctgtgccaggcttccttcacttaacataatgatctccagtttcattcgtgttgctgcaaataacagaaatttattctttttttgtgattgaataatatctccttttataaatgtaccacgtttcctttacccgttcatctattgatggacgcttaggttattcacatgattattgtgaatagtgctgcaataaacatgtgggtgcaggtatctctttgatgtactgatttcctttcttttgggtaaatactcagcagagggattgctggatcatatggtagttctatttttacttacattttcccaatcttctgatcagaaaccatgaattggtacaaagtaaggttcagaagtaaagtagctgttggggaaccagatgcattttcttagatggaactggaactgctcagttgcataaagaaaagaaagaaaagtgtaattaatcacagcatctcagctaaatactggaaagaggcatttatggctggacctgatcaagacaacatggatagtagaataatcttgtaaatatgtattgcaattattttcataacatactaagtggctgtgtcttgtagatatggcagtgggctgtaatgcaaaactgtatgaatattattgccacccacagctggattccctttattttacaaacgtgttttgacacttatggctaaaatggttacacaagtaataaatgccacactaaacaatttttattctaatgagcatttcttcagaaatattcaaagcaaaccatttttcatataaatctatatttgtttttaataatcagaaaaaagggtaaaaactgcacattacagaaaaaggataggagaaaatgtcaaattatatcaaaggaaattgatgaattttaccttccacacacatattagctgttgctatcgttgaaacagtgtcttttcagagaaattaggtggtaatgaaaactttacatttctagtttatatgattcaactaatgaagcagtactacatattatgtttgaaaaaagtatggatttagcacaataaaaagttaatgatgagatacataccctcatcaacacttccttttcaacacaatactcaggaattatattcctgaataaatggctcagctcttttttaactgaaaaaatccaaaattgaaatgtaaaaatgcattttaactaaagctactggagttattaacatggttaaaagtactcaattctggattatttctcttgctattgttataaaggctataaaatgaaatggaaatgacagaacaaaaggaaataaaacactaacaaaatcatcaaaacactatagagcagaggactgtaaaggtcccccacacatgacataggaatatagaggtaagtaataaaacacccctagccgttgctagttgggttgtttgcccaggaaagttccctttggggttttatactaactacctgtgaaatatctacttaaaaagaaagagacctatattccactggttgacagtggttatcccgacaagaaagtggttattttcaacaagaaaggaaaaacaaaaccaacttcagtgcatttacaggttaaaatgtaagatactgaaaatttatttaatattaaaaggaaaatgtacttttttttttttttttttttgagatggagtcttgttctgtcgcccaggctggagtgcagtggtgtgatctcggctcactgcaacctccacctcatgggttcaagctatcctcctgcctcagcctgggattatagacacgggctaccatgcccaatttttgtatttttagtagagatggggtttcaccatgttggccaggctggtctcaaactcctaacctcaggcaatctgcccgtcttgtcctcccaaattgctgggattacaggcataagccaccatggccggccaaaaatgtacatatttatgaataaaataacacttaatatattaacttccagaaagtaaaaatgataaaaaaaaaaaaactatgaatagtgattttagagacttaggacaaatttttgattcaatattttagagtatttttttacacagtttgataggatcttttattttaagctggtaatctgaaaactgggcatactcagaagaatcattttcagttatatttaatatgttggtataatagatatcagtttatatataaatatttctgtatctatttttctggacatgtatatatataaaacttatttgttataaagggaatatggacaggatatcgatacagatttttaaagttcgaaaaaattaaaaacatgggctataacttataattgaattgttttaaaataaatttcctataaaaatgtatgttcatatatcttcttaccctttactgtaatttattgaatggcacagcatcattttatgtaattaatgagcattggaagacaaaagactccagctttacttctgccaggcattacctagaatttctaattaggcctatgtaaataaatgcatggatgtatacatattgtctgtagttaatcccttctgattaccctcattcattatatgccttcttggaataactgacgatgatgcttcctgtacgtaggggctgaatgcaacctcagaaatgttctgaacctctctctgactatatgatactaaaaatactaaagggagtgatagtgattctaaataaaatattttttatcttttagttttgatcttaatttgtaaataatcatcacaatgaaaactgaattatttatctgatactcaagtgctagcaaataacatttttcattacactgctttcccaaatgtattattttagtatttctgcatgtgtaccacaagaatttgttaaaacatttgtgaataaagtattgttaaaacaaaaaagcatttacatgtagtatttcattttttgctagtttagtgtcaaaaaaagtaacaagtaaattattttttcacagctgaaattttaagggtcagaaagcctcatttatcacagattattgaggagaggtgctgtgaacctcagtttctgctttttcccaacacttggacttctgacttttcacataacttttgtatctgtaaacaccttaattctcgaaacccaatgtttatattgtaactgatgaataaaatagtgaattgtagggagaaatacatatgcaaaggaaatgaagattttcttcttttagaaaattattaccatttttagaacataaatatgctagacaaagaaacatacatgaagaggcattaacaagcactatcataagcatttcttattcatattctacgtttgagatatcattctttttgattaaaaattaattattgattatagttacattgtagatttgttgagatagatatgatattgtgatacatgtatacaacgtttaacatataaactaattacttagttttgggatctaaaatatctagaaaagagatgctgaaaaaaaaagcaaatactttgcagacttagttgtattttttgtctcctccactttgtatagaagctgccatattttttgttataatcacaatatatgtcatgacatagtgcaaaggctttcacagcttcatgttggaaatggtatttgtggaaaatagtaacttcaaaggcttatatgtattctttcatatatactgctggaaatgcattggaataaatcattttccttgaatgatgaaagtatcaaaaatgtaggtgcgttcagacataagtctgacatgtactttgacttttatctcattaaatctttgctatgtttgtacaactggcttcctttaatatttcagacccagaacttaagccccaagtcaaagtgtgaagtgagttaatctattcagcgcttcttcatatgtattttgaatgcatttctatttccagacttcttacttgaacattactttaggggaaaaagtttcatttttattttaaaatgcagggaattataatatgttctggatttacaattctgtttctcattttcttggtgtaaaggcactttgttattgacccaggggcagctacatagtctctctatatcttgaccctttcagaatctccaaaagaaccctccactaaagcttgggtaaaggaatagaagaaaatcacctttctgcaccacccacgcagggagagtttagggatgtcagtaatggtattgatgaagacagatgatgaatgtgggaagtgagaaaaaataaatacaacagaatttctaccccgtgtatctcttcagggccatcagggtttgtacatttttatgattcacatttctggctcaaacttcccaggatgagtctgtcactcttagaaccatagaagtaatttcctaagtgtgattatgtgaataacttagttgcaaattcgtcagatattaaaagagtgggcatatatgtttcacccttattccagacatatctattgtccctttcccaaaaccacagtgtggggttccagaagcaaaccaaacaaaaaaaaaaattaaggaaggtgagcttggcaggttgctccctgctgacttaaatattctgctaatttgccaaggatttgaacccaactttcagatatagctaaggctccataagaagcctttgaatagaaccgtcatcttaataagactaagtaaatcagatgagtttcatgttagctcagggccatttatcagcttgaagagtgttaatatttcatgtgggtctagcaatgacacctaagcaaagttgggtttggagactgtgaaacagctactacttatttctcttccaaaatattactaatcacccctccccacttccaccaacaaacagctttctatctggagcaaactcatgttttcttcattttaagactgatgaaaggtctgggagtcccaaaacgatttctggggctttcatatttctaagtttactagcatgttttatttatttattgaacttacaaattataatcagaaggctgcttatacacttagatgtagaaacaaccaatacaagtggaattactggcatggttttaatatactaatgacattatatccagatattcaactatactcataatagagacacacctaccacctgacagaagagttgacaccttctcagagagtacttgcccaagtcctgtcaatatttgcttctatgatagctattttttgtatcaccaaaagcatccaaacattttttaatggtagggatatgttatttcttaacatatgtaacaaattctgtcaagtcatagaacagtactcattgcctgggattcactgatctctttaataggagcttgcatatcttcgttttgttgtgctgatttcatagaacaattctcagacaatagtcttgtttctttaagtttcaacttacgggcgttaagttggccctttgggataaaacaaaatatacatgagaataaaaatgaatcaaatgatgaaagtatcaaaaatgtaggtgcgttaagatataagtctgacatgtactctgacttttgtctcattaaatctctgatatgtataaataaaataaaaatgaatcaaatttataagcaagagatacagtaatatgatgtgtcatgttctgactgagagaaatccaactcaaattgtcttaagaaaaaatctcataacgcaaaagagtagtggtaattctttagacactaagtgatatcagatggttaaacagtgttaccgagatctttctcccggaatatttaaaacctctgcacggtgttggtaggaatgcaaaatggtgcagccactaaggaaaacaatatggaggttcctcaaaaaattttaaaataaaattaccatatgatccagcaatcttacttctgggtatttatccaaaataattgaaatcaggatgttcacgggatattagcacttctaatgttcatggcagcagtattcgcaacagccgagatgtggaaacaacctaaatatccatccagaggaataaagaaaatatgttagatacaaatcatggaatatatttagccttaaaaaagaaggaaatttcgtgatatgagacatgacagttgaaacttgaggacatatgctaaatgaaataagcccgtcacagaaagacaattactgcatgattctagttatagtgtgtatctgaaatagtcaaatctatagaaacagagtagaatagtagtaccaggggctgtggggagggggaaacagaaagttactgtactaatcaaaggccataaagttgcagtcaagcaagaggaagaagctctagatgtctggtgtacaacattgtatctatcgtcaacaataatatattgtacacttaaaattttgttaagatggcaaatatcatgttaagtgtttttaccacagatgaataaaagtcagtcttcttcatcttccttaagccctgtgtggtttcattctgtttggttttatttccaagcagccttcttaaatgagataaagatagccaattagcagctcctggtttagagacataaaacattatccacacaagcagaaaaaaatgtctttcattttagttccttcagagatttcagggttgactctctatgattttctgacacatgctcatcccccaaatgatctcaactttcattatgtatgggtcagagttaccctaaggacttgttagaagacggattatagagccccagtaccagagctagagcgggtcccaatagtttgcatttcaaacaattagtcagatgatggtgatattagatcaggaagcacacattgaccaccacttcctcttagtggcaggatacttataggcacctgaaaggaagaattcagcatcatttgcattatacaaagcaaatatggatgaaatcatcttccataaaaaaatcagaatggtaatgtattctcaacaaaaaaaaagaaagaaaggataaagaagtagttattactcttggtagggcgctcagcagagaagcaaccacctctacccaacactacgaaggcctttccttctgctctcctgtttccctctgggactgtaaactagttcaaccatcgtggaagtcagtgtggcaattcctcagggatctagaactagaaataccatttgacccagcaatcccattactgggtgtatactgaaaggattataaatcaagctgctataaagacacatgcacacgtacgtttattgcggcactattcacaatagcaaagacttggaaccaacccaaatgtctaacaatgatagactggattaagaaaatgtggcacatatacgccatggaatactatgcagccataaaaaatgatgaagctggaaaccatcattctcagcaaactgtcgcaaggacaaaaaaaccaaacaccgcttgttctcactcttaggtgggaattgcaaaatgagaacacatggacacaggaaggggaacatcacacaccggggcctgttttggggtagggggagaggggagggatagcattaggagatatacctaatgttaaatgacgagttaatgggtgcaagcacaccaacgtggcacatgtatacatatgtaacaaacctgcatgttgtgcacatgtaccctaaaacttaaagtataatttaaaaaaaaaagaaaaagaaaaagaaacagtttagggatggcagggaaatgtgtttaatattatgctctgtatttcatgtcaataataagtgtaggagtcctaactaactagttatagaatttatccaggaatatatcaaaagagtaaaataatataaacaagaagagtttatttcaggaatgcaacacatgtaaaagtacatcatatgatgaacatcattaacactgaaaaagtattttacaatgtagtacatcaactccagaaaacaacaataaaaatacaaacaaatagaaatcaatgtataactccttaatgatcgatacaaatacatacacacaaacacagtcatatactctaatttcctgacaccattttcaaagaaagaatattcataaaaataacacccacttaatagaaactggtataaaacagtgtacacatatgaaaagcatctctatccatatctttataaacatattactatggtagacatacaatcttgaatgaattccaaaataaaaatcacatgtaccaatatttacttttgactccttcagttgtattgtatgcgcattgtaaaatctatctcatacaataatttaaggtattgtgtattttcatctgtgtcatgtctaaaatgtcatgactggcatgtatctttctaatgttatctagtaattagaaataataggataccaatgtatgaaaactgatgagtcatgctttcaggctttcatgtctattttttaatgcctttttagttacaaattgacaacaatttgtaattaataaattatgtaccagtaatcaaagccaatatctcattcggagcagaaaagaattactatgattttatcaataccagatgaccaaagtaaatacttactgactatgtgtcgaccatgtttttgttttgcttttaggataaaaatacaaagtgtattgatcaattaacacacatgtacatgcacataactatctgtctcttctatccgtctatctaccttgtacctatgcagtgtgggtagatagagggatggaagagacagatagatacataaatgcatatctatacacagtatgcattagcacacagtcacaggtatacttggcttataaagagcacaagatattatgccataggtggcattatcattactctagttaatgaaacatatgaaaagattattgtatcttcaattgtattctagggaaaagctgcagaaatttacagccaaaacaaagctatgaaattcgtcaattgattgtcaaatattctgagaacaatttttattgcaaattatttcttcaatttctaattttattaagttgatggtgctctcactttcaaaggagctttaagatacccctgacaagtagtttttaaaggacatcttaactgctgttactaattcacctagtgcaatccttcatttaaaaaaagtcctgctggtttatcttaaaaaataaatctttctaaagtttccaaactctatatttgcttagagaacacaaaggggaaataaaataaaatatatattatgttatgattatttttcttcaaagaaaagctgggttaaaattctgcatcatttttatggttgtccaaaagcttctaattttgtaattctataatatttactatccctgccattaatttggctatgacagaaattatagtttcatagtatgtgtgtgtgtgtgtgtgtggtgtgtgtgtttgtgtcttatgtgaaaagcaattttgtgtggcatatttattcacactggtttttcttttgtttcctttcatggggctgggccaataagcttcttaatgatgactttaagaaattcccatttctaaataaaaggtagttaggctaatacgctgcctttcccttactgataacatacctaatactaagaatatccattttaaattcaattacagctaactttgtgacaaacatatggtatatttttataaaaataattcatcatttataacaacctccagaaagtgaatcattgctgctataacttgataacaatgtatttcaccttttaaaaatgcattctgcacaatctggtactaataagaacattatcactaaatgtactggataagggattcatgaaatagtgacacatatttttatttattgtgtgtatttttttttttacattgctccttttaaactgatgcattagctgagttatatgttcaattattcattctgagtttttctctgaattctcttttttggaatattgcggaataatttgaggtagtttaagggactcactacacctccttctgcatattcttagactgggaccatggaaacaaactcaatagaattgtttatttaatattgtttttataactttagtatttattttcctgatttgaaatttatttttattaactgctgattacattataccttactatttaatatagacctccttttaaatgctaataaataacatattatgctttgttttatatttatcaagacgaatgatgaaaccacattcaatgttttattattgtttattgtctcaagatacataattgtatttacttactccaaaaccccaaattacttcattgctaaaattacataaattgttgtgtaaaaatatctaagaccaaaaagcataaaaagccaggagaaattaccacaaatataaataatatttatatagagagaggataggaaggaagtagagagactgtaggtcaactactaaataaatatggagaaacaccaagttcaaaatattgatagaaacagtctttaaagcagttttgttctctttgttttgtttcaatttatggagagttcttcataataattctttttcttgactactcgttagagacagggttgacttgcagttttaaagaatgtactgtggcactgggtcagtgaaatgtgcctgttatggtgttgctgactatagacgaggctgagtttcacttcaataccataaccactgagctggatttctgttgaccctgactttgtttttttttttttttttgagacggagtctcgctttgtcacccaggctgcagtgcagtgatgtgatctcggctcactgcaagctcagcctcctgggttcacgccattctgttgtctcagcctccagagtagcagggactacaggtgcccggcaccactcccggctaatttttttttttttttgtatttttagtagagacagggtttcaccgtgttagccaggatggtctcgatctcctgaccttgtgatccacccgccttggcctcccaaagtgctgggattacaggtgtggaccctgacattttttaaaaaggcttactggaattatatctcagtagccatttgcaactcttctccttttagctaccaggacacacaaaaagtattgctgtgtgtgtgtgtgtgtgtgtgtgtgtgtgtgtgtgtgtgtttgaagttcttcttgctcttgtttttataaaattttcaaaaataacaataacttaagaattagcttattcaactttactttaatgaatgcttatctagtttatccaatcacagaaacaggatattactataaggtacttgaagaagtttatttaactaggatttttttctaaagtaaatacaacaaaattattggttgaaaataactcttacttactgaatatctctgagccagaaatgattgtagatgctcaggatgtagcagtagaaaaaataggcaaaatggtccctgctctggcctctgggaataaaagaactaaacacataaattggttaaaaaaaatacaccacacacatacacacacacacacacacacacacacacacaaacacacacacacagagtttgtccagtggtgatgactactataaaaaataaataaatcagggaaggaacataaaaatttccaaaggaccagagaggagtaagtgcagtttcacaggagcatgagagatttgctaaaaaagtgacatttgtgcaaaaacgttatgaggtgagggagctagttacaggcaaaatgcaaaaactttgtggtgggagagtgtttgacacattcaaggaagagcaatgagacctgggtggaatgatggactatttagagtatttatataaaagggataagatcatgtagagacttttgggccacacagcaaattgtgatataattatctatgtatctgcccttttctttttgactctgagttctggaaaagcacgatcaggtgctattcatctttgagccaccaaagcatagcacttgcctgtcacagggaaggtattctgttggcttgaagtgagatttggatctcaaaaagtccaattctccttgtttatcagaacatgactagaagacagagtggcacccatctctacagactctggttaattggatggggacactgtataaatttcctgtggctgttgtatcaactataacaaattaggtggcttgtaacaaccagtcaggttgcacccacacttgggaggagacgattacacaaaagaatgaacaccaggaggtggaaataatgagctccacctgttgtctctccagcacacattgtatcttagaagctggaaaactccgtgggcacttatccaagcctagtgggttagggatggtttcctagaagacaccaaagatatgtgaatgaaatgcgcaggaaaactaagctttagctcagcaaaagaaaaacaaggcagagaagaatgctggagcaaatgtattgatgcacaaacaggagcatatgcatagagctcctggtaaagggtgagcaggggctcaggcagaagccaggaatcaggtactggagagccagacaggatgctcaagaactcaaatgcctagaaggattttacctaaggatgtcgcagtgcctgagatatgctttttaggtagaaattccgattaaaatatgaaaagggattcttttgtaaaaactagaggcaataactgtggttaggaagataattcagtgatccagccaaagataatggcctgaattaagacaaaggaagtagaaactaggaaggagaagagagtggaaaacctcagggaaccgtaagaacaaatcagagtggtgattcattacacttagaatttggggaaaaaactaggtgtctaagacatcccgctgagatttcaggcttgtatacagaatgaattaaagaagcaaccttacttagactttgaataatttttattttgatatatttcatttataccattttaagtgactacatctccattttagaattgttttctgggattatgatgagggaaaatcccttttctagcaatctttaatttgaagcttcagttgtcaacacagaagacatctatttaaaaaattaatgtgaaagaagcatttgtttttctttgtattgatgataataagtaactaggggaaaaactctgagctacttttacttaaaaataaatatttcttttagagatgtgatcatcataaataattagatgaacagaaatataaaagtacttcttatatagcttttttaaaatacacttccagcatttatgtggccaaaaatacttttttaaattcattatttaaattttcaaattttaattatgaggcatctgaaattttacaaaaatattattactgacacacatgtgcacataactaagattaaaaaatgttaaccctatgccttatatacttcacatcattcctttatcgaaagacataaaacattacatttatctcaaccttctcatccctcctcaattcctcaattaaattatatgcttaaattgctacaaataatatctacttatttttatatacttttatcaaacatacttatttcatcagttatctatattgccatttcaattttcaaatgacatatagtatgatgatgtgcttgttatttggcaatgcaatttttcactgaacatatatgtatacttttttacatttccatgttgtttcatgtagattccaattcagaaggctattgtatgtcctctccacattaatttattcattaggtacagaaaacttgtcttttctactgtttctctaatgtgtctctgtacatgtctctttgtgtattaatgtgttagaattccaactgctacttatggaatttttagattttggggtatgtacaccttcaactttgctaggaatccagaacacattccctggcttccatgaatataaatgagttcccatttcctgtctcttcactagcatttgttatttaaaaaacttacaataaaagcattactatctgttggatatgcaggatatcattttcttcataatttgtatttactttgcgacacagtactccaaacattatttaatgcacttcttgtccttttggtttcttgctctgtgaatttcatgtctgtatctttgcttatatttctgttgagatatatgttttccttcctgattagcaaattatttttattttctggatactaactcttcgttagttttagcttttgcacatagtttctactttttttgtatgtttaatttttgtttgtttatgacattttgatgtttttaatccgcccttaaagatctcctttgttgatgttgttaaaatggtcctcatatttcttttagaatgtttagtttattttaacctatacgtaattttttttttctgttgagtgttaaggggtggtgatttttttctttgtacataaggaacagctacctgtttcagcacaattcatgaaacagtgctgacatttccactgaaataggaaaagtgtctagtatcttcattctgttccattaagaaaattccatgttgttttaagaaatatacatttataataaggtgttttaactgataagatgccttcttcaatgtatctcaattatttgaaattatattgttggtgctttacttttctttttttgttttttagaagaagagtcagcttgctacattttaacaataatattctgtagattgaggtaggaattgttttgaatttaaaatttccctccctttacagaactgagtctatgattaaaaatactatagattttgtgtttttcaatatcattttactattatctgatatactttgattatattataattagagtaactatcttggtgtcttctatggtttctctgttctctcataccctatacacatgccaaccaaagttcctacattatgtcattaggctgtgcaggattctagccttggcaccccttagtcctcatttcctaccactctctgttttgtcctttctcttgttctgctccagccacatgggtcttcttggtggggaatgtgaaaatcacattcctgtctcaaggacattaaaatttgtgattccctttgcttggaataccacccagcatctccaactgatcctttgcttgtgtattccactgcacagcccctgcagctgatctttgcatggttgtctctctcatgtcattcagatctcagctcaaatgccacagtcacacaaagttctttctttacctttctttagttccttgcattaactttggacgccactcgtcattacctatctattcattacatatgtttctttatttcagaaaaattaccactcactagagcttttagttcatgattgtattcccagtattaaaaaatgactcagtagcctctcaataaatatttgttgaaaaactgaaagaatgaagaatctactcttaagtgccataaaattattttaactatgttttttcaaattatatcttcaaattgttattggagaataaaaccatgggtgatatctataaaatattatatatgtgagaagtgtttagtgcaaaataagtagtgttgtaaaataattttatttattaactcatggaatcctcatgacaacaatatagtcactattattactatttcttcttaaaagatggagagtttgaggtcagggagtttaaaatttttcttctcatcacttaacagtaacgatggagtcccttggatgcagtggagccactgtgctgtcactccagtgcctggaggctagaacacagaaagagtggttttaaccacgatccctggctttccgcctaggaaataaaattaagaaacagctagaaaattttaagactggaaggctatcaaaaatacatgaatcatgttcattgcttatgtatgacaactagctttcccatatcctgttaactttctctttcatatttaaattgtacaaaggaagtcatgcaccttatgacaacattttggtcaatgacagaccacatatgcaacagtggtcccataagattataataccgtattttactttcccctttctatgtttagataggtttagacaggcaaatagcactgtgctccagttgcctacagtattgagtacagtaacatgctacaggcttgtaggctaggagcaatacgctataccacagagcctaggtgtgtagcaggctgcacatctataccatctgggttattgtaagtacacactgtgatgttcacagaaaaacgaaatcacctaatgacacatttcccagaatgtattcccattaagtgacacatggctataatataagaaattataccacaatagaatgcatcattaatatattctacatttcataatcacatatttttatgaaaaatttactatcacagaatatcatttgccacttcattttactgttattattattatttttgagataaagtctctgctctgtcacccaggctggagtgtagtggtgcaatcaggactcactgcagcccccacctcccaggctcaagccatcctcccatctcaacctcccaagtagctgggactagaggcccacgccaccatgcccagctaattttttacatttattttttgtagagatgggatctctctgtattgcccagtctggtcttgaattcctggcctcaggtgatcttagtgcctcagcctaccaaagtgctgggattttagacgtgagcctccattttattttatacataaaaggtcttacaatcgtttaaacattaagactccctcaagaatatcttggtgatgtgagcacaagggccaactagacttgcctggcacgccccagacccccaccccgccatcaacacaaaaacccaaagcaacaaatacacaactgtattttacctggagtgactgaggaagtgcactggagagtacccacatggacctgcacaacggcgtggcctcgagcagctagccagcccactgtacgtgctcgctcctggcttggcagccaatctggtcagaccgcacctcattgcagagagtgctgcacagctgcccagccccatgccctggctgccctgctggaggcattcacacgcacccacccctggcctgaaaggggccctgccttcctggagagactgcagcagccacccagtcccatggtgcctgtgcaaaccaacacccaggccaacagcgaatccagcagcagccccagctccctggaaaacgcgagacagagctgtctggtccccctgcacttgcactcacacctggcccaacagccgggccaatgtctgccccgtgtccccagaaaatctgtcactgaggtgtcagccccactgaatgcacctgcacttggcctgaaagctgattcagaagtgaactagccaccccacccccgctagtccctttgcacctgccctgaacatgcctaacagccaatgtggcagtggccagcctcctggatataccaccacatacctgcacccaaccctacagccagttggctggtgacctccacatcccaggagagcacacgcgacagcctgtgggtcctgcacaccaatacatgcccagtccaacaatcaatgtggcaccttcgcctccagcgaaaccatgccatcaccttcacaaattcctgtaacctaggccacttgggtaatcgcagacctcactgatgaaaatcacagctgaagaaactgcaatgaagaccatgctactgagtccacccagaaccacagcctatgcgccacactcaacaaacaccctaggaagcatctacaagaaagagtctcaacaaagtagacataggaagtatttaacttaacacaataaaagccatatatggcaaacctacagctgacatcatactgaatggggaaaagctagcagctttttctttaagatcaggaacaaggccaggcatggtggctcatgcctgtaatcccagcaccttgggaggccgaggtgggcagatcacctgaggtcaggagttcaagaccagcctggcaaacatagtaaaaccccatctctactaaaaaataaaaaaaatagccaggcgtggtggtgggctcctgtagtcccagctacttgggaggctaaggcagagaatcacttgaacccaggaggcagaggttgcagtgagctaagatggtgccactgcactccagcctgggtgacagagcgagactctgtctcaaaacaaacaagcaaacaaacagatcaggaacaggacaattatatacactttcaccacttttattcaacatatgactgaaagtcctagttacagcaattaggtaagagaaggaaatacaagtcatccaaattggatgttgaagttcttgcttaagtctttagtgggaatctcttgagaaatgcacatcagagtaacctgctagcttctctgtttttccccagaatggtttagtaatgccatttggtttgaattcctagtagattcataaagaatttctccagttctgcctgcaagtggctattcaactacaccttgccatttaacagtgtcttacacttttatttcattagtagtattatttttagagacagggcctcattctgttgcccaagctggagtgcagtggtgcaatcatggctcactgaagctttgaactcctggcctcaagcaatcctcttgcttcaacctcccaaagtgcttggattataggcatgaaccaccacaaccggcccagctttcactcataatatgggtctagtccagcagaattttactgagcacccttgattgcagacacatagaaaagtatcccaggacattcttgttgacagttctactgtggattaattgaaaatttgtatttatatgtgaaattacagatttaacatatgatagtcactttcctgtttactggtgttctaatgctgatttttaagttaattttaaatttccaactattaacgactaaaagttcaattgcagattagtattaaaaccaaggattatatctatcactgctttatataaaaacaattgtcaaagaaattctgatactgtgtggttagtcaaatttgaatatcaactagatgttataacatgatagttaagaggatgaaaattgtgctttatccattcctgcttacttttgaactgtgttcagtatatttcagctgtcacttgttcactccattataagaataattattaagaatgagctgaaaaaacacacagttcataaaactaaaatccttaattcacatttgtatgttgtgagttaatgaaatttgttttcaaaaaaagcttgatttcagaaaaatctaattacattgttatactaaaagttatcagctttatcattatttaatggaaagtaataactgatagaactgtttatagtaatatattatagagtgatgtttttcatttaataagtttgttggagaagaagacaacatagaaatatttaatgggggctgcttccctagagttaaggatattttttgtgagggtgactttaaataatattttagaaaaatataggtataggtgtgaaaactataactgctttccaatagcataaatagcatacactcatactaatagagtacctttgatggcatatatgtcctagtctttcaagtcactactgttttgtcaaggttactacaacaattttgaagcttggcaaatgaagttacaatacataacctggtacgtgcctttttttccgtagtcaacaaccaaaaagtgaattgtgcttggtggaaaccgagtgttgtaaaaaaataaaagattattgactctgttcgttatcaactgtgaacagctgcacagggaagctggaagccagtgggcccgccaagcacctctctgagactgaagccatttggagccaggttggaagcagcgggagtctgaggtgtcttgtctagacagcagaggctctgtatggctcttgaagaaatgggcaaaggactttatagagagaaagtccttccagagttcttggcacaaattcatctacctatttcctttttgtatgttactattaaaatgagtagagaaaccaagacacaaaataaatcaatgggatgtttagagaatgaaatagaatggtatacacatctaagtttagaacttcaagaaaccttggcaacataccccaatttccttattttatacatagcaacacaaatgtccagaatagatgaataaattgcatctgataatacaattggatcaccagggatccggaatgtgtatctaaattgctggcatccatattcaataccttttccaggtgtcttaaatccttgtgctcaaaatgtgatctgcagagcagcagcatcagtatcacctgtgtgtttgccagaaattcagaatctcaggctcattcatagacttatgaattagaatctccatcttagcaagattgcctgtgtatatgctgtattaaattattgaaaagacttatgaatgataactatgttcttgagtgataaaggtggaaaattgcgtatgtacagtaggaaaaaatcttcagatcatccatccgttataacgtttagttatatgtggctagcatttttgttaatgtcagccacttgtttgattttaaatcagtccctctcttaatacggtaatttgagctcatggtaaaataagaatatttctgtttttcaataagtataattttaaatttatagaaagacctgggtgctgtcaaaaattttagtttaagccataaaataaacagattttaattaaatgttttgttagctttcatatagacaaatgagttttagtttattttctattgttgtctttactactttacaaacataaatattgaaattactcaagtatctataaatgagaaatagttataagccaattaattgttattaactgattcaacaaatattaactttaggcactatgctagatagatatatagtttattagggatttatttagactattttatttcacataaaattctgcaaaacaatttgtgttgtatatttacttaactaagacagttaacaaacgattatgattggagataaaatgcaagaattattttaattattttactaattttttttctcttgttataatattggttcaggttaactagtagcagtcacacgaattataaacatcagatttactatgtcatctctctataacctatgattccagagccagttttcactaatagttactcaagattagacagcatttagaaaattcagttaatattcttttagtcataaaatttggaaacacattaaagattatttatagactatagttttttctcttttcaatgtaggggttttcaaatgttataaacaccacgggactttttaaaatttacattcctggactacaggttaaagtttttggcttcattaacttacaagaatctacttttaacatatcttctgtttatttctatatactctgaaggtggagtccctttgggataaataggctagtgtatctcatatcaagagatgatatgacttcagtttcttaaaagtctattggcagacaaggtagatgaaactaagattacagcattgctctcatctgtgacataagatttgaattgctgacaaatatatgtaaatatttaggggacatttcaagaacaatactaaaataatctagagcagtgaatgcacattcatggaagagttgacactaatggtacattctctttttggtaaaaccaggaagtaaaaagacccttctttatgtatgtatgtatatctatctgtgcatttacttatttatttttgagacagggtctcattctcatttccatcatgcaggctgcagtgcagtggtatgatcatggctcactgcagcctcaatttcccaggctcatgtgattctctcacgtcagcctcccaagtacctgggactacaggtgtgcaccagcatgcttggctaatttttttgtattttttgtagagacagggttataccatgttacccaggctgatcttgaactcctgggctcaagaaatcctcctgactcagcctccctaactgttgggattatgggcatgagccactgcacccagccaagacccttcttttagatttttcactaacgaagtggttcatttggaaactcttagagcgaaaaggctagaatactacagtttctgttaatgtttttcttcctatattcctgtcatattaaccaatttctctttaaatctgcttggtggaaactgtgaaaaactgggaagttgaagtttgacttacttttcccttgctttctccacctaactctttttttctccccaagaatgtcatattccaatgatcccaaaccctagagagctctcctgacccttgaagcattgtctagtctcccattcccatgagaaaatgctgccatgttctttcatgcatgggagagaaactgtatcacttttttttgcaggatgtgagatgccagtagtaagtaccctaagttgcttgggcagtgatgtgagaggtacttccggacaggttccagttagatttataaccctaaattttattttcaaaatcctaatcaggccgatcaaaggaagagtagatatttggaaatgcacatctttgaagtgtgattttctcactttaaaccatgtaagctggcacctagagttggccctgtataacaatatagtcaagttatatattagtgatgctagagcggagtcatagcagagaaaaccagaggatagcacccaacagactatttgtagcctgataaactgagtcttcagcattattggaagaaactaataaggctacattgaccctgttgactgaagaaacacactgactctcttttttctgttttgagatggggtctcagtctgttgcccaggctggagtgcagtggcatgatcatagttcattgtgcagccttgactgtccggctcaagcaatcctcttacctcagcgtccagaatatctgggaccacagcgacatgccaccacgcctagctaattttttaaattatttgtagagatgaggtctccctatgtggcccaggcttctatatttttgataacacttttaccacatgcatcagccttcaggagagcaaatataagtaaaatcctgaataagtgtacctctgtaaattttatggttccactagcttgaaaattcctgggcaggtgtgtagatgaattttgtggctagcatttttgttgctttcttgcttgggtaggtaaagaatgaagacctcttttttaccaatacctagtcagggttaaaaatttggtagccttcatgccaaaagtgagcttcatgtcacacagtaagtgaagccatactaataatataaaagtaggatttggcatgactaatcctcagaaaatatctatctgtggataattcagcattattgaatagaaaacttagacaaaaaattatttatggtctccaggttgaaataccagtttcctacattagtaaggagcctgttttttaatgaacaaagtaacgtgcatactaatgtggctcatggtgttgccataatcaaatgtccctttttggttcaaaaactatcatttaatagaagtttgaaggcaagccaagtacaatataaatagaccaagtgggtacaaaaacctgttcagtacttggaaaaggtatgtaacatctgttcaaagtagaaagcactggttcactggcttaattggaggtgtcctagaagctatttttttttcttctgctttagctgttgatctggttttcctctcaggttgttgtaattaaggaatgcatacttcgtatgaatttgatgcagatgaggccaagaacatttttgtaagatatggatcattttcttttatgccaaaagaggaaattctatagtgtttctaatataatcagttagtctctagaaattattctcagatacagtaataaattactttgtgaagcattcatttgtgcctgcaagttaacagtaccattcttcccataaaagggctattataatctaaacttgttggaaaccaagacaaattatgtaaaaatgacacaagatatttaaaaacctatcatgggatgaacaatggacatatatcatagcaagacatatatttaattgattcacttttagaaatagtttatattgatattctgttcttcacatttgcacctcagaagaaaacatattcaaatgaagaagaaaaatatacgttaagcctctaatttgctaacacactaggagaataataaaagcctctatgattacatcatagagtagatattagttcaaggctaacagcacatctttatgtccaatctctagcaacaccaaatgaaaccttccagctgaacctgcaagatcacgcttcacaatacaagtacccaagaaaaatatcttctggactcatgtgcttagctgtggagtaagaaattctactacttcagatactgctgggtggatgaattctccttctctattatctgtacttcagagtcagacttgaaagggaactagggaaacttgcctcagttaaaacttaactatttctggggtaagaatttggctttagggaaagcaattcactgtttgacatgagtgcgatgaaatgacattgaatttttaataagaattactattgctattttattaatatttgagaattacatctcagaaatttttcttacttatttttccaattatgtaagtctgtatgaaacagctgtgtattccttaacaattcttaactcatagataaaaagttattccaaaggactattgactccacgaaacaatagatttttagaaaagtatacatctttgactataaaagagcatgtgatttaagaagtttgttttttgtatgcacatgtgatatacgtacacagaaattactcttttcccttatgtttctaggcctttattctgaaaactggagatttctgtgaaatcaaaaatctttgttctcttattcagtctcattccttactttattcagctaccaccaagcagttgaaatagaattatggaatcagcttctaggtgaaacagtttcacaccttctgatcaaagagtcttccagaaaaattggtcaagtaaagaatggttacataggcaaatgaaaagtagcgaagtaaatggagttctgcttgtgtccaatgactagcaggaagagccccaattttagtgttttaattatttgctaatgaataaacatggaaaaatagttaaaatgattttttaatgataaaaaggctcagtaattattaaacaacaatctgtccgtgaatctgtaaattagatgcatttttgtggctaatgctgacaggttttctttcagatacttgggttgtttctcgccgttctgccatgtgttgtgtgtgtataaacctagttatttccataacaaaggccactttttacctgtaggcttcaaaacacaccaaagatgtttaggaacagttggattttttcttttttttaagtttttgaaacttgcacatttcttttcaataacttgtaaaggttcatgctgtagaaatttaacatttcctgggtcttttccaatgcctgcttagtcattccccagtctccagcccaagggaatgttaagtgtgaaatatctcatattctgctcacctcctacccctgacaacaattactgaatacagaatttctatagcctctgcctcttgtttgaagttgtgactcttgattcaacttttctcccacacttgaatgccaacattatagaccctgccatttctttgtgtagcatttctgtgcaatgccccaacacccatgaaattatgatataatattgtgtgcatggacatctaggaagcactagtccagatttttacacagtatgatactataaagatattgctttggagtttccagaaaaaaatcatctgtgtaagtgtgaattaaaagcaatgttgaataaatataacctgcacattccattataacttaattttaaaagtgaaaactgaattgtgactaaagtgaagataagacacactctttctcttaaaaccaatgtttagattcatgggttgggaaatagaagtgaaatgaatagcacaaatattattaactccaatcaccgtgaaagaagcattagaatttcctattttgcaaagctagggctatcatcctatctaatgaaagtagaggaagaaataaaagctaaaacacctttgaaaatccatggcttatgggtgtgtaggctgcagaagtagcaactaaaatgtaaattgatagcattttttaaccaaggtttcacatcttggttttcataaggtttactggtttataaagataaataaattattagcatagaaagctgctatttcacaatagtaggtggtggttgggaggtatcttaagttgacattgatctcaatctcctgaacattttttctttgccttcaccaaaaaaacagatatttaaaatggaaaaaaaaaacaattaaatctaattccaataatttcagttggaaaaaagaagtagtggggtagctagtggatttgctttattttatgttactcactcatgatcaaatgtatgtaataaatggtaatttggtgttacattggcattaactattgcttcctgcactgatgattttgccaagtgctaatcaatatactgattttttttgataagccatcaataggtttatttcttgtaataaagtatttcattagaaaatttgatatactattcttgggtattagataaatactatacctacttttattactccttgctgtatatactagcaaaatgtgtgaattcatgaagattttgactatttatgtaaatataattatatttataaaattgttagagtgctagtaaatgcatccagtgaaacagacacagaatgtattttcaatctcattaattaattagaatacagaatttctctgtggaagtccccaaatcatgcaaactgtgtttaattacttcagtactgaaagattgagatgaaagatgaaaagaaatggactatagaacaatacgttttacagatttagggttattatccttcattgtcaaaatagatatctgctgaattaataaaaatataaatatttaatagaaaatttgttgtttatcaggatcaaagttagattatacaggatacagataaacaatcttagatacatgacctacctactaagaacctaaaaatctaaatgggatacaagtttacatgcctgaaacaataaacagacaaaagtgatgatatactcactagtaacaagatgaatatggaatcatataataaagtcctaagtagacttccgatgaggaagctatcaacttcagagtcccacaatcatatgtatgtgtcttggatttgttttttttaactcactgtacggtcttcgacaaatcactttacttgtatgaatgactgtttcttcctctataaaatagagttgatttcatctatcttgtatgtatgagaatattgaaaaaatgatggaaaacacacttctagtcatgtgcagtgtgtttgataacatatctcattattaactgtgaaaaaaactggagaaaacatcatattgtgtcctcagaaaatacaaaagaaaaggagggacattgaaggtaatttctgaaactattgataatcaaagagtgggtggaaatggggaggggatgcaaataagaatgttgtattcttatttggggatgcaaataagaatgtctgactcatctttggagctcacattaccataatacatatagtggttgttgaatgaataatacaattaaatgaatcaagaacataatggggagtttggttgactacaaaagtttaatcttttgtaaccaaacaatattgctcttgccttagaagatctgagctcttgaaaaaagaggtgaagggccaggcgcagtggctcatgcctgtgatttcaacattttgagaggccaaggcaggcagatcacttgaggtcaggagtttgagaccagcctgaccaacatggtgaaaccacgtctctactaaaaaactacaaaaattagctgggctttgtggcatgcatctataatccaagctacttgggaggcaggagaatggtgtaaacccgggaggcggagcttgcagtgagccgggattgcgccactgcactccagactggacgacagagcaagattccatctcagaaaataaataaataaataaataaataaataaataaataaataaatatataagtcatgtatgcattataagaaaatgtataatcactttataagaatgttatctcatataatacaataaggttttaaaataatgtgaagaatcgagaaaattagtgattgatgggagtggaaaattaaaaataaaaaaatttaaaagtcaggagtcaataccaggagaattaataatctacagtcacttcaggataaattagaatctatatttacttcattatgtaatatcattaataatagctacatttatgtataaacctagagagtcgtatgaatttggaaagaactgtcatggatggttaagcagagatggaacctgtagcaagctctctgtattgtgagtgaagcttgactcattgttgactgtattcattgtagaactctccaccttacaggtgtcgcatgctatttcttcacaagtaccatttgatcttcaccctttatttgaaaaaaaagaaaaattagcctatgcaatactaggaaaccattaaccttgcaatattgccagttctccccaaacattcttctcttgaaatatggtgcattttcccccttgatgcccagtgaattttaattttctataacatgcaagatgtataggaagaaaattcttctgtaacattgacagtatgggacacgttaaagccaagtggcctttatattttcatttttgggtaatgccagttgtgtcatcaccacagttagaatctttacgattactttgaggaagttcttcattccactgctcctttagatggccagggttcttctgctgtagcttggcaggttttcctacctttgaaaaaggaacctgattcaacagcctctctacctacttttatggttcttcactctcttgaaagaatccattgatattcttgcttcgaactggcagaatttttttcagttggagacccttctaagcaaaaattcacaaagaggtatatggctttatttgtgagttcttaagaaaattatgtgaaaattctgtcactttaacataaacagtattcagcaaacattcagaagaaagaagttaaaaatagaattaatatagatttaaacatgcacattatccagcatataacacctgtatcgtaaccttttgtagctattaatagttttcatgctcaaagttattcaggaaatagttgagccctttagtgtcattttatttcttggtttatgctatagcgattttaacacatataaaacaatataacaaacatttaaaaataggctgcgttcggtggctcacgcctggaatcccagcactttgggaggccatggtgagtggatcacttgaggtcaggaggttgagaccagcctggccaacatggtgaaacccggtctccaataaaaaataaatagataaataaataaataaataaataaatataatatacagaactgtaaagacagagaaaaatgaggggaggaggtatgctacatgcataacaggaaggttggtatcagaaatctcgaatggcctactgcatgccatgtagccatgatgttttgtattttcttattttgattttactttcatcttaaacaaaaagcactttccatgataggtcttatttgaatcactattactctgcttaattctaatacaataatacacaaaatatgtaggctagatttccttgcttgagaaaaatgctgtagtgaaggatttcactcctaagtctgtttatgattcatctactgaatggttataagttaataagtggaatgaaggataggattgtttgttttctttttcacctacagaatattttgtttcaagagatggacaatacagattgcacctaagagcctgtaggcaagccatctgagaaagttttctgcatgcagccatcgtaggatctatattgcagacaagatatagaattatatgctcaattacgaatgggtcagctgtcccaagtgtctgatgtgatggttgtttgaaagggtgccttgcacatttggccatgacttgcatcagaattcttattaaaaactaagtaatacaactgaggctcaatccatggcacagcccagccctcaaaaccaatattcatgagtaagtaactaaatgactgtgctccaaaagcagagccttatttactggtatgccgtctacacaaaaatattagtattataagttgtccatgagttcattttttccatagtttctctcaagggggtaggattgttgttttatcatcaatttccaccttcagaaacattcaggagttccctcccatcaaacaaacaaaaacaatggcattaaattcattaaacagttgtttagtttctacaatgtccaaaatataagttcttatgatagaaaaaatattcacaagtacatcagtaactctggacatgatgcccctcgggcaccagacctcatctgtgagcaaggtttagtttctgaaagattccccttctctctcatcggtagccttccaaaggattcctataccagaaatagaagtcaaattttcatgcatttattgacttttaggatttccaagttagagatggaattttacttcttgattgctgaaattcttctacaatcttaatacagcaaaatttagaaatattacatattaaatgtttcactacattcaacactctctgataagtagccacctatatttgtctctcttacttaaagtgtgtgatctactagtagacatgctagaccaactaactctcaacttacttttctcaaggcaatgttattgtaaaagatctttaaaaaaatctgtatttgcttgctacttgatttcatctgaatcccctggtcttcttgctctcaaccatttatgttcttaacgctttctcagaagaaagaattcaaatgcaaagagaaacagaagataatcacttctgagttaatgttttccttgaagttcaaatccatggatataattttattgctcccttaggatttctatagattttcttcctacgggtaggctttttttaaggtaagctatttttgacaatgctatagttaagagactagaatgcaaaggtggtataattttcttaagttaagtgaattagctttcttctttaactccatatttgaacctaagccttctagaaattatagaagaacatattatatcctaaactaaattgtaataagacttgccttagtaaaatgaaaatactttctggagtctgtgtgtaatttacatacaatgatatcagcaatcaaatgataagaaaaaaataagtatatcttttcattataaaaaaaagcatccaaacactttaataaagtatttcttaaaagatagataattttgatttataggaagatccacccccagatgtccatgacttgtaattttaataccttattaattgtagctttctatattttagggaaaacattcagatgcaacattgtgttggaatagaagaagtttattccataaaaatattaagtgtctactttccttaggatattgctaaacagtatgaagactaagtgatctacgccacagcttcaaaattaaaaagacttgaatgagattaatatcaggtttacttagttgacacccatctaaacatttagtatgagtctctgtaaccttaacaataaaattagggttttggatacagtgatttctactggtgttttcaaagaaaaagtcctattattctataatcttatgatttggtcaaaagcttgtgaccttgagatgcttttaaatatatttattgatttagtataaatcagaaaatacattcatttctaatccatcttagacaggtaggagagttatatttaagtttcctctgggtgtgagaaggaaaatgagtcatcatataggtttctaactatcctgtatgcatttcttcactaatatgtaagttataaccagttttaacactcaaaagaaatttattgttgcattatacaaagatacttaaaaaaaaaatctcacctgtacttaataatttgtcttttgttgaagctaattgataatgatatcagttaagtccttagctacctatgcttttataatattttatttatttatttattttacctaaagcctgctctaagttctgttctttttcaatcagaagtaaaagagtatagaaaatattagtggcaggacaatgtttgctgaatcaaaagtcatacctaggtaaatgcctcttgagaagatggcgggaaggagctctcttattcagactctgaaatttcaataagtagctgagttccgaagtgtttatttgaacagaatgtttaaaaaacataaaatttcccctttacaaccaactctccagatacctagcatgttgatatttagattctaaaatttatatcaaaaaacatcattgaaacagatgctggtaatatcattgactgagaatttgcattaaagatgactcttgggtgtgcactcaagcgttcatatgtccattaatagctacttgtggggatattatgacctgtttagaattcttattttttctcaaagtttttaaggcataagagaagattaatagctgctagatgaaaccaaaaggataagcagcaatgcagtgaagagtgttgtgaaatacacacatttgtcatgactcccaagtggcaaataaaatcaaagttgaaaatcaatgtctattgatcaatctattcgttttcatgcaagttctataaactatgtagtactgatgttagtattttattggcatatagaacagacataaactttccttttctcttgagtctttctgctcataaagaatttaaaataatagcatgacatacataaagtaagatttgttcttaggtttcggggaagagcttataaaacatgcatacattatgataaacaaaatggaaggtacactgcaagcaaaaaataaccacatttaattgtttttcagtctggcttttgatatcaggctcaaaatttgcttgcaaatttaaagacattattctgttttgggaggtatatagttatgaaacttgttctttcaattatagtcacaatataaaattactggatatgaatcttgaggcaatcccaggtgactggatattgtgttgacaatgaaaacatattaataaatgttgacttacgcttataaagagcttactgaaaaaaatcaagcaaatttgtgcatggcttttttggattaatgtgatagtagaaagaggttatggtatatacacataagcagcttaacagatagaattagcaagctgggtattgccaatacaaaatttgtagttcaaatagaatttcagaatgttccaaaactgtcctaatatctactatttcaatgattagaaattagaatacctttcattcctgaaaaatacgtatttacaaaatcaaaatgtcagagtcacaggagatataagctatttccttattaagaaaagtttaaataataaaaagttaagtcagtagaacaatgactaaaataggaaaagtacaaacaaaaattgttagatgcacctgtgacaatattgtctagttactgcttttacagccttagcacatattttttcttaagcaattcctgggtagagttttctacctctccttaaccagccagttcacatcagaagacataaaccccttggtggatgttattcatctctctgtctcttgctctgagctgcgtattgcacagtaggcattcagtaagcctcatcgagctcgtcttctcatgggacatgcagaaaacttgtagacaaatgagaggagagtaactttgaagattgtgatacatgttatgaagagaataaactgagtgaagagataacatactttggataagctagtcagaggcggcctctccaatgccatgagtagaatgggacacttgtgaagagtcatgagggaaacatttatggcagggggagcatctggtacaaagtcctggaggaaaaggatttggcatgttagagggacagagaggggccagaagagaaggtctagaacaactccagagtgtagggcagagacaagaagaccccggtaaggactccatatgttttactaagttccggggggtacaaataaaagcttctaaacaaggaagtgaaaatgtcttgtttctatttaaagattgccctggctcatctttagaaaatggattagatgtcgggagatgaaaaagtgggaaaaatgaagaataactggctattacctctttgttcttcaaaattgttctcatttttgaatactttcttacatataagtacaacctaccccctttcctctttaaattcttatccattatctctctttccgcatgtatttaaattgtgctccttccttcatttttatgtcattcacctcttttgctttctcccacattttatttttaacttgtcgatgttaataatcatttttaacaaaaatttcacgtctactccaaataccacctacttgcacctggcagggttgagaagcttactctagaacagaaaatatgaattataggttgtaagggaagaaacatctgcactgagcatggttagggttaacttttgcctgccttaccagtagtaatatatctaggtcagagcagaggcaacagaatgctgccttaagtcaaataactcacttctttctcttttagatacattgggtgaaggacttgaatgttttcaccacttgtattcacaacagagtgctgacaggaaacaacacacaaagagtgaactgactatagggagatgaatggctgcttaactcactgcctagtccctcagtcctgtctacaaaggactgaaagctggcatgacaaagactaatagtagattcaggatgaatctcctctggtccacatgacccaggttcagttcaatctgggaaacaggggtggaggaaaaaatgtattattcaatcaactcaccctcacctccactagcagcctaatatgtactggagtttgagtgacgcaccagagccctatcaactgaaaagcctgaaactagaggaagtctcacaaatgtcaatggttattaatttcagttaactgattaattctcattttattagtgatggacttggagggttctaataactgactcttgaagaattttcatataaatgttattatatattttcacatagcacctttttcttcccatttctcacttaggtacaaggtttcactatttcatttatgtaatagtgagatggggggaatactgtaatatcttttatacaccacagcaacaaagacataacattttgttctgtttcatttatgaaggatttagaaagaaaatgatctttaaaagaaaattcaatttttggaaaaaaaaaatgacagtgaatggcacagagcctctttatttcccttgaagctgtcagagtcagagaagaaaaccactttggggtatgagtctgcggtacctgtcataagactgaaaggacttgatgttgagattttattagctctgacaatatgggaaaattccattctaaactgtaataagtagtatataaagtaatttagatatgccagtggctatggccctgggtgtaaatgtatataccatgtgcgtaaataaagctggggtaaatttgccactaatgaaacttctgtgtaatttaggcttttttgaaattatatgaagttttgaaatgtgtgtgtgcttgcatgtgtgtgtgttttaatattaacactctgcaaatacattatctcccttttaataaataaaatttgaaatatatgtgtgttactacatgcatatctatagactataaaataaatggatacaaaacttgcccttaacaatttatgctgtttaagctaatattatattaacgcaataatattatgatatttttcctctctctttgaacatagcaaacattttctcttccatcaatgactgtttccctttggttgtttttgcaatgatgaaataaaatatcaacacatttcctgaaaaataggcaatatctcaataaaatttactgttagcaaatgatgcccagctttgtatttggcatttgtcccatatgagaaaaaagtcaattgcagaataatatggacagtcttttcaacagtatgacagactcgcaagccatatatatatacacacacacacacacacacacacagacatacacacacactcactgagttgacatgacaataaaaaaagtattcagagtgcgtccaaaaaggaattgagaacaagaatctagaaaagtgacccaaagagtcctggcagccggtttctctgctaatcccacatgaacttgagttttttattctgatggccttggggaaagcaggagagagtgcacagaggccaggctctgcccagcattgtaggggagcccactaccaaaggactgtgtcatcagtttacctttaagatacattaagaaaacaacaaaccttacatagcaataacaagcaaatgtatcttttttacctgggctctttcttgagtggtccccaagtactcactttagaaatttatatttgtgttcttggtttctagaatgtccaggctaggggaagaaataaatacaaatcctctctgaagctaagcaacaacaattcaggcctcaaagattttcacagataaacttttttgattatgcttaacaattttttaaaaatcacaaaacctgagaggggaaaaaagcgtaatgtataaaagagggtgaaggtgaggggcagaaagtagattgaggtggaaagtattgcagatattgaaattctcagattcaaattacagaataagtagatgaatgcacctactagaataaaaagtgtcaaaagcaagactaagtaaaaatatattataaaaatgacagcagagaaaaaatataataattaatgaatcacacaatgagtaagttaagtagttgatatgaaattggtgaagaaagacagtaaatgaaatagaaattttatataaaatgattctgaaagaagtgtggagggataaaatggtagaatgcgtaaaagagaggctaagagatacataaggcaacctagttgtaaaaagattttaaaaaggaggtttgggcggggacaatattaaaagagataagtgatgaaagatgtaaattccacccattcaaaataaatctccagttggaaaaattaaatgccatccagtagaaccatcagagttgcaaaacagagtaccaaagatctgagaatagccctggcgagaaaataggtattctttgcaaagaaacaatagttagactgagagctgattcctcattactaaaaatagaatctagaattgattggaatattgtctttgtcataacttaataacagtcaacttagaattgtatacttgtcaaaaatatcattgaagcataaattcaagataaaggcattttaataacagatcaaagaaacaagagaaattcactcaaaaatgataaggaatgtacttagggtaatagggaagggaaggtctgaatcataacaaggaagagagagcaaaaaattagttaacgtaggttaaaaaagagaaaacatcaaccttataaatcaacaataggatgaagtttgtggagttaataaagaactgaaatactggacacagataggtgggtgagcaaagtaaaatcttttcttttcttttttttttttttttgagatgaagtcttgctctgttgcccagactggagtgcagtggctcgatcttggctcactgcaacctctgcccccaggttcaagcgattctcctgcctcagcctcccgagtagctgggactacaggcgggcaccaccacgccaggctaatttttgtatttttagtagagaaggggtttcaccatgtcagccaggctggtctcgatcccctgaccttgtgatccgcccgcctcggcctcccagagtgctgggattacatgtgtgagccacaacgcccagccagtaaaatcattttaaggagaagacaatacacaaattattttagacttgctgagatgattacctatgttattatttctaagacgcacattaaattatggaatgggtgtacagaatttaaaactgatagagagaatgaaatgtaaaaaaggaagaaaaatataaaatacatcaagaaaaaagaaacagagaagtaacctagaaaaagcaggacacatggaaagtataaaattaagttatagaaacatatccaagtgtatcagtctatttaataaatgtaccaggaataaacacactatttgaaggaacagattgtcatattagacttaaaaacattccaggtgtgtgttgtatatgacagatacaattaaacatgagaaatagaaaggttgaaagaaaaaggaagaaaagaagttgctaaaaaaataacagaagaaagaattattttctaaatattaatatttggcaaatagacattggggcaaaaagtattactagagaggataaaattgactccataataatataactttaaacaagctagaaatatgtaagtattataatgcttataaatattgtaatgtttgtatgttatgcaatgtacatgataaaatgttttcaattatgctatatcaccttttacttaactgcaaggagaaattaatgaatgcaacaaaaatgggagattttagcaaatagttctcagcaagtaagagattataaaaatcacgagtaaaaatttaaaatactaaaaaatattaacacttttatatattggacataagtaaaacattgtgcactcacatacacacaacagataatatataattaagcacttttaaaaattacttgtgctacacaatggatactaatttcaaaatgtcaaatagataatatctttcagaacacattcaatttttaaaaactggaattaagtaagaaatctgcggaaaaaattgctggaaaatatttaaaacacttttgaattactacggaatcaagaaattacgctaaattatacacttctactaatagtatagaactttaataacatatcaaaacttgagggataaagctatagcaataatttagaagctagtttgtaacctgaactcttacagaaataagtagcacattattgagcaatgtatcccagagttacatgcccaataaactagtaaaatattttaaaaatgaaagtttggaaagaaataatgagtataaagtcagcaattaatgaaatagaatacaaagtgtaatagagtaacaaaaaaaccattctttgaaataaagtaactaatttaaagagtttgcaaaattgatcaagtaaaagtattggaatggagataaactagtgcagatggtgcagggatattaatggagataaatatatttgaaaacacatatgtcaataaatttaaaggcaattgaccaggctttgtttatggaagtatatcactgattaaaacggagtcaaaaagagattgaaaatagaaacggccccataagcataaagtacatggaattgtgaatccaaaattttcctaaagcactgttttgaaaatttcactaaatattcaagcaacaagtacttctccttcttattcaaatggttttaaaaaatagaaaatttcaatatatacaatatgagaaaaaaattataaaccaatctcaactattaaattaaatgcaaaagcctatatatattgatgtttctgaatttagtgatgtgtaaaaatttcaatgacttattatcaagttcaattttttagggatgctgtttaacatttgaaatcatttaataaattcaaattgaagtagcaaaattacatgatcatttcaatggaaagaaaaaacatttgataaaatttaaaatctcttatgataatagcttttagcaaactaaaaatataactgtaattctaacataggagagctacactaaatctatggtgaatgcctgatctaatgagtaaaaataaggatcatttcttttgtaatcatgatatgcactataatcacttttttcaaaatcctgtacctttgggttatagtgatttaattagctttagaaagtaataaatatataaaccttgaaaagaaaggaaaagagcttgaaattattcatcaataatgagaaaaatctaaaaattaaatgctagaattaataacatcatttagcaagttagctattttaaatcacagcatcaaaaagaaaatatatttttagaaagttagcatttacaatgaaaattaaacacaagataactaggggccaaattattcaaagaggcgtaaggacataatgttgaaaagtatactttactgaaaggcaatgaaaaaaagggctaaaaaattatggatagtgaaacagcatagtcggttaccccaaattaatcataaattcaatagaattctaatcaaaattaaaatggtgtgcgcatgcgcacgtgtgtgtgtgtgtgtgtgtgtgtgtgtgtgtgtgtgtgtaagaaaaaagagtcaggaagagccaagatacagaaggaaaattagcagcagtataaagacttgaatgacagatattaagacttactactttcagtccacatgctattggatctggagtagaaaaacagatcaatacaacaatcagctaagaaacagaaccccttatgtgttgaaaattcattgatcagaattggcattgcaaataggtgaaaaagagatgaaacattcaataagtgatcttggattttaattatcaatatggaagtttatttttaccttatagcatatattaaaactccttaaagaaaattacagacctaaatacaagacattcaatctttaggagaaattcactttagttttggaaagaatctcctagaaatagaatttgcagctttacattaaaattgagtataattgtatgaaaaagcaacatacatggaggacaaatacaagccaatgacacaaataactgctaaataatgaatatcaagagtatatatttttatattccacagataattgagaaatagcccaagagacagtaaaggcatggggatttatttttaagaaaatcaaacagaaatagacaataaacataagaagaatacctcattaacaattggtgaggaatacattttaaaagtcattacaatggaaaaatttaaacaaatcttattatgggtttctggtatacatattaactggcataacaatgttcaagaaatgatcactgtctagtaaggttgatgtgcaaaccttatggaccagaaaatctactcacaaatataatgtgaggagtggttttcaaacttcatttgattgaagcacatacgctaaaaaaataagaaaaatgtaattaaaatttatgtagccttattttgtgaatggcactctgtcattttgtattctatcaattatgtttaaaaattctattcataactcattgggttgatttcatgccaatgaagagttgtgatttatgatttgaaatacactgctccagagcaattcttgcactatgtaatagaaaaagtccaatagaagtttcaaaaaaacatttttgtagcatataaaaacacataatcatgatgcctacttataagaaaatgaggactagcttgtgttgtatagttatacaatgaacaattatgtagcaataaaagtaaattaaatttagttcacaaaagtcatcttcaacaaatactgcaaattacgtaagaatacagatgcttctgattcatgcaaagttaaaatatgcaaaattaagaaatacacaagggagaagtggggaagagattatagataagtacatacatatttgtgaaacaatatttctaaatattcattaaaataatctgaataagtattgggaaattagacaatcaattaaacattattttagaagttgatatggtttggatttgggtccctgcccaaatctcttgtcgaattgtaatccccaatgttggtggaggggcatggtgagaggtgattaaatcatgggtgtgaacttccccctctcttctctcttgacagtgagtgagttctcacaagacctggttgtttaaaagtgtgcagcactttccagttgtctctcttcctcctgctctggccatgtaaggagtgcctgcttcccttttgccttctactatggttgtaagtttactgaggcctccccagccctgcttcctgtaaagcctgctgaactgtgagccagttaaacctctttttaaaaataaattgcccagtctcaggtatttctttacagcagtgtgagaatgaactaatacagaagtcttaaaatatctgattacttaatgatgtaaacaactgaatataaagtaaattgacagtcaatgtaaggctgaggacctcttgtgtaaaagaaatagttcacaatttgagtgattttcttttatttacattgcaagaaacaaaaacaaaaataaagcatacaaaagaaactttctttggtctctaattccaccaccgaagtacaatactgaaattcttagcaaatgctctttaaaaccatttttattcatataatatatatacacctttttatttgtataaaatatataatacgaatgaaatatatctatctatctatctatatatatatatgtttacacacacacatacagttgacccccgatattcatgaaagattggctccaggactcccctgccctctcatgcatgccaaaatctaaggatgctgaagttcccaaaataaaaggtatattgtttgcatataacctatgcacatcttcctgtatactttaaatcatctctagattacttaaaatacctaatgcgatgtaaattctatgtaaatcgttgttatactgtatcgttcagagaataatgacaagaaaaaaatgttggtacatgtttagtacagatgcaaattttttaaaatatatttttatcaataataggttgaatctccacatgcagaactcagatctacaaaaggctgtgtgtgtatacgtgtgtgtatatatatatataaatggcagcatgttacatatatataacatgttaccattaaactgttaaattcaacatactcttaacttgctttcccccaaaaagacattgaagcttttccttatgcaattagttaaaagtacatattttgttttattagctgcaaagtattatagtttttggtataaaacagtatttatgttctttttaataaatatttgttacttactaatttgtgtgtgtgtgtgtgggacagggcctcattctgtcacctgtcacccaggctgaagtacagtggtgcaattatggctcactgcagcctgaaactctggggctcaagtgatcctcccgccacagtctccagagtagcgggactacaggcatgcgccaccacacctggctaatttattctgtattttttgtagagacagcattttactatgttgcccaggattgtcttgaacggcgaggctaaaccaatctgcccactctcaaccttccaaagtgcagggattacaggtgtgatccactgtacccagccatttattagtacttcaaaattatttttaaatgatatagtatactccctagacatatatctttgtggaattacccaattatttcctaaggataaattcctagaattatttaaataaataagaggaacttctttgtatatgacagggttgataaaaaccatccttgtacacatctttatcaagatcaagtacaatcaattgtgttgctgccaatacgtttagcaaaactcatttttggctttttaaattttcatttttgatcactaatgataatttcatatttcttcttttgtgaattgtttatgttaatattcacctttcatacaaatattcattgttttattatcatttttaaaattaaattctttatcagttgcaaaactattacaacataaataaatatgcattgactttattgttgtttctctcaaatgccaaactttctactttagaccctttgcttttttcattctcttcttctggaatgcatctctcctattcctttgcgtgactcattctcttactttatgtagctctctgttcaaatattaccacttcacccactctcatttctcatcagagagccagccttccgagttgtagaaactgcctactctgaaatctcacatcctgccttgctgtttagcagtcactctgacctaactatccttacctttcttaggtcttcaaatacagtgggcatcgtcccagctcaggacttaaggtcttgccacatgatggcctcactgcggggaatgttctttctactttgtagtgtacctaaatcctgcacatccttcaggtctgttaaaagtagttttctcaggaaggccatctctgactttactgaacagacaaggtctaacctctaatttctgtagatttatggcttagtgtagtgacagatatgtaggaactttataaacgttaattaaatcatgttaaattaataacatgaatgaatagcaaaatatgctgctgcttttacaatgtgggttattccctaagcaattgtcaaaaaataagttgctataaaagcatatatttataattgtagttttatagtccacactgggaagctttaaaacccaaggaaacattactcactttggtccctggtaaaggctgcgctctgtgttttagaaactaaaatttatggacagccaaccttgctgctgacatctatgaaaaaggaagaaacagaaatatgaggagatggtgtcaccttcattaaatgcgtggaggaacagtatttacttttccagttttcacaactctgaccagaaaactgttgtctagttatcaacgcattgcggcattttaagaatatattaattaggaattctaactctttaatttatcttaacctctgtctaccttagtcttgcccttcattagctaacactgaaatgacctatctgactcataagaagtcaacaggtaaagagcaggtgtacaatccattctctccctttagaatagggaatgtctttgggaagaaagtaagtaactgacctgttcagatgtcctcgtgagtatgctaacatatttgacaaaaaaaatggtattttctagcgggaatcctaacctaaggtatccattttgctggatgcacttaggttgaattgcttgtgataactggggatcaatggacaaaagacagcataaataatgaacctgcatgtaaaacgtttatgttttatgatcagaaaagcacctttgtgtaagtaatatggcctcacatgttaatctagagcacattctaatgcagtaagaatgaaaatgtacatatacgttagacagtttgaaacctctcactgctttacctcttcctagtgattactgatatccttgaaattattggtaataattgaacttcactaaaatctctgatacacccaagtctgatttgaaaatataatcttttgtgtgatatccacagatattgaaggctgattgtaagaatgcaacaaaatatcatccataaaaccatgacttaatgcataaacagctgaacaaatacacaagtctttttctatattaaaactatggaagatatcacatgaaaactaagctaatgctttcagggtggacggaatatgcattgaaggaaaatgtttacaaatgggaaaatttttgtttttttaacatgtatcaataagtatattttaaaaattaggaaagagagtcatttctatgagaagaagttcacaaaatattgaaaataatcatattaggtctttactgttatcagataaatgaattttgtacaatttcaatggtcacaattcactgtcaatgttaaatataaatacttttttaactgaatatcctagatatttacaaactttacattactcccatatcaactatgatcaatcacataattgcaattaatcttcctctttgtgattgaaaaataaattctgaaaacagatgtgaaaaatgtaatgcattgataaacatcagttttctacagtcattacatagcccattatttatatttctttgactcaaatatatgttgtgattttatattcagtttttaaaagaaaatctattatctttaacattttaataaatgtacaccatgcttgttaaatgaaatgtcaaaaagtatcttataataaaatattttttctttattagagaaacttgtaatctttcttccatccataccttctgaaataaacttaaaggaaatgaatattgtaaaacatgctttagcctgagaaatatgcaataattaggctgaacctagaattctgtgttcaacttagtaagtaaaactttttatatttgtagtaaggaagaactttatagttgacggcttgttacgtttaaccaattagaaagactatcacattgtaccattacaaaatatgtaattctaagggaactagagtctgaaatgcaggaatttttttttgaaaacaatataatgcagttgagaaattgttgccttatgaatgtaaacatttttgtgaattaatcattaggcaatgttctcttaggtaagatactaagtctgagccatggaatttaaaagatctcatcatcttagaaatttatcagccgatagagctattacaatttgggcaactttaaaatagagttctgtagaataattctaatatttgttaaattgtttagtgttccattagagttataccaattttagtgaatataacttctctgcagaataaatatttttaggggcgctggggtgtcttcttttagaatttgtatatacatacttactcagagctgagcatagtggcacatgtctgtggtcccagctactcaggaggctgaggcaggagaaatccttgaacccaggtgttccagaccatcctgggcaacacagggagaccctatgtaaagaaagagaaatctgtttatgagaatgactggatcctatagagcaattggcaatgtgagctcaaaatatctgcctgacaaaagcagttgttctacgtgatgataccagcatttaagtggaaatgagtgacatgtttgcctgaagcaaatagaaataatctccctttatccacactcaacaatgaaaaaaccaaaggccattttagaagaccttcatatttcatattttttagtcagagcttaaaaagaatagaaagcaagtaaagcaaccacaaaataaacttatttattttccaatggagaacatatctgaacaatttagttgtctaatcacttcttactctactcattataggtttaactaaaaagtgaggacagattatcactgtgtatgcaaagggaaactacaggtacagattgtaggtgtctttcttcagctgtcatagctttctaatctatagcttctgtttattgaatttggctactctttacagcactgcctctaacatcagggacacaatattagagtcaaattttaccaaaacaaattaatgagggatatggtgagttaaaataggacagcttttctttttttctcttattttttttggagatggagtcttactctgttgcccaggctagagtgcaatggcatgatctcggctcactgcaacctctgcctcccaggttcaagtgattctcctgtctcagcctcccgagtaacagggttttacaggcacatgccaccatgctcagtgaatttttgtatatgtttaatggagacagggtttcactgtgttccccaggctggtctcgaactcctgatctcaggcaatccacccacctcagcctcccaaagtgctaggattacaggtgtgagccaccacgccctgccaggatagcttttcaatgagcaatttaagtaaatggcttctgttttaaaacaaataaaatgtatatataaatttttttaaaaaaactcagagaaatgactgtctttatttaaaaaaaaaaaaaaaaaaaaaagtcaatgttgtataccagcaggatttttagaaccttactaggaaggtaaataacaagcacctcaggaaaatgtgacaatctggtgttgaactattacaactgatgggagcacctaaggtctagatgcattaagctggtggtgtgaatctagttgctttagtctctttcattgtcactagagaaattattaagagaaacacaaggctactctgcccacagagtagccattctttattcctttattctttcttaataaacttgctttcacattactctgtggactctccccagattctttcttgtgagagatccaagaagccactcttgaggtctgggttgggactcctttccagtaacatcttcctggaaaaccacaaaaggaaaatactgaggatacccctggcacaaaggaaaaagatggtagcaccaattctccaattgtgtcccaaagtctgtttattttaccagggaattgactgaaatggcatactttcttttaataaatcagatttgacttatagagccaacaaaagccccttgggtaaactgtcttcataccttgtctaacagtccctgtacagggttcctgacctgtggaaagtaaagaatatcacattctgacaggcccaggagccacaagttctctcagggcctcaagaggagaagaatttacccaactcataggtatttgatggtacaaacccatggctgagttagactttaaaaaacaaaaaagtcttatttgagattccttctatgggacaaagttccatcaacaccaattaaaaaaaccctacgtagcaaataattattcttgctgcactttatacaaataatcaggccaactataataaagcaaatcagtcttatgatttgtttttagtataaatgggaaactgaagaaataaattatgtttcaaaactatggtacacctgttattagatttcagtttcatcagttgtttttgagttttttctacaatttaggctaacgtgcttattcctgtaaaaccaaccagtggtctctagctgctgctcagaagaaacaagggggatgggtaatgtaaaaatctggatcaatattctaattgtgagcacatattggaaccagctagcaaccctatcagcttggttccaacagttgcccagttcatagaaagccttcttaattagtttactcaggatagatttacttattttgcttcactcttgtggaatatattgctgttgtactctatgtttacaatgaaagataagcttactcaatgtactcttaaatcgaacacttattaatcttccatatataaccttttgtcagaacgcaaaagttatgaggggactttgacatacccatgctttctgactgagttcctctctactgtgaatacaagacaccctaatagttaggcaggaatatcatcgcccctatccaacctgaagaagttacagaagatggatcattatttgtctctaaccctttggattaaaggttcccttgtaaaaggaaggagagaaatatgtcagaagcatttgaacaagatcaactccatcttgaataagggctgggtaaaatgaggctgagacctaccgggctgcattcccaggaggttaggcattcttagtcaccaaatgagataggagatccgcacaagatacaggtcacaaagacatggctgataaaacaggatgcagtaaaacagccagccaaaacccagatggcaatgaaagtgacctctggtcgtcctcattactcattatcgactaattataattcattagcatgctaaaagacactcctaccagcgccatgacagtttacaaatgtcacggcaacattaggaagttaccctatatgtttggtctaaaaaggggaggaacccacagttctgggaattgcccactcctttcctggaaaactcatgaataatccaccccttgtttaccaaataatcaagaaataaccataaaaatagccaaacagcagcccttgtagctgcattgcgtatggagtagccattatttattcctttactttcttaataagcttgcttttacttttttttttttttttttgtgagatgatgtctcgctctgtcgccaggcaagagtgcagtggctcaatctcagctcactacaaccttgaaacctccgggttcaagcgactgtcctgccccagcttctcagatagctgggactataggtgtgcaccaccatgcccagctaatttttgtatttttaatagagacggggtttcactatgttggccaggatggtctcaatctcttgaccttgtgatccgcccaccttggcctcccaaagtgctgggatttctggtgtgagccactgcgcccaacctacttttttttttttttttaaagagaaacataattggtaaatacaatctaagaagtgcatcatttttagtactgtgctctaatttataggatcatagtatagtaaatttgggaaagatgctagaaatcaaaaggagtgaaactctcattttatttgtgccattaatgtttggtatgtccaacggcacagcaaatgatgtagctaggagtacacccaggtcattggactttctgatctgtatatttttcaatgcaatgtaagtttacatatccatatatttatagaaggattatagaaaaaggtctgagcctttctcagttatactttcagagtataaagaaaagctatatagttatttaaagagtggaatttgcttaaagagtggaatttaaagagtgttatttaaagagtggaatatccaaaaagaaattaggtttaaaaagtggtgtgtgaataaggtaaactgtttatgtatataccaatttaactatagggtaatgtcatttttaaactaattatttagttctctatatgaagtagaaagttaaggatatgatttcaattaaccctaaggagtgatggtaacctaaatgtaaatcgcttacttaaacaggatctggtttcatcttgataacccagctttagcaccaatagcattcaaggaaccatattaacataacgacattacaaactaaatacaacagtattgctatacaggaagagagagaataaaaggcctatatgttaggagtgaattatccgtgggtttcttatatttctgcacatcttgagagcagaagcactgaaggccctttttatggactattttattgaagatgttttatagaaaagagtcttggaagatagagatagaatcttgctccagcataataaagataatgtcttcctccaaggcaaaggaaggcaagtttatgcccattatattataaaagaatcaagcttcctcagtgtgggtatcctgtcttgtaatgtaatccattgcatgttctggtgtcacttgattcttttctcactgcccagtggaaattttggctctgagaactggcacaaataataatactgattactgctgttgctgtaagcaatacttttttttttttcctctgccccaggagtcctatgttttctgctggtatcattgaaactgtggcagagtaacttgttagtttctaagtaggatagaacctcaaatctcagactcctagtggttcttgaaattgtcatctttttattcctctgaagttcattcaatatacttttattaggctaatatttccaaagcaaacaatctattattacatttctatcagaatgtttcagtgtcttccagttaggtatagactaacaccaaggaatcaaaagctttttaattatattgtttcatcccattttgtccaattaagtatagattctcaccaagaaattaaaaacttttcattatatggctccagcctggttttaaaagttgcatttcttgttccccgaacataccccattttcatattcccatcatctttcacctgttattgtctatcatatgattatattgtattttctttcatttatgttattctctaagaacactttaacttacataaagttgaacagttggtctagtggtggctatgaagcagcacctagatcccctttcagggctgaaggacttgtttttccatctgctgtaggtgccacagtactgtctgttctggcggtcgaccttggacaagcaaagcttccttgcccaacaccattcctctttcgcagaggcagcccatactgattggctggccactgaagggacactaaggctcagcctctcccccaaaattgggacagttctgatggtcatctgagcttcagaccttctcatggatttcagtgatgtctttgttgtgactacatcacagtcctgctttttcctttctttttaataaatttcctgctgacaaatctctatgtaaatgcctactgcctggggagtccaaactataacagttaccattctgccttagaatgcaatccttttgagaaagggcttccgttttactttgttgtatttgtattaggcacctctaataatagttttcccataaatatttgttgaatcaaattgaactaaatagggtaaagaagctcaccttgcattttgatcattagtatgccaaataaatgtagaatatggagccagaaagtatcctctaacaacacaatagtggatatgaagtgataaatatattttataatccagaatccagaaagacctattactcaaaagaagagtcaatgggggctgggggcagtggctcacgcctgtaatcccagcactttgggaaaccgaggcgggcggatcacaaggtcaggagatcgagaccatcctggctaatacagtgaaaccccgtctctactaaaaatacaaaaaattagccaggcgaggtggtgggcacctgtaatcccagctacttggtaggctgaggcaggagaatggcatgaacctgggaagcagagcttgcagtgagccgagatcgcaccactgcactccagcctgggcgacagagcgagactccgtctcagaaaaaaaaaaaaaaagaagaagaagagtcaatgggataataccatatgaattacacctataaaaagctagctgacttaacaattcttattttttctatctaaaaagaaataaaattgtatttgccttacacaagtgagggaatggtgttcaggaataagttcagagaaaaagagggaatgtatttatttaccctttcgtttactttcatgtataagactaatggtctaaactgagtggtagaattcatatgtctaaaaccaaataaggatggttcaactttattttttcttattggtcagaactattgtaagcttgcttttaaaaagcaatcttgagtttattattcttttaagcagccttggtgatcagggagaagggtgtcatctcttatctttctatgacagatttcttttttaacttttgagagtaggaaaccctgatcatcttagacataagttgtcaccaccaccacacctttcattatagattcctatactgttagtcataggggagatcctaaactgaaggagaagacagtttaccttctggcatctccagcacagcatatacattctgaatttatagctgaataggtttctaagacctagttcttaatgtggaaagtgtttgttggagtttgtgtggtgtgatattctagtgtgccaagtggagttaattaagaaaggtttttctgtaagaattgagtcttggtgaatgagagtggggatggacatagccgcagacaggccattataaatgggctttggcaattcaatatggagagcgctaaaggtgggctccaggtagggatgtcatatttgcctgattggataagaaagtgtgatccagagagtcacagagtggactccaacatctggaatgtaatgtatgcctggtatttatagtctgctgaagtctggctggtgcttagggaggaaggagttgggagaagggcctgtaaagcatatttaaaaggtcttatctttgagagcctctgcattgggctttacctccattttatagttgtgaatttgggggttttatcttatttcttgcctggttaaaacaaacagagctgaaccctgatcccaattcttgattccaaatccattgctctttctattgtgttattactatttccagcagtcgtcacctcactgggaagtctacctctgatctttgtgtatcaaacctgtttattttctcctataatttttttcttgttgttgtactttaattaattattaaaaaataagcaatcttgagaaattattcttgaaaaatttaagaaattttaaaacaatagcctaatataagatactccaaatagctctaaggaaatagacataggaatactttgcaagtagcagttttgaaagaaagctgagaatatgagaaacaatcccattatcaaaacctccaagtatatttcaaaataactaccccctacccacttaagttttctcgttacttctttaaacactggaaagttttacataactgataccgtattgtaaaatgtgttttcagtttgataaaatagctgctagattataaacaagtgtttgctcttgggcttgttgagtaccgtgttgaatgtcaacaggtgtgcttgtttcatgtttgggctttgtggtaaacgatggatcatggccttccattaaaaagaattcttcatctttcagcttatatatcatctattttcccagttgagactttaggtcattggcttttaacatcaacaataacaagtttgtgagcctgattgtagttttcttccccctatgggttttttttttttttttttgtagatgtagttctacttgaaatgttattctcagagaaaatatattgaaaatagtcatagttctttgaaaaggttgttctttaattatcagctggtgcatttcatgtctaatttataatttattagacaaccatttattattatttggcaatacttacatgcctctgttaacattttcattgcacttattttgtaatacaaaaataacaaaggaatgtgaacaatttctttctcttctaaatttatactcatttcgtgacatttaggttacaacctatttgaatttttttcccccattaaaagtaacaaaagaataacaaatgaaacccttgagtactctgaacaaatatatgatacttgatgctttccctatttttttcccggcttctcattctgggtgggaatacaggtgggacaactcttaattatacagaatctccccagaaattggaggcttttaacatcctgggtcctaggacgcctgaagcataccctagttgtgagaacagtagtgtgtgcacacatttccaattccttccaggagaaagagcccggtgcgatcttcttactcagcttctgattctactccttattactagttatcttaaaggttactatagcagtcttcttctgcctgttatcttccctctccactttttattctcaagattctaacctttccatttttttttaatgccggaatgccccttgccaaaatacttcagcggcatctgtattagtctcctagagctgccttaataaatgatcacacactgggtgacttcacacaacagaagtgtattttctcctaaatctggaggccaaaagtccgaaatcaaggatttggcagggtcatttcattttgggggttccaagggaaaaaccatcccaatgtctctgtcctagtttctggtcattgccaaccatccttggaattgctcgtcttttaaacacaacaccgtaatctcttcctccatcttcaagtgcttcttctctatgtttgtgtcctttcttcctcttcctgtaaggctacttccattagatttagggcttacactaatccagcatgatctagttctttacctttattacatctgcaaagaccctatttccaaataaggttacattctgatgttccaggacgacatgaattttgagaagacactattcgacccaccacagcactcattgtttttaacttgaagtccacacttttcttgtggtagagaaagcctcagatgataagaactgctttgtttatccaccttcctgtcttgccagtgtcctctctcagtcagtgaactctgggtcagacttgtatgatgttccaccttcgcaatcgccctcccttgttctattttttttttgtgcggggtggggggggggttggggacagagtctcgctctgtcacccaggctggagtgcaatagtgtgatctcggctcactgcaacctctgcctcccaggttcaagcgattttcctgcctcagcctcctgagtagctgggattatgggtgcacaccaccacgcccggctaatttttgtatttttagtagtggtggggtttcaccatgttggtcaggctggtctcgaactcctgacctcgtgatctgcctgcctcagcatcccaaagtcctgggattacaggcatgagccaccgcgcctggcctatcccttgttcttaaatactcctcacatgatacttcctctccttcttcctaccatttttgtataaacctctggtcctaggttaaacatcaccttcttgactctgctataagactctgtttagagcagttgtccctctaatatactgctagagtgtgtatcccacagccaatcattgtgtgtttgcactatggcaaacactggaatataacagcaaatgaaatggatttgattccacaaggcctgaggcaaggattacatcaccatgtgtatacagagcattatccgtgtcctctatatgaattaattgcttagttaatgctagttagttgtaggtgtccttcataaatggcataggaggtatttcaccaatttatttacacgtgattatttaggagcagttgcattaataattctacattgaaatacttgttctgtatttttactcttgatttggtctgctttttagagaaccttttatttatacaaagatagcactgtgttttcaagaaatgcccttaaaaactagtcgtcagccttgccttaaaaatgttaatactgattggtatggtttcagacttctaaaactaaatggaggcaaacataggctacatatgataacaactccaaaccactttttttttttttttccttgagatggagtctcactctgtcattcaggctggagggcagtggcacaatctctgcccactgcaacctccgccttcagagtttaagtgattctcatgcctcagcctcccaaatagctgggattataaacatgtgccaccacacctggcaatttttttgtatttttagtagacacgggatttcaccatgttgaccatgctagtcttgaactcctgacctcaggtgatccaccctccttggcctcccaaagtgctggaattacaggtgtgagccactgcatcaggcccaaaccacctttaaagaatgtgtgaaaattatggattcaacttgactttgcgtataaattgaagagaggatttttggtttacctaaaatatttcctctccacatagaattacccaaaatcaccggccatgatcaaccctagccatggccagcaaatttgagagtcctatgaactggagagaaattctaagcttaaatactacctactgtaaattttaagttgatcttctccatcaggatgttggctggaccaagcatttggtgaaaatttctccttaattagaaatcagaagtaaaagttttgtactttagtaaggatattataaagctttcaaggaatactagtgatggatcttggaatatatttaaatgttcaataaaatgacagaaatctggatgctatggacataatgtctttccttccatgtatatttgataaatttcatatcagttttcaagataaaaatcttatcttaaaaatttttagtggaaaacaaggtaaaaatgtgtgcttcttcatccttaatcctagggaattggattagcccaatactttatatgttttgagtgagttaatcaagcttttgcatatttcacaatttcttatatttaaaaactcaaaaatgtgtttgcttattctggatccagtcagaattctagaaatgagcacaaaatgcaaaataagattttaattgcaaaaatataaccattggctttaaaaaagataaatatggcttaatacacagcctgagcaaaaatttacaaaataacttattttaaaaaaagtttcggagctaatgattaagaaataaatcactactgaagtcaatatctaatgcttgaagtttagagttaattcaattgataaaagatggagaaagatgaaatctgactttatacctccatttcacaattatctgagaaattagtagcagggttgaactgagggccaaaacattgaaataagctcctgcatggaggagatggcaatgtctgcagctcttacttcttggtagcaaaataattaggtaaataggcttctgatttatcaggagcttgaattgtacacagaaaacatgcaaagtttattaacatgtggcattatttgtatttgagaaaaaatgaaaatgccataattatcctgatgccaccattcccgatcctcccactcccaaccctatttctaggctgtgaattatccctctgaatgaaggcctagaaatgcctctttgaggtaagtgttcagtgttgacttgacttcgctacggactacaaggttccaaagacttggagaagacagtccagtaacagtaaatttctagctgttgtttcgttttttgaggtgtgtgaacacaaaatatattttgaatttataattgggacatttaggacagggagaagattccttatgcattttctgatagtaaataaaagttaaataaattattctatttggcttggttccaaaaaaggcttacctattaccaagtgaagaattattgagcatttctttgtgaagtgataatttggcatgcagtcctctccaaaacataattgccaaaatattaataaaattgagttgatttgtaggtttctgtaaagcaattcattgaaatgcaatgggtctggtctttttttaaagtcctatatttgaatattataaaaaaatataggattttgatatgtaaccaaaaattgttttgttggataacaaactatggcaaaacttagctagctgccttaaattaacagtcattttagtcacattttccacaagtaagcctgttggctgtgtgtgtctgtgagtgtgtttgtgtgtgtatgtgtgtgtgtgtggtctgggatggttcagctaggttacctaggacggcctcacccacatgtctgaggctttaggggagagacttgggccttccaactcatggtctctcatactttaagaaactgcccaggcttgaatccactgtggtgcaataattctctgaagcaagacccattgtgtgagcattatttcagcctctgcttctgtcatgtttgttaatatcccgttgtccaaagttattcacatgccaaacagaaacaagctccacctctacaacttgtagttttgcaacatatatatgccatatatgttcatacatatatatgtgtgtgtgcatatagcacattagtatttaaaactactaatgtattttatatattttcttttgggattatagcaatttaacatatggcatctatatgactatattatatttcataaatcatttcaatattaaatgatacttctaacttagtattgtcaatttctttagctaagcaatatgtttattacttttgaatattatgttgtcctaggattatagctttgtactgagttgtctttcagacaattagatttattgtttgcctgtttgatcagaaaagagagcctgtgggtcatttgatacatagcaaattccatgataataaattatacctggtcatataaatagaagattctactatattttttaaactatatttatttcaaactttgaaattttaaaaagcaaaatactagatagaaaatgtattagtggtttggatttaggtatatttggacttgaactagcaatgtgagtttatagaattaactttttataacattaaaattgctatctattaaattggaaatgtctggcaaaggatattcctgtaaactattctagaaatgctcaaagtcatgtaattctagaagctcattttttcatagagagataatcaattctgttttggcaaagtaatgttctacagtagatttctggaagctatttatctgaattactaaatacaacagaataatagtataatcgaatttcttcttaaaaaggaattgtgtcagaataataaagtatattatgatgaaatgtattactataatctaacaaaaatataaaactatgcaattattaaagagtattctattttcattgaatgctactcttaattcagtttctatcctccctcctccccaacatacacacacttctatgaagctgacccacttcacatttttagcagaggaagggaagttgtatgtgggagaagtgtcagatatagtgtttctaagtttgtaattttatactgttttgtcttaattctaacatattttatgatatgtcttcttttggagaaaaaaggaggagggcgtgtatcagtttgctagggctgccataaggaagtaccacaaactagaaggcccaaaacaatagaaatgtattttctcagggttctgcagtctagaactttgacattaaaatgatggtaggaccattgtcctctgataactctacaaggtgatgcctccttgcttcttccagcttctggtaggcctgggggttccttggcttgtggcagcatcaggtcaatttctgtcacgttttcacatggatactgtctctgtgtctgtctgtgtccaaatttttctcttataaacctagtagtcctattgaattaaggcccatcataattcagtatgaactcatcttaacctgactgtatctgcaatgaacccatttccaaataaagctacattcttgggtaccagggattaagacttcaacatatctttttagggggacagaattcaatccacagcaggacctaaggaagagcagtgttaaaacttttgcattaattgatactatagatgttcagtaaataataattattgttattatcgttatagagacatgtgtttgtcacttatatggtaccaagttttcttttaaatattttgtaagcatttactctttcattgaactgaaatgagaagccaagggtcttatcctgaagtgataacatacagattagcaaattctgttttagactataaaaggcattcttataatcagacattttgtttttgcaatttttttgtttgttttattttatttatttatttttttgaaagagtcttgctctgtcacccaggctggagtgcagtggcgagatctcagctcactgcattctctacctcccaggcccaagcgattcttgtgcctcagcttctcaagtagctgggactacaggcaagtgccaccacacccagctaaccttttttttttctttttaataatccgtgtattctgaaagtttttgatgtctatgaagttttgacttgcaaaatattctagtagtttacaatttctcagtaggcttatttaaactttgtttattattaagaattgaaccagttccagacaccattaccaatgaaatcaggcccaccatagcagctgaagtcgaccatttattacatgcacttcatttgagtcttattaatgctgacatctgttcaagtcttcattaccatattaccacaactggtcccttgtcacatttatcctgattctttgtagcataaacacaaaagagaaaaatacatttccaactaatgataaggttatttataaatgagatatattcaaagaatgattttccacatattggacacatgctattcatttctcaattttatttttacctttagacaaaaaaattttaaatactgaattataaacaagatttaaaattttattcatgaaactaaaagtatgttttaatacacagctatacaagacaattacttaagcatacatttaagcaatgtaattaataaaatattttctttgtgagtttgagatgttacttttatgaattttgcaatagcctaatgaaagaataaaaattacgtaatttttgcaatgatcattcattcatcatttttagtagcaacacaattctatgatatgttatggttgtaacagtggctttttcaatgatgctttcttaatgacactttacaaattacactaatagtctctcacggcaaggttggctgtatgtattttttgtaggctttataatatcatctgagtctattattacctctgacatttttctagaggccagttaacttgtttatattcaaacaccgagtgggaaatgccagcatcaatcaccgtttctacctgtaatgcatagtgataatagcaaccacgggtagtaagcactttgctaagtattgggcttaaatgattccagttattttcctcaataagactgtattataggtattcccatttccttgaggacaagagtaataagtaattttctagaagtcatgctttagtagatatatttgaaattagcacccaggatatctgactccagaatatgtcctcccaagtgtgatgctctaccctacttatcataatggttctgcctgaaaataattattatgtgcctaccatatacttatctccaacactattattactgagtggcctaaaaaagaaggaaaagtaggtatccttttctttagggtagggaagacatacaaaggtgaagctactgaaattaattataatagcagtatataacatggtgaatccttgtcttgaaaatgtagtcaagagattaggctgaactggggctagtttttcattgaattggaacttaaaagacatactagagaaaagcaaaagcaaaagaaagtcatactgggtggacaaaagggcaagggctagacctaaagagaataaaaacaagcatttgaaaatcagtgaatgaaagacactctacaaaagaacttgctctattttaggtagtacctttcaaagtcacctttcaattttgaaatatggtaaactcaacaattgactataactgttagtaactaaaattattatatctcaagtattttttgaaaaatagttcaaattatcaaaattttgaattctttggagactaaaaaaattaataagttgtcaattgacttcatgcacaaaatgtatgtggagtatatacaagcggcatttttttttaagacggaattttcctcttgttgcccaggctggagtgcattggtgcaacctcagctcattgcaacctccacctcccaggttcaagatattttcctgcctcagcctcctgagtagctgggattacaggggtgcgccaccatgcccagctaatttttgtatttttagtagagacagggtttcaccatgttgtccaggctggtcttgaactcctgacctcaagtaattcttccacctcgacctcccaaagtgctgggaatacaggcgtaagccactgcacccagccacaggcagcaaattcttaacagacactatagaatgagcttaatagaaaatttgtgtcgttacataatttgcatttatggactgcttctagaagatgtgaaaaatagaggaaagaatatgcgttgaggtcaaattttataaatcaatgttttcctaaatatacatgtattgactatctctgctacaccagagaatgctgtttctgcaggacattaacaagggataaacatataataatttccatgtataaacacatttgagatagggtgttcaaaaattacataggttttgtatggtgtatccactgaatacttctaatgagctgagagatattggtaaagttaacaagaagagtataacatgcagcgtttctcaaaattactatactacgcactattttgatagcgggttatggtgactgcattaggataaatctgcattctcaagatttttggggtaaagagatatgtggtcatatcctatgaaataactgtgagtcgtttaggaaagacttagacatcgtgaacccatgtgatgtggaccatgagtgaatgaaaggtttggaaaatggaagatgtcattcataacatgaaactttcaggtgaaagattctcaggaacaaaaatctctaaagaatacaagaaaaatgttcatgagagaaaaatcagttttaaccatttctcagacccaaagagcatgaaatctatcgaatcaagtcagaagtattctatcaccttaccagttttctctcctttcttccaataatgttcaaaactgcaactagaaactaaggaaacaggtgaaaaagagagggagcagaagccggctgcatttccttttactgattaatatatctgccagctatgactctgggcattcagaagaaggagagtaagccttagcctcaaatggcattgaagcagattgattcatgttttcatatattaattaataggtgattatttaatccaaattttatgctgtgacttaaagagattgtacaaccatttattatccaaaaatgaaaagaacagttaatgatgtcaccaattttaaattattggtctgagttattaccctgaaagtataaatgttaaataaggaagagtagtatattagttttctaggactgccataataaagtaccacagactgggtggcttaaataacagaattttattctttcacagttctgtaggttagaagtccaagattaagatgccagcaggattggtttcttctgtggcctcactccttggggtgtagatggctgtcttctctctgcatcttcacgtggtttttccttctgtatgtgtctgtgtgcctgtcctcttcctataaggacaccagtcatattgaatgaggacccactcattttaactttaaagagcctatctgtaattacagtcacatctgatgtactggggattaggatttcaacacacaaattttgtgagggtgacacaactcaccccatggcaggtagaaagttacaattccatcaagtcatattcaatgcatctgttgcatattgttatattctctgatatatcaaactacttttgattttctggaattaatccagcttggttattgaataattgctcttacgatgtatttctagattctaatataatttttaaatctataatcacaagatagattggcttactgttttgttttgaatatattatttagggtttgtaatattaggttgccgtaaaagtaattgtggtttttgccatggcaaaaagtaattgcagttttgctctcatgagcatttttcttgtattctttagagatttttgttcctttgaatggcaaaaaccgccattactaacaccaacctaatatacattatgttggcaaatctgtggcaacacattagaaaatctacagaaaatgggtgattttcatagcaaaattgcattaaaatatcaagaagaaatgaaaatcttagataaaatatttaaaaattgtgacatatttaccattttaaaatattctaggaatatgtgagttgttatatatactaactattaatactttctgctacaacacccttaaaaaccacagtgattaaaaagtgtatattaagtaaattctgtgatgttctcattgggtgagacttttgtggctcttctccaagaattggctgaattcacccagatatcaagcaggcaggaatcagaaaaggagggtgtttaggggagatatgtccactctaaactgcctcagtagcaccccatcagctcagctcacatttcaactgtaaagcacatctccacatgaggggctaattatggtagttcagctgtgtgtccaagagaaagaaacaagtttcttgagcagtgagttggtccctgccacagatgggttcacagttgagtttcagccaactctaaaaactcttaattacaatgttttctaaattattccaagctaggaaaagaaaaattaagtcctcagtctttctgacaatgaaggataatttaattttaattttgacttgattttaataatcttgacttttaggcattaaaaaaagatgtaaaactaaaagcattttttcagctattgcattttgcaaaatggagagcttcttggcttaggaaacaatttctggaatattttagatagatgatagatttgatttatatctacatatacatataaatcaaaataagagatctcttcattgaaatatagttatacatctttaaatttttaatcaacacttagggagatggcatgttattatacaaaatgtgtcccttttaggttcaagtcaatctccaaatttctgttctgtcgcttcccagttttttgacattatgcaggtcactttgcttacttcacctaaattttctcacctgtaaaatagacataaatataagagtatcacaagattcatacatgattcgcatggcataatctttgaattgacccagagcaatggacattacagcacggccatccacacaaaggcagtgttttttaatcatcattaacacctttaacattatatcaaataatttaccttcggtgttttcccattctataatcttcaaggcttttgtacagaaaacattgtaatttcatactttgagtatacttacttcatcccctgaccctttcaaaacatataacaatgatagacaaaatgtgaaagaaaaaatatcgacacaacccaggcaaaaataaagcagacaaccccaagggctagaaattggacaaaaacaacaattaggattgaaattggttcctacttgggtcagggaaaagaagtttcaggcaactatgaattggtatccacgggtaacagaactagaagtaattcctataaatttggagatccattccaggtttactgctagaaaatagcctggggcagagtttcccaaactgaaaggcagttgccaaggttcatggtgtctctggagtgggagactatagctaattccagaagaaggaggggctatagcacatatcagggagagtggaatctgcagggaatatcagaagaaacaaagtctctggccaggttccgagccaagcttccctctggcaagtggccatgtaactatatttctaatgccaatattacccccaatctgccagcataaatactatctttgtatttgaagacaaaattgttagttggaagaaactatagaacatctagatagagagggtcaaagagagagagagaaggaaaagaaacagagtgacaagcaaaggaaacagctcctcaagaagattttgcaaaataaaattccaaaacccacaaggcaagtaaataattagttgctttaataaaccaaggcaaaaaaattaattagcaattaaataaaacaaacctatgtttatttcctcaaatgcataaaataataataatagcattgaggaagaaacaggcattattaaacagaagcacttactagggtaggaaaaagaacccaaagaattattagaaatgaaaaaaattaaaaaccattcaattagtaaacaggggtggaaaaatccctgaactggtagaataactagtagggagcacagtttaagtgatacctctggttaagataacattaagaaattcgtttagaacgcagcctgtacatatataacatgaaagagaagttaatatccaggaagggtcgattgaaagactttagcatgttgaaaataatatcaagaaaatgattaaagaggagatggagaaatgaagcaacccaaaattgataatggatttgaatttttttgaaattcaaaagtgcacaaaaagtctgcatgtaaatccacatctacccgcaccactgtgaaactgcagtgtgtatatttgtatgtaaactgagagaaaagacatacaaattataaaagtacaatgaagaaggcgacatcaaacttctcatcaaggctaacacacaatcggaagcagtgttcttgtgttcttgttcgtcgaagtaccaagggaaaatcacctccagctctgaagttgacatctgcctaaactgtggttcaacagtataaagaaggaaaaacactttgaacaaacaaatcttaaagtctctatgacacatagacccactctgaacgaactattggaggatttcattaaaatgaaatattcctaactgaggttattgccaagcaatatgaataaacaagtggtatattttaaaaagtagtattttgcagagaatctttagaatggccaactatgtaactttttggaaaaatgattagaatcaagtgttataaatgaaacatttcaaatgccttaaaattgtgagctgaaaatatctgagacagatctcaatcaatttggagagtttattttgccaaggtttaggatgcctcctgacacaacctcaggggtcttgaggacatgcacccaaggtaatcagggtacaacttgcttttatgttttaggaagacatgaaacaataataaatatgtgtaagatatatattggtttggtgttggtggggcttctggattccagatagataagcacaaaatgttgcattcttttgagtctttgatcagcttttcaccaaatgcacaatttagactggctcagtgaatcctcattgttacataaacagtagggcagaggaagcaatggaatgtgcatttgtctcaggtgagcagagggatgactttctgtccagtagctgtgaagataagctgtcagtttacattgccagggtgaaactcaactgttttgtggttaagatcttgaggcccacaaggaatttctctgttggcaaattatgagggaggtatggagctttttttatctttgtagctatcttacttaggaataaaataggaagcagatttgccttggcttagtgatttgggggtctgagttttttttattctttcacaagatctttatatgttaaatgaaattcctaaattaaattaagcattatcacttctgcaacattttgcattacacaacacctgagtgagaaggccttataaaatccaaagaatgcttagctactttcagtatactttttttctgtttcatttttctttttaaatttagcaaagaattcatattgagttatgagatatgtttaaaggaaattattctcaatgattaagatttatttctcttccttaattctatttaaataaaaatgaaaaatacaaagaaaaaatgtaaatatttatatatatattttaactacagatctattcctgaaagagggggttaactatatttcagaagtcaaattggattttaaatatatttgaatagatgataatttggggtaatcttatagtcagtctattaaggagtgaaaactactactaatttctcactgctttatatgctaattttagtttccatattaaattttgtgaaagtatacatgttctcattttaaaactgttaatatcctgacattaagaatatttaagtctatataaccacttctaatcttcagatttttttctcccacttttattttggcaaattaataaagtaaaatttaacttcaggagggtcataaaagtgactatcattcacctaatagacgaaagtattttgtttgtttgttgtttgtttgtttttgatacggagtctcgctctgtcacccaggctggagtgcagtggcgcgatctcggcccactgcaagctctgcctcctgggttcacgtcattctcctgcttcagcctccccagtagctgggactacaggcgcccgccaccacgcccggctgatttttttgtattttcattagagacggggtttcactgtcttagccaggatggtcttgatctcctgacctcgtgattcgcccgcctcagcctcccaaagtgctgggattacaagcatgagccaccgcgcccgaccgaaagtactttcgtttgcttcttccagacgagcttgttggaggtcctccacccatagtccccacatcaaccccttgatagtaaatcaaggataattgatagatttcaacatttgacttacaaagttttgagaaaatcataaaactaacatacatctttctctgttctgtaattgatgttgtgaaagaaaataggatcttaggacctcatactcactatgctaaagggaaagttaagcttgggaactgagtcaggcaaaaactgcctctttttggttcacagatagctgtaatttctcagccctgtgtcatagcctcattttctcttttcacatgtaaaatgtagatttactgaagcttatcagagccttacaagaatgtaaccatctgcttcatggcctatcctccctcccttttttcctccttgcactttctctaaatattgatgtaccgaaaaacccttttgaaaaaaactcaggtgacagatgctcctatgatttatatttttttcctggatacatcctcccccttgtctaaataaacccgtatagttttaggcctgccttagtcacgttttggtgtacggtgtacaaattctgaatggtaatgaacatatgatccacaattttattttagagtgctcttattttgaggggcaaagcttgctaattattttttcttctaaattctgataaataaaaatattcacatggggcttccagaactagtttgctctattcctgtaacaggtgctatcatatccgttgtgctccagaaaactttcagtatccacataacctgactgagaacttttctagaaatgtggaaggatgctctgcagttaaggccagcttcagaggcatcttgattttatttatttatttatttatttatttatttatttatttatttgagacggggtctctcattctgtcacccaggctggagtgcagtggtgccatcacggctcattatagcctcaatctcctaggatcaagagatcctctcacctgagcctcccaaggtgctgggattacaagtgtgagcttccatgcctggccttgaaattcttaataatgctctccttgaattttaatttgtgttttgtaagttaagtcattgggacaatcaatgaggggtgggttgaaatgtgggggttagagtcttgcatgacctaccctggatagcttcttggctgcctttgcttcaacccctcctaacaactgctgctgctctcctccttggggaaagtaaaggaggtggtggggaagggccatggagtagggaagtggagaaggaggaaaggaagtatacatatgcatttcactattttgcaccccttcccctagtgtgggcctcagcacacatactgggagggttggacatgtgcccagcagcatctcaggacaggtagtgcccaaccccagcccgggctgttaactcaatggtggattcattaggggccccttgaccactcccatccagatgcagagtatgtctcagctgggatgcagtgcattgtggttttcaggtggttggatggcaggcccgtgggaaggagagcttgacttccctgcccttggccaggtccccacttttacattatgcccttggaaacaaaatgcaggttcagtcgcttgccacctacagagtccaataacaaaggagaggtctggtatttcaagacttttatttcaaaactagcttagaggaaacagtaccagcttcctgtcttaagggtcttgctttgcttttggagcagaaagcaggcacttttaaaaggcatgagaggaagtgagcaggtaggtggtctgcatgctagctcagtgccttatctaccagacaattgagttggcatttttgtggtcagaaagggttgtagaggtggcccaaaactctccagatgggagagagttttgtagcgggactttgggttgcaaactgaatgttatctctggaggcaacctcctggtgtgtgacagcccgctctggagtttctaagtccacagttaaatcaacttactttgtagggagtgtctgctgaagagacagtaaaaggctataattgtgtttctaaagagctaagtaggaagcaggggaaaggaggaaagaggagatagaaaagagagaaaaaataattaaactagctcttagattaatgggggtatttgagtatagtctgggtcccatgaattatatagccagcattatctgcagtgagtatatcagccatgggaagtgactgagtcaatcactctaagataacccaacttctggccaggcactgtggctcacgcctgtaatcccagcactttgggaggtcgaggcaggtagatcacgaggtcaggagattaagaccatcaaaaattagcaaaatacaaaaataaaatcagcaaaaacaaaaaaaaaaaagaaaagaaaacccaacttccttgcctttaggtagattattccaagacatgagttttacaatgttttttttagagctctccccacccaattaagtttattgtggtaactggcttgataaaaaaaatcctgtattgagtgtactcatctgttttcacaccactgataaagatatgcctgagactgggtattttataaagaaaaaaaaagctttaatggactcatagttccacatttttcctcacaataatggcagaaggtaaaagacacgtctcacatggcagcaagccagagaaaatgagagccaagtgaaagggaaaaccccttataaagccaaccgatctcatgagacttactcagcaccatgagtacactatgggggaaaccacccccatgattctattatctcccaccaggtccctcccacaacatgtgggaattatgggagctacaattcaagatgagatttgggtgaggacacagccaagtttcttttacatgatgttgctttaaaatgccattataattactttgtattattccccatcacctgtatctcactaccacacttccatggattattatgttacacagtgttgaagagatgtctggctaaacaaaacccactacatgtttgaattccaggcattttgatgtttgtttgagagatataaaaagccttttaaaaattagggctgtcactgaaaatctgggaaatttggtaactctataaaattatatatatatatatatgctttttcaaagaattataaacatcaaaaacacttctgttgggaggccgaggtgggtggatcacaaggtcaggagtttgagagcagcctgaccaacatggtgaaaccccatctctactaaaaatacaaaaattagccgggcgtggtagcacacacctgtaatcccagcttctcaggaggctgaggcaggagaattgcttgaatccaggaggcggaggttgcagtgagccgagaatgcaccactgcactccagcctgagtgacagagccagactctgtctcaaaaaaaaaaaaaaaaaaaacacttctgtccaattggaaaattggtatctttggcacatatgatagtttcactcacgtccatgtgaagagaccaccaaacaggctttgtgtgagcaataaagctgtttatttcacctgggtgcagctgggctgagtccgaaaagagagtcagagaaaggagataagggtggggctgttttataggatttgggtagataaaggaaaattacagtcaaagggggggtgttctctggcgggcagagtgggggtcacaaggtgctcagtaggggagcttttgagccaggatgacccaggagaaggaatctcacaagacaatgtcatcagttaaggcaggaacccgccatctggatgtgtacgtgcaggtcacaggggatatgatggcttagcttgggctcagaggcctgacattcctgtcttcttatattaataagaaaaataaaatgaaatagtggtaaagtgttgggatggtgaaaattttagggggtggtatggagagataatgggcaatgtttctcagggctgtttcgagcgggattaggggtggcgtgggaacctagagtgggagagattaagctgaaggaagattttgtggtaaggggtgatcttgtggggttgttagaagaaacatttattgtgtagaattattggtgatggcctggataccgttttgtatgaattgaaaaactaaatggagtaagagaaggagaaaaacaggtataaaaggtctaagaattgggacgacccaggacatctgattagagagtgcctaaggagattcagcatagtcctgccagcagagattatttatttacttcaagagttaagagtggcagtttgggaatagtaccaggagatatcagctgtgatggcttgcagaaacagtgtaaaccggcagtgtaaacaagagcagggcatgtatgagtagttgagaacggtgaataggcgtatgactagacagaacatagtagggatgacaagtttttgggggcacagtctaagttgttctggtgtctggaatgagactggggcctaataaaaaggagcatctatacaggagctcaaatgggctgtaccctgtagcattctgaggacaggcctgacttctgagaagggaaagtggtaaaagtattgtccagtcttttttaagttggtggctgagcttggtgaggtgtgtttttaaaagaccttttagtccattctacttttcctgaagacggaggaccgtaagggatataaaggtttgactgaatactaagagcctgaaaaactgcttggctgatttgactaataaaggctggtctattatcagactgtatagagatgggaaggctaaactgaggaattatgtctgacagaagggaagaaatgactgcggtggccttctcagacgctgtaggaaaggcctctacccaaccagtgaaagtgtctacccagactaagaggtattttagttttctgacttggggcatgttgagtaaagccaatttgccagtcctgggcgggggcaaatccccgagcttgatgtgtagggaagggaaggggcctgaataatccctgaggagtagtagaatagcagatggaacactgagaagttatttccttgaggatagatttccacgatggaaaggaaatgagaggttctaagaggcgggctagtggcttgtgctatagcatagcctgcctttgctggtgtgtggcgattaggcctggtggaaccaccatcaataaatcaagcgtgatcagggtgaggaacaggaaagaaggaaatatggggaaatggggtgaatgtcaggcgcatcagagagatacagtcatgggggtcaggtgtggtatcaggaataatgtggaagtcgggattaaagtccaggccaggaacaatggtaattatgggacttaacaaagagtgagtacagctgaaggagccggggagcagaaagtatatgcgtcaggtatgaggaagaaaatagattttggaagttatgagaaatgtagagagtgagttgagcatagttcgtgatttttagggcctctaaaactattaaagcagcagcagccactgcacgcagacatgagggctaggctaaaacagtaggtcaagttgtttggacagaaaggctacagggtgcagtcctggctcttgtgtaagaattctgaccgcactaagcatgcctaggaaggaaaggagttcttgttttgtaagggattgacgtttgggagattaatcggccacaatcagcagggagagcacgtgtgtttttatgagaattatgccaagatacgtaacagatgtggatgaaatttgggcttgactgaagtaataggggctgtctgtgaagccttgcggcagtacagcccaggtaatttgctgagcctaatgggtgtcagggtcagtctaagtgaaagcgaagagaggctgggatgaagggtgcaaaggaatagtaaagaaagcatgtttgagatctagaacagaatagtggattgtggagggaggtattgaggataggagagtatatgggtttggcaccacggggtggataggcaaaacaattcggttgataaggcacagattctgaactaacctgtaagccttgcctggttttaggacaggtaaaatgggggaatggtaaggagagtgtataggctttaaaaggccatgctgtaacaggtgagtgataacaggctttaatcttttcaaagcgtgcagtgggatgggatattggcattgagccgggtaagagtgattaagttttaataggatggtaaggggggcatgatcggtcgctaaggagggagtagaggtgtcttatacttgtggcttaaggtggggagacacaaggggaggatgtgaaggaggctttgaactgggggaaaaggtggcaatgaggtgtggctgtagcctaggaatagtcagggaagcagataatttagttaaagtgtctcggcctaataagggaactgggcaggtggggataactaaaaaggagtgcttaaaagagtattgtctaagttggcaccagagttggggagttttaagaggtttagaagcctggccgtcaatagcacaacagttatggaagcaagggaaacaggcccttgaaaataaggtaatatggagtgagtagcctccgtattgattaagaaggggacggacttactttccactgtgagagttactcaaagcttggtgtccgtgatggtctagggggcttctgaggcgatccggcagtgtcagtcttcagccacgaagccgagaagatctgggaaggagtcagtcagagagccttgggccagcattccaggggctctgggagtggctgccaggtgagttgaacagtctgattttcaatgggttcctacacagatgggatacggcttaggaggaatcctgggctgtgggcattccttggcccagtggccagatttccggcacttgtagcaaactcctgggagaggaggttctggaggaacccctggcagctgcggttcaggtgtttggagttcttgtgtgctggaaatgtggctggggtttgtctcacagtggaggcaaggaattgcaactcagaaatacattgctacttggctgcctctactcttattactgcacatcttgaaggcaatgttaattaagtcctgttgtggggtttgaggtctggaatttaatttttgcagttttatttaatgtcaggagcggattgggtaataaaatgtatattgagaataagacggccttttgaccttttaaggtctagggctgtaaagcatctcagggttgctgccgaacgagccatgaactgggctgggtttttcatatttgatgaaaaagagcctaaacgctatctgatttgggataaagaaaaaggagcattaaccttgactatgcctttagctccagccacctttttaagagcaaattgctgggcaggtgggggagggctagtcacggaaggaaacagtaagctggaccaggtgtgaggaggggaggtgataaaaggattatagggtggaggagtggaggctaaggaagaattgggacctagctcggcctgctgaggagcagcctggggagaaggcttataacattatctacattgaatttaacctcttacccagacagtaaatttacttccttttatttataatcttcatgtgttttattgataaacatttgcataaaaattagctaaaatttatcaagtgcataccatgtattgggcagccttctaagtacttcatatttattaattcacttatttttttcaatactcatttattaaataatcctcattttacagttgaagaaattaaactcaagagaaagaaattgggtagttaagtaatctacacagtcacataacagtaagaggcagaaacagaatgtgaacccaaacagtgggtttcagaggtgccttcttaatcaatttattattctgctactttgtattattctgatactttatatcagaaaatgaagaaaaagagaaagtgaccctaattgtctgaagtgtttagttcatccttgcattccctatcacacgatagtaataaaaaaacatttttaaagttattttaattatgagcatgcatacaaaaattctaggttaatgggtggatggaatgcaatgattatacaaactaaaaagtcaagaaatgtagttcttaggagtaaaacttaaaaagagaaacaatgcatcttttataaagcatttaatgttacacaaacttaggaaattaatagaatttgataaagctgacatatgatatctactggaaatttgaaagcaaatattgttttaaatgttgctgtaaatgttgaaataagcttgttaattaaatggtgtctgttcaacaagctctggctgtcttggcctatgcaatacaagaagaaaataaaacaggagatatgcagattggaaaaaagcatcagaattttctgccaagcttatgactatcgatgtagaaaaccaaagaagttctcatctacactcatggaactgagagacttcagcaatgttgctactcataagagccacatgaaaaaattaataaccttccaaaagatcaatgaaaaaacaatcaagatacgtaattaaaagaaacatttctcttgtaacaacaacaaaagacattggatagtcatagacctttaagaaaagatgtgtaagatctatgaggattagtgaaggttttacagaaagacctaaattaaggtgaggtatgaataggaaggtgttaaagcaagaatataaattttccaaaatgtatgccaaaaattattttctgaaatatttcccaaatctcacagttcaatgaagtgccaatcaaaaccatatcaagatttttttctgtggtgattttttaaaacttaatttgaagtgtcgttaacagagagtaagtatacaaaaatagtcaagagaaacctaaaaaacagaagaaggaatgaatcaatctaacaaatatcaagactttttacatagctaccttaattaatagagtgcagtatttgtgtaaaaagaagccattatttcagtggattatcacttcaaagcccaaaggcaaaggaaagaatacttgagaaattagtatgtgagaggattgattatcagtttctagttatttctaatctataagtagaccagaagttgagtttgattatatgtgtgtgtgtgtgtgtgtatatatatatatatatatatatatacacatatatatacatatatatatgattatgtatattacatatttgagcaaaatttgctactatggttatatttttagtgaatatttgaggaaataaataaaatccaagaaaatagcaattcaatcttatgtcaataagtaactgtgtaattgtcaaataaaaaaatccataaaatgaacattattaacaactaatacaagaccagctcttgagtagaccatgaagtgtaactaatcaacaattatggcaaagttttttctcttttgtgagaacgaattacaatgttttccttacagctttttgaatcagatattatggctctgaaagcaaatttaattttcatcgcaattcatgactcagatatcttttcagtggaaagcagtgaattggctgccaattagattgatgctatttgaatctgcatgcatgttcttgaaataatcctaaaagaattcaattcaacttgctgacaaaagaactgatctatactgctgggtttttttttctttttattcatcctattatgttccctaatcctgagtatattttttactaggaatgaatgaagattgattcagtcccaattacagaggccattcagttaattaccctcatgttatccatataatgtacacctatataaatgaaagtcacttttctctgaagtctcaagtctatgaatttcttatgggaccagtgcagaacaggtaatattgcaattataattggatacatatgcttgtaattacactgccccactcagatcttcttactctacctagtatctgataaaactgatagttgggaaaatgagaaatagaattctgattcggtctgtaatgcagatttatttcttgaaagctacaaaagtgatttctcaaaagacaactgctatattttaaaaaataaaatcttgcagtaaacaagtttcctaagagagtatatctcttattctagagaaaataattcattgttttagaaactagaaagcctaagtagcctagggtttcatagaacataagttgaaattaattgacctcattataaataatgacctttcctaacagagcatgttgatgagtatctgtatgtgcagaagtgtcttaagaaaatgattggtgaaggcaatctcatactatgccttcagacactcatttcttttaattttcatctacttcttacatttcactgtttttccaagctcatgctaaatttctcagagttgcttctttgttttgctctgactcattgcagtttctttgtgttacatacatcctttaagtccccccttgagatggtaataatctgttttcgtctctgccaactccctccccaacaacacggcatatttaattgtaacttcaggaggcacaattattcttattatagaattcagacaatggaatgggtaaacacatataagatgatgagagtcagaataagtatatataagagaaaaatagttcatatgttgtcacatgtgctattgtgacaatacaatagtgttgtgtatggaaagcaaggatcttctcccaatatctacaggcttattatgtgataagtgatattttttctgtggatgaagagacagaaccagaaaatattggcaatgctaacaggacacatgttagttcaactgtatggagaacttcctgccaggcaatgggatgagttaactaaggacaacggagctgtgtcatgctaatgattatctgaggagtgtgaagtttaccctattgtcaatggacagctaagaaatagaggaataactttttaacaatagatcaattctgttcttgccaaatgaatatttagccaaatgatgaattcagcatccatttggtttagataaaacaatgtacttagagtagaggactgaaaaataaggcagatgatttggaagagatgcacacgtgagtatggtccatgtagaggtcatagttagtattatgaaagaaaagttaatgggttttacagtatgaaagaaggcaaaaaggagagtgctgggagcatggaaaacttggagaaagacattatatatatatacatatatatgtatatatatgtaatgtaaagacattacacacacatgtggagtaaaaatgcaatagaaaataagacagatgaacataacattaaataaactaaaatacttttatgacagatgagaaaattgtataacgtaagtgctggggttggaggacaaaattttgttcctgggattaaagaatgctggtgaattgaaaagatcaagaagtaataaaagaagtgtcttcatccctttatattgttatgtcattgaactctcttatggattgagtagaagattacaagtgtattgcccctttgtttttctcaattaatttttatagaagtatggtgattgaaactaccagtatcaatcaagatggtctaggatatggaatgataacagccaactgtagcacatcagtgatttcagaccacacccagactgttggagcggccactcaaacattgctaatactagagcagaaggctctgtgtggtcttaattggcaattaaatgagccagcctggaaatgacatgagtcaggtcaagtgtacccaaaactgattgacctgatagatatttaatggttgtttattctcaagtagtgaggatatcctacccattcactagctagatcagagctgtgtcctaatgaacatgggtactctacacgcatattaaaaaacacttattgcttagaagggtatgatggacttggggacttagagaggaaggttgggaggaggatgagagatgaaggactacacactgggtacattgtacactgctcgagtgatgggcacactaaaatctcagaaatcaccagtaaagaacgtatccatgtaaccaaactcacctgtactccctaaactattgaaataaaaacaaaacagttgttggttttgttgctgtgttattgctattgcaatacaaaatatgaaaaaaaaagaaccaggaatatctaagtcagttaaaaatagtttattcgtactcccagaaaactcagaggccataaaataaatagttggaagcaaaaaaactagaattggagagaattagagtgaacaaatttgcaacgaggaaaataatgccagcaatgaaactaattatttatgtgaaaaaatatttccaaaatatcaactaaacatttaaaaagtgacaacctaaacaatcatttaattaaaatgataaatgatcaaataagacataaaaataaactctctagaaatatatacaaaaaatggaaagacttagaaactgttcttataaaattcataaaattatagaaaattataattcctatttttattaaaacaatagtaaaatgcatattattatatatgctgatgggattgtaatcagaaaaaagtgttttatgagacattttgttcatagaaattaattataatgagatggtgttaaatagaaagaatatcaaccataaagagaggttgcctaaatttgaaatcagatcataacattcaccacttctggatgaaaactttacattttaaccgtttaaatatttatttgtttccatccatctcctagaaattaaaaacatacctaacagtgagcaaaagatgcagcctaatgaggttcagtgaagcattgtttattttaccgaaactgaagaaaacatataataaattattctgtacagaatttgccacacaaaaaaattaacgtatctccataatgtaatgaatgcaatacattttttaatgtattcatctgaaaagatatttaatatattattatgtgacaaaaaccagtgaaaaaagagtatgtgcagtctttcccacttttagaaagaatacattagtataagaacaaataaacacaagaatatacaaacattagagcagtttcctttggcagatgcaattatgaagaaattttaccttagtattcattttaaatattttaataataaataaccttaaattacttttatgataaaaaatagaactgtaacaatagaagctaaatgattcatttaaagtatattccaaaatattatgttggtagtaggataacaacttagaaaagtccatgtaccatgtgctacacattacagttttaaagtgcctttagtaacatctgacaaaagttgataatataacacttaacaaccattgtacagaataaagagccaatactactgataaaggcatattacccacaattggggcatgaaattttcattttccattaagattcattttatacagctcctctaaatggcctcttacgagcccattcctgctgtcatcctgcccacttgcttacataaacagaaatttaacagcccatattcttgaatccgtacacttaacattaagtgggtgcttctctgaaatagtgatacacatgtttattaggaaatatgatgatatttatcatttaatgtcatgctttatttggtatatggaaaattctgtaaagtgaaagcaatttccaaatttataaattattttctaatgtgcatttcaaaagcagtagctccattttccgagttttaaatctgaacaagaacaattctatttgcccttgatctatattgcattgtattgatgtgatatttcatggaccattattttataaatcagatttctaacatacttaggacctaagttatgtcaatacctccaatcaactactattatcctgttttcatatttgcaatatatttataatagcttcttagtagaggtagctaaaattataattaaaagcaagactgtgcgtttgtcacaggagaagaatgttaaaagatgctgttactattaggattattaataatgctattattttactattattatattcttcaaagcagaggtgtccaatctttttgcttccctgggccacattcgaggaagaaacattctcttgggccacacataatatatactaacaatagctgacgagcaaaaaaaaaaaaaaaaaaaactcacagtgtcttaagaaagtctacccactatgtgttgggctgcattcaaagctgtcctggatcgcatgcagcccatgggccacgggttgaacaagcttgctttaaagtaatagcatagtgcctaataaacacctagatatatttctctcagataattactagtgaagtttatagaactagatctgaattttgaaacttgtctctgattggacagaggcataacaaacaacattctttgccatctgtaagtaactacagttcttagttatccaagtgttggaattggggcaggcaacagaaagaacattgtatttgtctgcagaatactcttgattatctcttcaaggaaaggagacttggaataggtcttgtcttcttcatgtaagtgtgctctttggaaaacatatttgaacttgcatgcaaatgactttcagagagtttgcaacctggtagagcaaaccatgctttgttgacctggatcaagactcccagaagaggggcaacttccctagctccataccaatcagcttttaccacttcttggattccattatccatgattttttgaacacagcaaatatcaacccatcaaagttactttatgaagagaagcacccattctccttgatttacgatggggttatgtcctgataaacccatcgtaagttgaacctattgtaggtagaaaatgaatttaatatacccaacctgttgagcatcatagcttacccttaaacatgttcagagcactcatattagcctactgttgggcataatcatctaatgcaaagcctattttataataaagtgttgactatcttgtgtgatttattgaaagtaaaagataaaatggttgtatggatactcaaagcatcatccataaagttttaaaaaatcattaagtcacaccatggtaagtcagagaccatctgtagtagactttctttcataaggaatacaagtaatagcccaaataaacatcttaaggaaagaacataaaagactagggagaggggtagttgttgggagtggggaacatgaaaaagagagagagagacagatatcagagccatttttccaggctcttaaagattgtcacagggtaggaccttcagggagaaaaagttaggaacgtgtttccacactaacatccatgctaacattaactcccacaggagtattcagaaagctcagtggtgcctcttactcttatatgatgttttaattatgtttatatatcatccagtgttttgggaggcagagaagaggctggccacatcttactgtagcatgggttcttatcctatgcctcttttaccccattagatattaaagtgaagttgtttcacatgttgtatgtggatgactgaacagaaaacaaatcatgagcaatgctaagttttagtaattactgatcataactttaattgtcactcagttgcatctagaaataggtgtcatttagtccatctattaagtttctccagcaaaacagaaccaacagaatgtgtttacatataaagaaagagagatctattttaagaaattggttcatgtgactgtggaggtctaatgagtcaaaaatcaaggtgctggcaaggttggcttcctttgaggcctctttcctgggcttgtgaatgtcagaccacttgctgcctctccacatagtctcctgagtgtcttgaactcctcttataaaaacacctgttagactgggttatggcccactctaaaagtctcattttaacttaacctctttaaacgtcctatctccaaatacagtcacatttttaggtagtggggggttaggacttaaatatataaacgttgggggacacagtttagcttgtaaccatccaaaagtgaaatttatgtttctccattttgttatttgttgttgcaatattattttaataatgaattatttgtaggtaatggtaaagcatgcaatgaaaacttccatgcctgctaaaacgcttttaaccacaagttagaaaaacaaacacataaccacccaacaaaccaaattcttacaaacaaaagtagaagcaaaaacatgtacagatttcgcaaaactgaaataatggttgttagagatgtttcagagttggcttaatcccattaccctggctccgatccttagtgattctgtcaggtccaccctctgctatgtccagcctttgtcctaggactggttcctggggaagattacagcctcataccctcaagtaatgtccagaggaagaaggaattgtactttctgaggttttctttaagcatgacataattcctccctgagtccctcaggaaacgtcttttggtatttcatttgtttgactaaggtcacttttccattcctgaagcaatcccatgtccctcaataagcttagcctgattcctatgttatttactaggaagagaaagaggtattgtgatgaactttgaggtcaaacctagtcaatcccccaaatttatggaaacaacagtggtggagaggtggactagatttgagggctaacaccataatgacctctacaattgcctatgaaaaagaaatgtaacttgcgtttaaattttaacacaaacacatttaaatgaagaatatatttcatagaaataatggcaaatggttttctgtaaatgtgtgctatttccggggaggttgaagagattggtgttgaagggctaataattgtattacttcctgcattagattatggtccagtgaccataatgtctttaaatcacaagaaaataagttggtttaatattggcttccaggacatagaatgtttgtttattgtgtgaagtgttgcattttaactgggagcaatggtagtttgatttcatttccagtgccttgaaaacatctaaaatgttcatctctctactaccattgtaaactaagacacatcaactacaatttctgacaacatttatattagctttattttcactttacaggttcttacacatttgattaaaaatatgacagattcttacaactctgaaattaaaaaaaagtttaagtccttgtattgtgctgtaaagtccttattattttgcaaatatttttgtactttgaagcaaaaaggtgcaactcttaattttgcatttgaatgtcttcatagatctccaattactaacatagcctaacaccgatattcataatatgtaagagattgtattttcatcacaatgtaggcaatatgacaatttgtttatggaatatggtgggaaagtaaaagttttcttttggagaattattcaaatcatgatggtcctgcacctgtggtagcatcagcatatacggagtatgagtgtttagaacaatgagtgtttatgatctcaggaagaaaacatgaaacaatattcagtgagttcaccagaactcagtcttcagtacattcttgaagagccatagaacaataaaagaattttgttaaatgctcaatgattatataaataaatgagatataattgaacaattatgactaatgaggtccggcagtatggaaaataaactctccttggtcagaatcttcctgcttacagataaattgaattgcccaaagaatgttcattgaatatggataacttgagttcattctggaggagaccctctgaggactgcagaacatatctcagaatcatcccaccaaagagtgaggatctagggtgtttatccatcaatttccattccttgtgggttaagcattgcctttggtacaattattgtcctgaatgtatgccacacctatcaccaccctcagctccctgcagtctcaaagcttgccgaagcagggaaaggtgggaagctgtctgtgctctgtgcataagggaccagtctgcaggtgaactccagggtaagagagaggatatgaataggacactgacagtttctgctattgtaagttaggctatgttatggtaagaaaaatatatccacagacacctgtgccttgtttctaaatatatctaaaattgataggaagaggattctgcttagtgcagtcaatgagagatccagactattggaggagctgccacctcatcagggcatatcctagaactcatgctcttcccgttgtgtagcataggtagagaaacaagaaaattgcagagaagttgtattacttcagcatgaaagtagcacacatcaccacagccaagaactatccacaactagttgcatatcccaatcttactttcagaaggcagaaagttgttgagaaagatatgttctacctgcttgccattactctctgtgttacattctatcagtctggtcatagcaatagcagtggtgagaatagttgttgtaatagtagttgtaatagtacgtagtcatcattgtaatcgttgtaattagtgatgtataaagaatcttcgcaacaaaagagagttgagaaatctgaaatattttccagaagatattatttttagaaaatgtaattgtttgacattaagaagaaagaagttagttatcatcccaactatatccaattagtatactttcagtgtaaactggaggaaagcccatcccaaaataatttaagtactactagcagtactgaaaagtccagagtacactgcatatcaggatagcttgatgcaagggtacaaatactgtcatttataatttacatttgattctgtcctctgtggggcctccatttcagatattcagacagaacttgcttcatgataaaatgaaaaggagatgggttcagaatagacttggagaggcagtaagagtacatgaagtttagttttccttgacaatgacattttaagatattatttgctttctgggccaataagctgcttgctttgattatttccctagaggatactgttaatggtttcatcaaaagcagaggcatggtatttaattttgcttgcccgaacctccctcaacttttggatttcagtaagtccgctctatgcaagcactatatatgggcattcaagctcctctctaggggttcttcttactcgtaagataaagctgcttcaggtagattctttctcccatggatcatttctggatcacaggaaacgtacatgaatttttctcctagccaaagtacaggtttgtaatttgttgccaaacaggaacaacattttccttcagacccattattaaattcatagctgtccctgctctttgcgattttccagatatgatttaaacactggcccactgtgtctctccctaactgcaacagacacatttaaaactccccaagccatccaaatgaagtccctatataaggcttatggtgggggaaaattaccacccaccacactctccctttaggaaggtgaatttctcacagagctatccaaagaaaatctgattatatatcatcttgccaacttcaacaggtaggccttattatatttaaagagggtaaggaggtttaagagtgccatggattgaattttcttggtccctatcaaattcatatgttgaaactgaatcctcaatgtgagtgtttatttttatgtgaagtttttgggaggtaattagatcacaagggtggagcccttactaatgcaattagtgcccttataaaagaggcctctgagagataaatgagaaatagtgagcacagagtgaaaagacagctgtctatatgccaggaagtggatgctcaccaaaggtaaaatcttcccctgccttgatcttgaacttgccagactcaagaactgttagaaatacattcctgttgtttataagccacaaagtctatgatattttgttatagcagtccagacatacaagtttttttaatgatctgtaatactaactatatttgagttctactaagtattaacatttcactaatctcttttgtcttagaatattagtcaaaactcccattttaagagaagctacacagtcttgggttcggttcaaatccccttagaaaaagtgataactactttctcaatatctcagaaaatgtttcattggtcctgattgagtgatgggtccatccctaatataatccttgagggaagaacatactttgattcccttcacatctgagctgggagatggagctcccacagaacacgtgttataagaggtggagaatggatggttctcccattctggtggcaaaaataatagattccatttcaaaaccttatattgtgaagtaggcagtgaggggagcaattgagagcttttataggctacatgtaacacaattaatggtgtcaataacagtatcattttggcacattaatcaattatcgattaagggagtaaaggtggtaagaagaggtggtattgtacttcttctctcctatattgtcaaagatctccttcttgcttctttcatggcttttggcttcctgatggcttccagcagcttttgtgttgttcttaggatttacatatcgtttgcttgaataaaaaatacagacaattttgcattttttataaccatatgaaaactctttggagtaatacttgtatttgaaattattaccatgacaatcattacacacatctatcaagattttatttctttaggacattctgtatctaaatttctaggactttctaagaagggagaaaaaggaacatcatacacaattattttaaataaacttcaaagtacagttagaacagaaaaaaacttttcattattttatacattttattatgtaacttttgtccatgttgagttcactctaagtcatgatgctgttcctcacgtttctcttaattatattctctaatagtagaatgtgtacagttttaatattctctaagctttagtcaagggcagctttgttctttaagccttcatatattcaacagctatcaccaaaataatattcaatctttaagccaattttctatgtcagataattctttaaaatgtcatggttggttgctttaatttcatcaccccttcgaaagaccgtttgggctctaaaatggttacatatgtcttggttaatgtcctcagtcatggtgccttcagctgtcttttcatttctggacctaggagacttattcaatttccattatattgtatggctaatcaaaagaaggtctttacaccctacttatttagctgtcagaagtacctgtatcaaaagaaaaatacaaaccaaaataatctaaataagcatttcttaaggttatgactcctgcactgaatttacggaaatatttttggtcaatttctggcttttgagtataattagtacaagtgatcagagaatatgaatcaagttttcataaatcgttatcacttgtggaactctttccagagctaagaggatacaactgtttgcatacctagttcctagtaatattcataagtggacaactttcaagctctagcttcaagtttatcatcatctgatttacaataatttattctttggtgccaaattaaaccttttgttcctaactgcaaagagttattaagattaatagtttgtccccacaaaagattttcaataaatttcccttttgtcttccttttctgatgggtgagaagggagggaacctttcagaaagagtgacaatggatcagttacagagataaaatcaacagcaactctctggatttacttccagtaaacaacatcaaaatgatacagggttggaattttgtgaatctattagttaatggtggtttttttttcttaaaaaattttaaactgctctatttctacctcctggatcctttcaaattctatcaccatctactttagatccattggattaattattttacctgctcagttttactaattatttatattattggagaaaaaatattgccaatactttaataaaactcagcatatgtacaatataagtgggaaattaaagcagagaaacagatgcattcagattaatttataaaatatgctctaatatatgtcttaatgatatattagagtgaaaaactatagttaaaactttaggagtagcaaaatattaccaatcatttgcagagatatgaaaagaaaatcagatgcccaattactgaagcattgttaaagcagactttgtctcctttaggaatcactctctttctaatcccccaatttttttttgtttcttggaaagttacaactctgtatgtaatttacttagtattttcttgaaaaaaaaaagaagaaaaagtttggaaccttagatttaactcatttctggatagattattcacatttttaaccagatataattcttgcttaagttctttgaataagtttttcataaaatactgtgccttgttacgtgatatgccaaccacaaattgtacttttaatatttaaggtggagttctttctattagaaatagcttctcttaaaaagcttttattttattttattttattttatttatttatttttgagacagggtctcactctgtcacccaggctggagtgcaatggcgcgatcttggctcactgcaacttctgcctccctggctcaggtgatgctcccacctcagcctcccaaatagctgggaccacaggtatgcaccatcacacctggctaattttttggtactttttgtatagatgaggttttgctacattgcccaggctggcctcaaactcctggactcaaaggatccacctgcctctgcctcccaaactgttgggattacaggcatgagccactgccccaggacttaaaaagcttcaaagaaacactttttacaaaagattaaaaacaggaaaagagtaagagaataaaccctacactacagaatgaactagttatcatttactaacaaatggtacaagcaccacacactcacagtatatcccctctcccatcccatctactatgatatatatctacatatatgtatgtgtgtgtatatatttacacacacctatacctatgcaataatatcttaaaattctaaaataaggaacatggtctaagctaagatcttactacatagttaaaatcaatacaatttttacttttccaggaattttaaactgtgggattactgcatgtgattaccatggagaggggatgaatgttaataaatgaaagtgcataaattatatccctattgatttgtttgaattccccttttgtagggaattagtggaagccttagcttaaataactattgaagtgccagcagcactttggttcaccttttcttcaatattgtgattctttttgtcataagatgcacatctctgaaaaatactgatttgctttcacaagacctattaactttctagtatcagatcttacattttaattgcagagagaatctagttcctccagctgtcattgcttaaatactaagaagctttctgcaacaccttgaatttaacaacagcatgtctacgagtcatgctattatctttccctgtttcattaatctgtgcagtattagaacttctacagaggacacgattgaaatgcatacttgctctgagcacctcttagagctgtggctctgccatggactgtggaagcctgcactattttagggcagttaggcatgtttttcctatatgccaatggccattcctctaaagtgctttgagctttagtgacttccaaaatcaaaacttggtgcaggctggacacggtggctcttgcctgtaatcctagtaccttgagcagcggaagtgggaggattgctttagcccaggagttcaagactagcctaggcaacatagtgagaccctttctttacaataaaatagaaagctagccaaggtggtggtgcacacctgcagtcccagctactcgggaggctgaggttggaagattgcttgaaccctggatgttgaggctgcagtgagcctttattatgctaccaaacaccagcctgacagagtgagaccctgtccaaaaaaggaaaagaaaagaaaagaaaaaaagtaaagtaacttgatgcaacaattgaagtaaaaactaaagttcttggggggaatatctgactccacagttatttaaccctgacatagtcattgctaataatttccagtagctttatggctaagttcatcacggcatacatgatactaagactttctggattctgaggttctttaattacagaaggttaaaataatttggatttattttttgatcctcagttatctacaaaaatgtttaaattatgctcagtattatctggttaaaacagcaagaaagtagatgaaatgttaatttaaatatctataaaatagtcaaaaactttaaagttaatatgtaaagcaacaaaattctgttttccggaaaagtaatttatgtgcaaagaactttattaaggaaaatctttccttttacaataatgaaagataaataaattgccactgtggttattttcactttcttaaatacagtcacattttgtgtctgtcagactgaagataagaaccccacagagaaaagctaagaacatgtaattaattcattgatagaaaccattatggtttgcatttcactatctttataatattcatgtagactatatttttctttgctaacaagaaaaataatgtttcatgtgtttttgaaatgtgttaaattagctattaaaagctatgtatgattaaagaagattatgaactatagctgacatatggagacatgtatttagtagacatatagcaactgttatcaggaccagtatgaataagtaatatatattataaaaactataagcagcgatgacaaaaaaagaatacagaatattttcattaacttcaatatatgaaatcaagtaacagcagcaattaacaatcactgcaaatgaatatacaacaatatcgatcattcaaaaagtgaaaaagaaaattaattaacaacctaattaaaaatcacagaatgccctcaattattctgtttaagtaagatcatctttttagttctcagtttagaatttggactaattattcaattaaatttcagagaaacatcaaccttataaaaacctctattctgggcatttaaatgtagattattaaatattcttaatgaacacagagcccatccagcattcctttgatcattttaggatatctccccttttctgtccttaaactaaattatccttcccttttatagatggatcagagatagcagctttttaataaaataaggtcaacttgtaacattgggatctttttattagatttttttttcaaatactagtgctttggactgctgccatttccttacacctgaactgaggttcttttttctgctgtgtctagacatttttaaattgtcttgtccatgtggtcatgaattaggctttataaaacagaataattatattttgtgactaattgtcagctgtttctactaaagagaatcaaggtttattttcatttgcttgtttgcattatactctagataagtatattcaaacagctttcataccagttacacacaaacacaaatcacagacaaaagatgttttaaattttctaatgcaacctaaaccatttaaaatgtaaattgaagcataattacattttctgaacaaattttaacaagcatcttgcttttaaagtctctgtatgtttttgcatgagtgtgcagcagcttttatgagctaagttgttcaagggctgcagacatttttcataaagaggaaactgtttagcacatggattctaggtctccatccgtgttaaatctttaatatttggtttgatttgtttctgcatcaactttcttttttttttaatttaaggatttatttttgccttgccccaactcagtacctccttttgtttccaaaaacttagccacttactccaataattagtcagtcatgtagattttcctgtataatgaagaagagaaataggggagaatcgtgtatcaaaccactaagaacaaacgaaccaccttcctcaaaaccgttttgtttccacagtcactgtccagccttcaggcacgaatgggaatcctttacacttctccttttcattgtcttgtttttcaggctttagactcctcctagtttttccatctatcccttcaccagttttggctgctttccacatccttatgcagagcaaatcaacccagtttcagcttcaacctccaatctttagtcttgcgaatctacctctactgcttagaagatgtctgtgtgtagaggagggagggtggtaaattttaaaaagaaacaaaaagttacatgaagattgataatatgctttaactatttgctgaaaaaggaaggaaagaaagtgagaaagatggagaaagagagaaaattgggcatatttctggtatttccatcttcactagaaatactaaattatattatgttgcattgttactacatttaagccatttatttaaaggtcctattaggagatataggacctatatatttcctaaatacctatttctctttaattttcataaaaacatttgagctagtttatattattatgcccattttacagatgaggtaattaaggaaattgtccaactttgcctcgctggtgagggtagaattgtgattagcatccgggaggtctgactctagagattatgctcctatgactactttgccatagtttaaacagcgtgtgggttgttgctcctagcctggcatggtgctggacaaatattttcaagtcctggaatacaatttaggtaatgaagattttcaaatggtctaccccctgtgcctgtccctggcatttaacatttgttttatgaatatggacactttgacatatatgactgcttactgtatctgtaaacaaatctgaatccttgatgatgcttctcatttacttaacaagaccttttctcaaagggagtacaaagaaacttcattccaagccccacataaatcatcttgaattccgaatcaatggtgactgaacaaatgtggttttgtggtatattgcattgttttacattcctgcttctgttaaaatcactattggtttcttttgctttaccatgatttttttaagtcctgggcaggcacgtatgtggcttattttcccagtctctgtgagtttttggtacagttatccagagttcaaatagagggttacataagactaccattgactcaggtgtttcactattagggacctccttgcagcctgggcaacttcacaaaccaatgtagatattactgcagcacaaggcaaaaggactgtgtgaaccttctggtgttaaagactagaactctgtgtgaattattttctattctgaaagccatatagaacaatcaacacaattagggagacaatacagtttttcttgtattttaggagactccgaggaccaaatcaattctgattctctaacttcctacatagtgtattttattaactagaaaggatagagtttactaaatggcaattttattgctccctttgcctaggaagagagcagtgggatctttagcttctttattacaaaagcagtcagatattttatacagtaataaaagcaccagctgccatttgagacagctaaagctatgcgatgagtactatgagtacaacattagtaatattttctaagaaaagtgttcattaaaatgtaagtttttccctaaccccaaacactactggactataaatagttatagacaagctaccttaaactggttagagaaaaaccatgttaggtaatacctttgaatacctcaactattaatgcatagaataggagaaaataaagttacagccaaaatgaattggggcagtacatttatttccctcaaaagtgcatacatttttttcacttgtccaaatgttgttatatttccaactgatatataaaaggagaaaaatggcctggtagaatgcatttgctattattaaaatttggaattttttttaaagctgctgtgtctttcaagtaaatctcccaaatcaattaactgctctagttattaacacttactagcaactactttccacaagtcagtagctaagagcatggcatacaaggaaaggaaaacactatcagtgtcttctaccagtcaatattataatcaaagagatgaaatttaagtatgtgaaatgatacttagtaaagtcaaacaagtgcttgtgaaaactgttgacacaacgccatccgaagagttcagtggtaatttggcaagggttgtaagagtaatttttcagaaagaaaataagatttgagatggttcttgtaagatggatgctatatattcccatattgtaaacaaaattatgaaaaatttgattaatagagaaattgcaacccagagcctgccatttagtaagaattccaatatttgtcaaatgtatactactataagaaattttaatttgcacaacaaatatatgagaactgtactattactatttgcaacctacagataagaaatataaggcttagagagtatccttgacattgacaaattccgtcatagaggaactgagtagtcagattctgaagcacaacattctgatccaaattatcatacagaattatgtgtgagcttaagtgaaacttggaacaagaattggtctggagactgaaatttgcggaggaagaaagttgtttgggatcaggttttgaaggtctttaatgttagcttgaaaggattaaggcttagtaatagaaaacaggaaggaagtgggtttgtaagagagtgtgggtgtgtcctaaaagtctgtgactttttttattgaaatgtgttctatttctttcaaatgcaagaacctttagaaagaatgccttgcttcttatttcagtaatccttaagaataggcattatactggaaacagagtaaattagcataaactcttgagatggacagagatttttttagggcacttttatttttcaactcatatcattcctgaaatctggaacatgttatatgtgataaaatcactttcctatattatttttcccttaaacctctagttacagaatcttataacatattgtatcttataacccatggtacctttgttagaatttaggaaaaaggtcatttgaagaataaaatataatatgaaataaaatacaaccttgaatagaaatgtaagaaaatcattctaaaatataagaaaaataaaaaactaaaccttagggaacagagaaagtatcaagaatagagataaatttgcactttaaagaataaatgaatttttcatagtgcaatagggtgagaaaggtgacatatgctcatttaatggtgaactaagaccttgctaagtaatggagaattttttaaaaagtgcaagcctgcttattgatttgtcatttcaggtgggcaataaagattaaaagagtatgatgggtagctatgttactttcatcaagttaaacgaactctgtaatttccaaattcctaagctgtaaaactgccacgcatttagggccataaaggctactgctctctgacatcccccaaagcccaccgtagggacttgctcctttgtcttctcctgcaggcacaagatatgatgaaaacacattgacttccacctaaacagtgtcaccataagagaaaaatagcatctcatgacccatcacatcctgagagctcccttttcaccagggccgaattctgagcagcccaagtacaacccttcttccagggtctactctctaggccactgtgtctcaaagtagtgttttcctagggtgaaacccccttcccacatgttctaccatattcctttgtaatatcacactcctaattttctgtgatgtttttttctctcttaatgccattgacttctactatcagaagccctattctatagtaaataaatacttttaaactctcaatatcatcagtgaaatttgccagtacatttgggaatgaactgtaaaccctctcctgaggttttcacagctcatgtggaagctgcctaccctctgatgctgctcttctggcataggctggtacaggcctttgtccttttaacttcccatgactttactcaggtcatttctcttctactcccctataatctcctcacatcattattattgttttttgtttgtttctttttaaatttattttttgaggactcagctttggtaaagtataatttacataaataaaatccacaaattttaagtgtacaatgcgatagttttgacagttgcattcatttttgtagccactgccacaatcattacaaaggacatctccctcacccccaaaagttctctggtacaaccctgtgttgtcactctcctcactccagtccctcactcctagcaattactgattggcttccattattatagctttgcatatggtattttaaaattgctttcatttttaattgacataataattgtatatatttatgggatgctgagtgatattttgatacacatgtacaatgtttaatgattacatcagggtaattagcaaacccatcacctcaaacatttatcatttctttttgttggaaacgttcaaagtcctcttttccagctttttaaatatatacaataaattgttgttaattatagtcatcctagtgctatgaaacactggtacttactcctcctatctatgtacttattaaacagcttttgggcaactacccatctctttcctcaccttgagtaatcactatttcactctacttttatgagatcaacttttttagctcccacatatgggtaaaaatatacagtatttgtctttctgtgcctggcttattttacttaacactatgtcctcgagtgtcatccatatcagctcaaataataggattttattctttttttaagattaactagtatataaatgtttatatatttcacatttctctttttaaaatcttttctttttaattttttgtgggtacatagtaggtgtgtacatttgtggggcacatgaaacattttgacacaggcctgtaatgtgtaatgatcacatcagggtaaaaaggccatccatcaccttaaacatttatccttcatgtcacaaacaatccaattatactgttttagttatttataaatgtaaaactaaattattattgactatagtcaccttgttgtgacatgaaatactaggtcttattcattcttctaactattttttggatctatcaaccatccctaatccccaccccccagctcctgagccccccactacccttcccagactctgataccatccttctactctatacctccatgagttcagttgttttaatttttagcttccacaaataagtgagaacatgtaaagtttgtctttctgtgcctagcttatttcacttaacataatgatctccaattacattcatgtttttgcaaatgacaggatttcattcttttttatggctcagtagcactccattgtgcatatatgccacattttcttcactcatttatctgctgatggatactcagattgcttccaaacctttgctatcatgaacagtgctggaataaacatgggagtgcagatatctcttcaatatactgatttcctttcttttgggtatatggtgagcagtgagattgctggattgtctggtagctcaatttttagttttttgaggaacctccattctgttctctgtggtggttgtactaattttcattcccaccaacagtgtacaagagttcccttttctctacattctcaccagcatttattagtacctgtcttttcgataaaggacattttaactggggtgagatgacatgtcacttaagttttgatttgcatttctttgattatcaatgatgtcgagcatgttttcatatacctgtttgccatttgtgtttctcttttttgttgttgttgttccaatttaatttagctctgctctgatctttgttatttcttttcttctgctgggtttgggtttgatttgttcttgtttctctagttacttgaggtgtggcgtcagattgtctatttgtgctctctcagacttttcaatgtaggcatgtaatgctatgaactttcctcttagcactgcttttgttgtgtcctggaggtttaataggttgtgttgctgttatcattcaattccaataactttttaaattttcattttgatttcattgttgacccaaagatcattcaagagcagattatttaatttgcatgtatttgtatagtttcgaaggttccattcggagtgaatttccagttttattccacagtggtctgagagggtacttgatataattttgacttttgcagaaatttattgagactcatactgtgacctatcatattatctatgttggaaaatattctatgtgctgatgaaaggaatgtataatctgcaattgttgggtagaatgttctgtaaatatttgttaagtccatttgttttaagatatagcttaagttcattgtttttttgttgactttctgttttcatgacctatctaatgctgtcagtggagtattgaagtcctccactattattgtggtgccctctatctcatttcttaggtctagtagcaattgctttgtaaatttggaagctgtggtgttagatgtatatatgtatttaggattgtgccatttttctgttggactactccctttatcattatataatgtccttctttctctttgttgctttaaggtatctttcatgtgatataaaaatagctactcgtgcttgcttttggtttccatttatgtgtaatatcttattccaaccctttaccttaagtttgtatgagttcttgtgtgttaagtgagtctcttgaagacagcagatacttggttgatggatttttatccattctgccattctgtatattttaagtgaagcatttggaccacttacatttaatgtttgttttgagatgtcggttattgttctgttaatcatgttacttgttgcctaaataccttatattttgttattgttttacaagccatgtgagatttattctttaaggagatcctattttggtatatttcaaggttttgtttcaagatttagaactcattttagcatttttttagttttggcttggtagtgatgaattccctcagcatttgtttgtctgaaaaagactttatctcatcttcatttatgaagttcagttttgctgaatataattcttggctgacaattattttctttcaggaggctaaagataggaccccaatcccttctggcttataagctacctgctgagaaatcagctgataatctaataggatttttttttttttttttttttttttttttttttgtaggttacctgatgcttttgtctcacagctcttaagattctttcctttgtctggacttttgataacctgatttctaagtgcctaggtgataatctttttgccatgactttcccaggagttctttgagcttcttgtatttgcatgtctagatctctaggaaggccagggaagttttcctcaattattccctcaaatatgttttccaaacatttagctttctcttcttcctcagggacaccaattattcttaggtttggccacttaacataatctcaagtttcttggaggtgttgttcattttttaaaattcttttctctttatctttgtttgattgggttaatttgaaagccttgtcttcacgctctgaaattctttcttctacttgttctagtctattgttgaaattttccactgcattttgtatttccctaactgtgttgttcatttacagaagttgtggttgtctttttctttatactatctatttatctgaaaaatttttcatccatattgtgtattgttgttttaatttctttaagttggttttcacctttctctggtatctccttgaattgcttactaatcaataaccttctgaattatttatctggcaattcagagatttattcttcatttggatccattgctaggaagctagtgtgatattttgggggttgttatagaaccccattttgtcatattaccagaattacttttctggctccttctcatttgggtagactatttcttaaaattattttttaatttattttttattggattgatttttcttttaatttaatttttttatccctcttaaggatcagactttgatgtttattttagcctaatttgattcttggggcttctaggggtgaacactctgtatgagatccttagttatagagagtctttatgtgctggctttccctcatgcttggtttagtggttatattcttgatgtgtggtcactgtctcctgtggaattggaatgacagtaatctcttgaagtttatctcgttctctcagagtgtacactttatttatttacttaattttttcctgatgttttatttactgagttaatgatttaggcttcaggctaataggggagttattcctgagtaggcactggttgtggctaaggcaggtgggtagatgtaatacccaatggtgggctaaggtagcctccttgatgaaggaggctagtggagctctcatttagatgtgctgaggttttatcagggagaagagtgggagctacttcagctcccctgccatgtcagcaagaaagctattcaccttacagcctcactcttgtcctagtgtttcagccattcagatcagacaggcacttcttttcatggacagaaatgttgatgttttgagtggggagggattgtgactctgctgtttttccaggcatggatctggagtgtgctcctcctgtggggctatactcaccctggatttttccagaaaggctgtctatagaggcctccatgctgcgttcttctgggagaagccccaattgtgtctgcagtacagtgccaggggagaacaaggtccccttctccaagacccctcacaatcacagaggctgcctgcctgttggggtaccggtgcagacgttccctactatacccagcactgtgattgtgtttctgctgtgagaaacgacccaccagcagaaaggtctggaacccaagggctgttgtccagattcttttgtcccacggggtgatcccttcatatggttccctccctcttcccatagagttggcatttcctaagagccagactgcaggattattgctcttctggatctagccacgcattggggctactaggctctgggctggtgctggggaatgcctgcaaagagtcctgtgatgggacccatttcaagtctccaagccatggatacaggcacctgctctgctagaggttgcaggggagtgatgtagactctgaaaatcatcagtgagaatccttggttgtagatatgttcactgtgctgactttctcaaatcctgtttatactagcagtgaagttgtcatgtgaacagatttgggacctctgattagccaggatgttgcaggcagtgggattagctgttgttttcaccttcctgggagcagagttattctgtcatgaattgctgtaatggcctgaattggtaggcctccataaaggaggtggtcctttcaacagagcaccagctgtggtagtagtaatgggatacaagcttgccttacattggccagggggaggtattctggtttctcaggtaatgggtgaggccagaaagctcccaagagtttaagtcttttgtgtttggcaaccagagtggatagagaaatatcaggtaggggcaggattatgtgggtctgagctcagactgtccttgggcagggcttgctgaggccactgtaggggtttagggagtggttctcagttttctggggtaatgttccagaggggagtatggctgcctctgctgtgcagtatagtttgccagggaagttgggggtagcaggtagtgaaaggcctcacccagctcccacacagttggcaagcctggtcttgctccctcagtatcctattaacagctccgagtttagatctgggcagcctgcacataaaactcagaacagccccaggccataagcttcaatgctgagaaagcaagtggggcttttaggccacatctctcccaatttgtccacaataccaacttctgcactcaaatctgcaacagttcccttttacccctggattctgctcaggcaggttcatgcccaatcaatattactacaaaatttagtttgaagctgctttcaccctgtgacccctacttaattgtgctggctgcctttcctgagggcccctgtgagatatagtcagggatggcttccctgggtgcaagctggagaatgggagtgcctataaggctcttcctgctgctacttctacatttatgttttgtgtgactccctaaatcctttccagctctaggtaagtttaaatccttctccagtgatctggattttcagattccccagtgggatatgttaggaggcagatttttcccctctcacactttgggaactcacagtttttcgcctgtctcatagaatttgtagcagcatgccgcttctttcagaatatctgtgaattctctgttttcccggtacactcctgcaatggtttttggaacaaaagttcatggtctgagtctccacacaatcttctttcattccaggtgggaaatgcacattagtcctgcctcctatccaacatcttcctcctgtctcctgtatgtcctcttttgaaaaatgtctgtttggagcttttgtccattttaaagaatcatgttagatttttttccatagagtgatttgatctccttatagatgaatggattaaaaaaaagacccaataatctgttgcctatgagaaacacacttcacctataaagttacaaacagactgacaataaaggaatggaaaaagatatttcatgctaaaagaaaccaaaaaagagcaagaataacaatacttatatgagacaaaatatatttcaggacaaaaactatcagaaaagacaaagaagtgcattatataatgaaaaagtggtcaactcagcaagaggatataacaattttaaatacttatccacccaacactggagcacccagatatatgaagcaaatattactagtgctaaggagagagatagactctgatacaaaaataatagagacttcaacaccccactttcagcattggacagatcttccaggaagaaaatcaacaacaacaaaaatcggacttcaccttcattataggccaagtggacctaatagatatttacagaacatttcatccaacaactgcagaatacacattcttttcctcagcacatggatcattctcagtgataaatcatatgtgaggtcacaaaacaagtcttcaacattcaaacattgaaataatattaagcatcttttctgatcataatgtaataaaactagaaatcaataataggaattttggaaactatgcaaacacatagaaattaaataatatgctcttgaacaaccagtgaatcaatgaataaattaagaataaaattgaaaagtttcttgaaaccaatgaaaatggaaatacaacataccaaaacttatgggatacaataaaagcagtactaagatggaagtttatagctctaagtgcctaaatcagaaaagaagaaagaccaaataagcaacctaacaatgcatcttaaagaactagaaaggcaaaagcaaaccaaacccaaaattagtagaagaaataataaagattacagcagaaataaataaaattgaaatgaagaaaataatacaaaagatcaaagaaacaaaaggttgctttttttttttgaaaagttaaacaaaattgaaaaagctttagcaagactaagaaaaaaagagagaaaatccaaatacataaaatcagaggtgataaaggagacatgacaattgatactgtagaaattcaaaggatcattagtggctactatgaacaactatatgctaatcaactggagaatctagtagaaattgaaaaattcccaaatacatacacctaccgagattagaccatgaagaaatacaaaacctgaacagatcaataacaagtgacaagatcaaagccataataagaagcctcacagcaaagaaaagcccaggacacaatagcttcactgcagcattctatcaaacatttacagaactaataccaatcctactgaaactattctgaaaaataagggtggaggaaatacttccaaactcattccacaaggcctgtattaccctgatacttacaccaaagacacatcaaaaaaagaaaactataggccaacaccctgataaatattgatgcaaaagtcctcaacaaaatactagcaacctgaattcaacaacacattgaaaaagatcattcatcatgaccatgtggaatttatcccggggatgcaaggatggttcaacatacacaaatcaatcaatgtgatacatatcaacagaatgaaggacaaaaaccatataataatttcaattgatgctaaaaaaattgataaaattcggcatcccttcatgataaaaactctcaaacagctgggtgtagaaggaacataagccatatatgacagaactgcagctagtgtcatatcgaatggagaaaaactgaaagccttttatctaagatctggaacatgacaaggctgccctctttcaccactgttacttaacatgttattggaagtcctagctagagcaatcagaaaagaggaataataaaggacatccgaatttgaaagaaagaaatgaaattatccttgtttgcacatgatacaatcttatatttggaaaagtctaaagaagtgaaagatatctacaatgaaaactataagacattgacgaaagaaattgaagaggacacaaaaaatggaaagatattccatgtccattgtttggaagaatcaatattattaaaatgtccatattatccaaagcaatctacagattcaaagcaaaccatatcaaaataccaaggtcattcttcatggaaatagaaaacacaatcctaaattttatatggaaccataaagactcagaatagccaaagctatcctaagcaaaatgtacaaacctggaggaataacattacctgacttcaaattctactacagagctatagcaaccaaaagagtttgtttctagcataaaaacatattatgttccaatgaaacataatagagaacacagaaacaaatccatatatctacagtaaactcgttttcaacaaaggggccaaaaactttgaggaaaagataatctgttcaataaatggtcctagaaaaactgggtatcaatatgccaaagaatgaaactagattcctatgctttccataggcaaaactcaaatccaaatgaattaaatatttaaatctaagacctcaaagtatgaaactactaaaagaaaatactgaagaaactcccaggacattggagtgggcaaggctttcttgagtaataccccacaagcacaggcaaccaaagcaaaaatggatgaatgggatcacatcaagttaaaaagcttctgaacaagcaaggaaacaatcaataaggtgaagagacaacctacagactgggagaaaatatttgcaaggtacctatctgacaagagatttttattatttgctcagacaattgttgccatgcaaatatagtactatttatcccatttctccgctgccatttctgatagcatttcaagtcacatcctcatagtaattgacaatcttagtttatgaactagagccttcctccacactgactttttcaacatcttgcatttcatcaatattcttgatcttctcattttcagtaaataatactaatacatcagttaagttcttgcatgaccacatcctgtcttttccaaaaactataccagtggcaatgacaaatgtggccagttcactttctgactccacatatccatgcaactgcttcagtatcatcattccaccagttctttgtcttctttaatctctggtgcctggtatgcctctgcattttcctagcattcatctctgctgtcatacctttcatcactattcacccttagatctcatgattctgtcctgcaatgtcttgtctgattactttctgtgtccctgtttggggaaaaaaaaaaccctccattccttggtgaatgtaagtcataggtctgactcctctcatgtctagtcacaggctgctaagcactcctgcaaaattcagacaacctgacattattataaattcataacctgaaatctcaattagatttattagcaatgtctaacaattctctgagccaccccatttccctgtttttcacaattccattctaaatcttctctgaacacttcaaactattgactctatttttctttcactgactttagctagctttactgtacagagaataaataaacgtttacatataaagtcatttaaatttcttctaccaaatgcaagaatccatcttcttttcaatactcctttcctcccaacatccttcttttccagtaccattgaagaggtgtctcttatcttatgtaatgataatttatcttgcttagctctgagtggcttgcaccaatatatatccagaaatgaaaagagcagttaaatttggtcaactgtcctccttcctgaccaaataaccatgccttctgatatagtgtgtttagtgtattgaaaatatatatatatatatttgtcaaataattgttgactgttgttattggcaaatataaaataatgcttccaaaatacataacttttttttttacctataatcacaattgttttctccataactgctatgcaattatcaagtataaaaaagtaaaaacctttcacatgttgggtatcttttcgtaagtcaaacaaaaagaactaaaatatcaaactgagtttccctaactttgaatgatgtttaaacttcttataagagtaaaatgattgattaattacttttcttatttcaactctttcatgctttactcttcaggtgacttattcaatacatttcttttctttaactacaacttagctatagatttttaaattcatctctagaaatcaatgtatttttggcaggtagaaccatactaatacatgtgcttgatataaatgatgctgagtctcacatgcaacaaaaatatatttttaaatatagctttggtcattctttatattcgagtaagttgtatagtcctaccctatctcctttggagaaacatgtaaatacatggagttgttaatattataatacaaatacatttatggcagtgtttgctcaaaactctcagtgccttgtaattacttaaaagtataataatcaaatcccctataatgatggttataattccaaagcattttttgttctaagacactattttagacttttactggtctattcattcatttaaaaaatatataattaatctactggtctaaatttggccctgaaaatgcctatcatatttccactattctaaacacccattctcattctgcttaggttttagggtgtagagtaaatgccaatgtatgcatgaattcttctttattccattagatatttaattttgttctcttcttcctctatgcttccattgaactttgttgtagtttattacagcactgagaatatccttttgtttctactataattatttacatatatacatatcaaatgtacattttccttgaaggcaagagtcatgcttcattcatctttcttatgctttgtttaatatatatatacataatatattcccattggatgaaaatattattactgtttaaaaggcttgcctctaggcttaatttaattagcattttttctattatatttaagtgattctctatataatactaatagttgacagaactagaaggaagactatatgatggaagatctgatacattttgcctatttaaggagatattgtcaattaaagaggaattagttatgtaaaccttctctcaattcccaatatatgacaaaaggaaacttcttggtttatgtagattttaatcaaatttggagtaattagtacccattaattttgtatcatatcatttaggatacatttttgccatagaactgtatagtgaactatgattattatttgagagtatccagaagtaggctgtagtacaaaataaatagagtggaacaaccagtatagatttttgtgatgaaaaacacagaagtgctattgtcttccttacttcattttcttcctttcttccctcccaccctcccttctttcgcttattccctgctttcttccttcctccctgtctaaattaagagatttttagcgttgttggagtttcttcccttcctcttagtaccctttagattgctaataagaaaagtctaagaacaaaatattacccatccaagataaatctttccaataaatgtgattcataaacctgggatgggaacaaaggcatttaataaggtgaccctcaatgcttcacagcttaatttttattagcacatcagacactaatagactctcatttaggtaggtcaaggggtttttacagataatgtctgtaaaggaaataatgtttccaaataaggggctcctaaagaatatcttattttcctcaatcataaaatgctttccagtaacattcccagttgaattggatgtcaagtatttagagtgaaaatttctttgcatttcttttcattaaaatggactgtcataaaacaacaagtacggcacctcgcataaaatcaggtcatgttttatgaatatttaacttcctttgaacttttcagaaggaaacagtgaccttgaaaacttctagtagcagtacaacattgtaacacaaaggccactgcctctgtcattaatcatggtagatgactgcctagagctggtgttggcttttcaaagagaaataataaaagatagaaaaatgtgaaaatatttattatacactattttatcatttaaaaaaaagggaatagttgagacccaactagcacatgaaggtttttttgaaacttatttttaacatggagtttgaaatttttggttttcagttactgtcagcttgaaatcaatatactagtcaagcaataagaatttaataactgctaaatattggttcagtatattacctttttattgggctttggaactttgatttatgcagaatcacgacagtactaaccctaaataagcaggcctttggtgtgtgtgtgtgtgtatgtttgtgtgtgtgtgtgtttaactgtttatgaaggtttcagaaaggcattcaaaattctcaggagaaaaccagtaaaataaacaaatatttatccacatgttaattcaagtcttatttctagaacagaatattgacttggagctatcatctaagccaagataaaaattttcagagtcaaacagaatgagtgagaacatcattatatttaaatttaaataatattaaaaaggaaaacagacaatttgatcccttggtctttagtaaaagcaatattcaaaattataatgctttttctagatttttaaaaaataaagtatacacgaatcatgtaatttgctcactcatataatattataccaaaattacctcctatgaacaatattgcatttgtttcaattaaaccctcaggattataaatgtaggtatttcatatttttatgctattctagttttatatcttcaaaataacaaatagccaataaaatttccatggaaaatgttaactcttttttccccagcctcttactttgatgtcatcaataatgtctagatcatctattgacagatattaagcacagcacagtggaaagataacaaattttgtaatcagaaagatgtaggttcaaattatctgtatctgcactatacaatacatagccagtagccacatgcgctccttgaacagttgaaatgtatttagttcaactgagggattgaatttttaattaagtaaatttaaattttaaaattcaaaacatatatagtatttcattattttgaaaggactaagtttcattttaactatttacattacataagtattcatgctgcattgtaatacacattaggctcatgtttcatttctatggttttgtatatatacacataactgatctattggggcgagtggattgactcagtttgaatgacttttacatgtactatgtaacactgcaatgtgttgatttgaacattttatgcagaaggcacagttactgttacctatataaaacataattggtaaatacaggcattctttgttttattgtgcttcactttattattttatcttattttatttatttattttttgagaaagggtctcactctgtcacctttcacccaggctggagtgcagtggcatgatcacagctcactgcagcctccacctcctggggctcaagtgatctttccacctcagactctcgagtatgtgggactacaggtgcatgccaccatgcccagccagccaattgttttatttttgtagaaacagagtttcaccatgttgcccaggctggtctcaaactctgagcttcaagcaatcctcccacttcaacctcccaaattatttctgtgattatagtgcaaagccactaagcctggcctgcgctttactttcttgcactttacagatattgtggttgttacaaattgaaggtttgctgcaaccctgtgtggagcaagtctatcagcataattattccaacagcatgtgcccacttcatgtttctgagtcacattttgataatcctcacagtatttcaaatgttgtcatcattattatatctcttatggtgatctgtgatcagtgatctttgatattactattataattgttttggggtaccacaaactgtgcccttgtaagatggtggatttaatcaatatatgctgtgtgtgttctgactgatccactcactggccattccctgtctctctctctctcttcaggcctccctattccttgagaccaacgatactgaaattagtccaactaagaaccctctaatggcctgtagtgaaaagaaaaatcacatgtctctcactttaaatcaaaagctagaaatgattaagcttagttgaggaaggcatgttgcaagccaagatgggccaaaagctaggtcttctgtgccaaacagctcgacaaatagtgaatgcaaaggaaaagttattgaaagaaattaaaagtgctactccagtgagtgcatgaatactagaaaagcaaatctttattgctaatatgaagaaagttttaatggtctagatggaagatccaggatccaagatagaacaggtgaggaagctgcaggacaaaagtatggaggtagcagagattggttcattaaatttaaggaataagccatctccctaacagaaaagtgcaaagtatagcgggaagggctgatgtagaagctatagcagattacccagaagatctagctagaataattgatgaaggtggctacacactaaacagcagattctcaatgaagatgcaagattgtattggaagaagtggccatctaggattttcacagctagcaaggagaatttcatagctagcaagaatttactactgatatattatatagtgatgatatagaaactaccaaaataataaagatgaaaagagattgggagtagttacatcacaaaattcatgatgaattgcaatttattgtggtagtgcgaaatgaaaaaaaaagtataaaaacttcaaaaaaatataaagttgacagtattaggaaacatcttcagcaaatatggaatgaattttataagaagttacctttgagaaaagaattgataaaattgattgtctggaatctgaattaaatgctaataaaaacatttaaacaattttatacaaattctgagtttataaatttggccaaatgtaagataggttggattcctacacaaaagaaatttagttttagattgagatagtaagataaattattactcctgatatggaaattttgttatgaaattgctaaaaataaaagacaatgattttaattatctgtgttcttttttaacggtcattggttgattttcacaaatttttactgtactcaacttcaattcatgattttctttaaacaaaaggaatgtttgccaaacatgtaattatcaaagacaaaaaaatgcagtgtgtttatatttttcactgataccacactgcatatgaatgaacaaaatctgaagttctatggaaaaagaaagctcattagtacttagaaatgtaaaagtattttaaagctgacatttcaaaataaaaataataattttacacatttttctaacatgaatcaatatgtagattctactctttgatgttatataaatcagattcaaagtctaaaagaaaatgtctaagaaatgtctttttctaatatttgaacatttagagttgctttttaatttatacagtgatattttaaactagatattaattggcacaatggctagtgaagaaaagatgaatttgttctgtcaatatatatgcaaagatgggaagaaatggtcttttttcaattattgaaaatctttttgaccatatttggaacaatctatataagggaatctattttttgaactgtaaacttcattaaatgtcaatacagatgaagcaattcttatgaaactaagtgtaaaatacctacaaatttcaaagacttagtatgaaaatattgtgtgaaatatttcattaataatttttatgtgattacatgttaaaacgttaatttttataatatactaggttaaatgaaatatacaattaatattgatttaacctcaaatggctacataaaaatttgattacatatgtggctgacactatcgaatactgatctatatggtcttgtacaagctacaaattccctcacaatttcattttctatactttaaaagtagaatcactccagatagtgtgtgattagggtaaccctgaagtggtcttaggccaattgtttctggaaagtatttcctcatttctctaaatggaactaaatagtacatcactgttcaaaaagtgtttggtttttacttctgtaatagaaatatcatgcttatcacaagcattcatccctagtggctgtgactccaaaggaaaacaaaagaacatgtaagagaaaaagaaaacaggaaaagaaaaatattcaaacaattataagtgatttactgactagttctatgaactctagcatggtggctgggacacagtaggtgttttatgatttttatagaattaatatttgtgtgatgctctagaagaccaagccctataggtaacagtgcaataatggttagctaatttacattggtaaatttaaatatggaaaaagtgagtgctaataacccttattaggtatatatgtgtatgctatgtttatgtgtgtatgtcgaactcagttcacttttgctacagcaatcctgtaatacaggtattaatattcacattttactcaaaataaaactcttacagataaaactttccaaggtcactaagcaaatatgagaaacaatgtagattttaactaaatgttactaattaccattccaccacattgccataaaaaccaaattatttgagccatgttacatatttaggtaaattttataaaatgcaaatatttcacctatctaatctaatcgagaaaaaccacaatagctctggtttacaaaataaatatgatacctattttcttaaaggtaatgttattcttatgaatcctgcggcatgtcaagcaaccggggtagcatgaggtacctagtatccttcttggctggggtcaaaggaatatagtaaaagagtttcaaatatggggtaggccgggcacagtggctcactcctgtaatcccagcactttgggaggctgaggcaggtggatcacctgaggtcaggagtttgagaccagactgaccaacatggcaaaacccgtctctaccaaaaatacaaaaattagccaggtgtggtggtgcacatctgtaatcccagctactcaggaggctgaggcaggagaatcacttgatcccaagaggcagaggttgcagtaagccaagatcgcaccactgtactctagcctgggccacacagctagactctgtctccaaaagaataaaatatgggggacatattttatatattttattttatatattatatatgtatgtatatatgcatattaccgtatttcacacacatacatacacatatataaacataaactttaatgtgtttttataattttttataattttacagcatctggaaatagtttactatagcattatgtaaaataaactcgcagtcttaaaatttcctattgatgacaaacagaggatcactttataaaggagtgtttctgagaagacctacccaagcagtctgaaatgtatgccctcttcctaccccattctgtctccaagctggatgaagaaaaatgcaggaatcatctcaaagattatcatagaaatgccctattgtcttccaagactctgattctttttatgatcccagccatgtatcatgatgacagccgtttctcggccttatgactaagatcaagtgtgtcaccatgacaacttggagaatttcacctgggggagaggatccacaggtagttccctgtaccttataatatctgaaaaatgccaaacaaaaattaagtatgtttactccaactccaccaaattccaatatggtccctgtgcaaatttccataactttaaaaaatggtaatagggaagaatagaaaacaaactccaatggggtacaagatagaaaaaggttttagaataaacttacaagacgtgctccttaaaaaatttattgtcaatagtgctacgcaaatgtataattgtatatatgtgattttaagaatgtgctgcttaaaattaataaaggcctttgtcattgctttgtggctagaaagatgaaatctaaaacactgagttagtctgaggttatctttattgagtggcaaggaagtattaaagaaacattatttctgtaagaatgactgtcatcctttagtacgttgtacctattgcactatctctgccattcgataggcagccaagttctctggctttcaagtcctcagcctcagtgtgaagatgaatctcatttccttgaaatactgctcctgctgtatttcaaggaaatgagattctgttcaagcaagttgaaatcttaattccagttcttttcagagtaataatttatatataaagtaccacagatggatgtttatattagatataataacttgaagacttattttacctgaaaacggaattagagcttcttaatgccaaaatacagaactaaatcatttaaggttatagccccatctttcagtgctggagaagcaccatcttttaccaaaagagcatttaagtcagcattacttctttctcaactgatatcacccataaaaagttttcactgtcacaaaaaccagtaaaggagtaaaatatttggcaactattgggcaagtataagataccttatttttactaatgaactaatgtgaatgaatatgaaagaaagctcatggtattctgtttcatacaatcttatccattacatttgcttaagcaaaaacaacttgaagaaaagtcaatttggtcactaaactttgggagtaaaacacaagcttctcatttataatttgaaagagattaataggtgtcataattatcaaggtgtcgttaagacctatgacactctgaatattgctcatattaaattaagaatcattaaatgttgtgtcagagacttggagggaaaataaaagtaaaaggaacaattacattttattaaataatgctaaagaattatcttaaaattaatatgtaagctctgaagagaatgttatcattgactataatatgggctgatggttgaatatcagtagatatttaattcttatctatgtttctgcacacaaaatttgtctgtataaacacaccccaaaacaaaattttctaactcattcatattgttaaaacctgccttaggtgctctgtggacataaataagaagcagccttttaatgcttgcatgtatcagattattgacatagctattacggctttatcctcaaaccacaactttcagaaatgttgcattagaatgtttttttccaaaaaatagaaatagattaaatttttaccagcataatattaatggtgaagagaaaaaataatgtctcttgcagaaaggtttaaaatttttagtatgatctttaaccatttaatcactgccattttctttagatatcttatttccatttaattttctctttataatctgattggagagatgaaaaattagacatatactgtattcttatagtacatgaaaattgtgaataacccgaagagcttatatatactgaataaatgttaactcttgaacctcctgtaaagtgactacctaggtatgacaagttaacatttctctagtaaaaaagttgcttcagtccccctattactgtcttttaatggcttatcttgtctcttttggaactaaagctgttccaaacaactttattacacacacacggagagagagagagagagagagagatcagacaactctgatttttgagagaaaactatcattgtctagaagtaacattcactatatgtaacctataaaagcacatttgtcaaatgcttgtgttccataacaagaatatattctataaatataaatatcgtagtatttttttctatagtgtagaagggacacttggctatcaggccattttttaaaataaatatctaagaaaacatacttcagagtttctgtggcttatgtagtgtatttctacactaaaaaattagaatgtctggggtttcaaattagatgaaatcacctgccttataaattatgaagatccacagagccattgcttcccaggaaaactggccctcagttatcacagagtttggaaaagtatggcttgtcactagtttttctatggtccatgaactaagaattatttttatattttaaaatagttgaaaaaaaatccaatcatgatatgagaaaactatagaaatcatcaattgtccatgaataaatttggattgaacacagccacagataatcactggcatgtttactatgactgctttcttgctacagtggcagagttgtgtagttgtgacagagattgtataatcctgccctttacacaaaatatctagaccctttagatagaccaaaagaaagttttgcaaagagtacaaaactattagcctaatgagccatttggagacttctgaattatctgtgtatatcctaataacacttttattgcactactaattgctcagggctgccaactcaatgactaacttttaacatacatgattatcagttgaacaatcaaaaattgttttctcagcataaccttatactactgctaaaatcagtgtctagtgagttgtcggggcccaaacaagatgttttaccattctaacaaggcataattctttttaggatatttgctccaaaccatctaagttttattctatatgtaatgtaataagttaatacgacacgtaaaatgccacatccctgactaacctcccctgtgcctgagttctcaaagtgctctgtagcgccctctactgtctgggctgtgtaccaactcagacactttgaggagctggccatagctgggatttcctttttatatattttgtataggtcataggggcaggcaacccataatttaggaacagatctgggtatctattcttccttaaggggagcgtgcgtgcgtgtgtgtgtgtgtgtgtgtgtgtgtgtgtgtgtgtgtgtgtgtgtgtgtgtagtttgggaataaatagaaacatgcaatcttgaaacacaaatgagaatattcagcatatatactgtggttatgtatgaattttctttggcaagtcagactcagtggtgtgatgtgcacacttagtcatcttacatttgccaaagtaatatgagtacacaaactcatgaatttacaagcaagcaaaatgtttccaagtcactttcattttaagaaatgtatatatttgtgtacctgcattgaaacattaaattcagaatatcatgataattatgcaaaaaagagggtagttgtcttacacaatatgacacaaaatgacagaagttgtggattttaggatttggggtacattgccttaggtatcttttggtgcatcaacagtcaagaacatgctttctacactaaaggaaaaggaattttatgtcttcatgctgctaaatttaaagagttgcaaataaatttgtatagaagaattgatgcaaaatatatttattgcaatatgtacaattcctaaactcctgcactaattaaacatcttaatgttatggtgaaaatcatgttactgtcattactattatattactattcaagataacttgccattttcacagtaaaataatttttaagacttttagtgtgtctatggcatgtctatgcctgtccttttttagaacaagtatgcttattacctgatatttcaaaatagtataaagtaagtaaagtaaaaaggactgccttctttaaaatgactcaaaaatttaaaaaacatagaaaacatgtaaagttttcaagaataatagacaagtccataatatcactaagcatgaagaaaaatgtaggcaggacaaagtttcctgaggctaaaatatgaaagaaaccatcacaatttcctaataaatttggactcctcaagccagtaatatcagaataaaaattggcagtggatattatgcctaggaatattcctggcctattactaacacctagaataaaaaggctttagaatctattgattgttataatataactaagtaaaacaatacatttgtgtttaaaacatgcatttcatgtgacaataatttaaaatctttgagacctcctaaagccaggaaaaaggagaatatgacccaatgttaacactatcaaagcaaagtaatacagttgattgaaaatacagttgagcactcccagcagatgaaggtgtgaatttcctcatacatcatcttaatggcaacattttctacaaagcgacatggagcactcctttcatatttcatgagttctatttgcctgacttcaaaatgccaaatgtgccagtgaacagtgctttaatattcatgggtttttgagatggctttgacagttgtcaactagagaaatgacttcatcaggaaagaatctaacttatgatttctggcacacatataaaatcatgtagtcattcgcatatgcattctacttgaaatgtattatttgcatagttatcttttatgaaaattacaaagctataaaatcttttatgtaacagtaagacatttgtaaatcttatttggatatatacttagcatttcagaaaattttgttaaccccagacatttaataattgagttatttttacaaatgtcttttgaaaggacatagcccagtaagtatcccaaaagttctctaaagcataagtcatcacagcataaatcacacatgtatgtgaacaattcatatttatttccctttcataattcaaaagcttattaagtaattcagtttatagaaaaaaaatgcaggctatttctttaacccaaaggtttggattttgggtcttgagtctctcgattacctttcacacactaaaaataaaatgtaaaattacccatgaaatacagttcactgctgttaatcttaaaagttttaggaatttttcacacgatgtcagtaactaataatacattgaataaattatataaatcacacaaagtcataagaatttttagtgtatattatctcattgtattctcccaaaaatcttatgagctggaagaaccaatagcataataccattagattgagagtaatatctaacagttattcgatactcactgttcgtacatgccagtaactcttttaagcactttgtatgtattagttcaattaatttcagtatataattaaccacttttgtagatgagacagattaaataacttgtcccatatttcctcactagaacattgattaggagccaggcagtcatagtcgtatagcctgaactccaacaaaaaccctaaactgtcagatgttaaactacattgagaacccagttgacgtttctaccctagggttgtttccatttatttattacacaaaggttattcttattgactggtatatttaattcattgaatttagccttgaaataatatctcttttggggactattctgtcagcactgaaagttaccctagggataacatgaagttttgaaattaagtgtgatgtgtcatctcttttctttttattcatctttccttgttctttaagttacaagcattcaaagaggcaatagagatatgtgtggaatgatggctggagttccctacattagatgattatacatttcctattggctggcacttggctatggactatatgtatacataaatttaaaaagcctgaaatattaatttttagagcttgctaagataacgggcccagtgccccttactttctgctagtacatgccctgtcacttaacgtgtatcaatacaatagtttatcttctctgtgtttatacatgggttgtttaggataattaaaaaaatcaataaactgctgagactagaactctgagactggagctaacagtattcctgcagaatctccccactgcacagcaatcctcttacattttcctagtcagctcttcctctcattctccatagcatctatttgatctttcttaaaaatatctagtccttttctttcccaccactttgtgcagatggccatgcctactatttcacaggaaaactagatactgtgatgctatacctgctcacataaaaacactaaaaatgccctctacattcctctcttttccttgtccctcctattatgctatcaaagcttaacaattctgtctgtgccctgaatgctgcctcattccacttcctcaaagtcccaactcttgtagttatcttttttatcctctagactttcaaacctttgtatcatttaggatgggacagactatgctgaaataacaaacctcaaactatcttgaaatcatgagcaatattgctatatccacactattactgcccattcaattctcaaaattagtttgtttctgaaagtaaccaccaataacttaactttaaaaaaaaattctagagaccgggagcgttggctcatgcctgtaatcccagcactttgggaggctgaggcaggtggattacctaaggtcaggagtttgagaccagcctggccaacatggtgaaactctgtctctactaaaaaatacaaaaattagctgggagtggtggcacacgcctgtaatcccagctacttgggaggctgaggcaggagaattgtttgcacctgggcgataaggttgcagtgagccgagatcgtgccattgccctccagcgtggctaacagagtgagactctgtctcaaaaaaaaaaacaaaaaaatttagagataattttctcagtcctctcttactcatctattcagccttatttgcaaattctatgcatctcccttgaaacactctttctcttgttttttcctgatatacacacatatttttcctggcattttaattctagacttaactttttaatataatcctaaacatcggtatttgtgagagttttaagtatttttttcttctcttttaaatagattgtcttttcttcaacgcaaggccaatttgctaaagagagtttatatattctatcttccagtttaatatatacacattgtccttgctttgctcagttctgatatatgtaaatttcagtaactattgtttcgttaaataataccaaacccccaacaacaaaattcaaaattcaaattcaaaactgagagtaattatgtgaagtaaatctttgctgctagctctttagtccacaaattaatacattaaataatagatatgcatcacgatccgttaccagccccatcactgtcttcaaagtctgttggtggttggtcaccggtcatttgttattcaattcacaaacagtcagcaaagcctgcagttatgttgcttccttgtctcccagttatgaatccatgtgatatatttttaaatggataagtgaaagagagttggccaagaaagatgaaagagcaacaaggaaatagaaagtgataatgccggaagtgaaattcaaatagaacataaaatggattcatagaagaagtagctggccctgaaaacattggcattggcactgtccaagagaatctagatctttctctgctgagatattcttttttattattcactacaagcgtatttccctgatgccactgggcttggttataacagctgctttataatccttttcgcttcattttgacaccaggatatttcatgatcaggctccactaattgttctatctactgatcatgggtcatatttcttttgttcttcatttcaactaattttgcataatatcattgatattgtgaattttgtattgttgattctgttatattctcccaaggagtgttgacttttttgtttgtttaactggcaattaagtttgtttggtgtaaaccgcaaacttttgtatgtaacccaaaaaaaattttcaatgtggtatattttacattttcagacttcttgatatttgttcttcagcctagaaagtaaagaaaaatgacagaagctgagaagctttttaaagaggaagtcttaaaagtataatgagaaaaataacattctttgatgtccagcagacaaatggtgagggtagaaaactaggttatatatttgtgtattttgccagaagcattggctatattagcagctgtcaccatggggagattcccaccattatgtagcttctctagtaggggacagtcaggaatgagttatggagagaaagcaggaatctacaaaggacagttcataacagtgcagctgcaaaaattttccaagaggaacacatgagacctgagaagtaaaaacagcctctggagactcccagtcaaaagtgcagaagaaaaggggagtggggaatctgcctgagcagatgggcaaaatgtttaaactaaggttaagaagattaaccaatagcataaggttaacatgcaattgtcagtacctataaagggataaacctcaggacaactcattatattaaaatgacttgattgcctctaatgttaacatattttattccagtgtaatttcattaagatgaagttaatttatatgcttactttcgctgtgagaaagacaacttcagggcaaaaaaaaaatttactttgcatttaaatgataaaaatattgcaatccatataaatttgattaaacgaacaaacaaaaatgttagtcctatggaaaacatatgcttatgaaatagtaatttcatcaattatagtgtgcaacatactttgaaagaaacacaaaaacaaggtccctgggatgcctggttttctataacaatggcgcaatggaaatgagaataaaatggagactaaaaatagcatattaataatcattgcactttctggatcacgctatgaaagacattttgtgtatcaataaccaacaatttaaatacttacaaaataaattttagactggtattaaaggtatttatctggaaagatttttctcaactattctaatatttctgtttgttcttatttttttctcagttttactcttttgtaatatgcaaagaactttgtttttttatgccacttttatgctttttactttttgcttcctttttcctaagacttcatttttcatagcatatgttccttttttaaacatcatgtaacagagttaccctctttcagatgctccaaaataaatacttgtgagaaaaacaatttgcttactggttcaatttctaccatgccattaatgatgactaataattataaaaataataactgactattgatggtctaatatgttatttgaatacatcattttgattaattcttacgatgacgcttcaacatgaaaacagtatcttcaatttacagctgataaaattgatacttaaagaggctaactgatttttcaaggttaggtgacaaactggaagagccaggattccaactgcaattcccattgtttctttgcatgcattgctttcacactttgatcataattatttgttattatcttagaataattaaactattaatgtcatatatctattgatgacttgcaactgcacaatataattctgtacaagacaattataatacctacaatatcatttgtcttaattggttgagtgttattacatattatattgctgatacaacaataattttcattgtttatacaatcatttataaagaacttaactaaatagttcacaatggcattattaaaagttctgagggatgaaaggaaaattgaagcctaatgtctaattgtttttttattttagattgctaatcacagccatctcataattttacatgatgttgatgattgcatgagttgggaacattttctatttggtttattgatccctatgaatcagaactttgacactcacaatagcaaggaaagtggtttacttaaaatggcgttattctttgcatggagtttgctctttttcaaaggcagcattttaccttttctttgaaatcatcttattgctgagtgttttaacattcagtgggcaacaagctatcaattatattaagaaaaaattctacatgctgatctaatgcagtcattgagaatattttaaaacatatttaaaattagaaattttaagctgaatctgaaagactgttcattgtgaaccttagcataaataatttacagacatttgtaatccactgctagaggaattcaacagtacagacctgtgattatatcctaaatatcttagtccgtttaggcaaaatgacagagcatctgaaatgatttaaaggcttttttatgattaacaaaactataattgcctacattagaactatttcattaaataaacacattgattacttatggtatgcctggccctttgctacaggtgtactttgtataacttgatagtagcaaggagtaattataaagtgtcacaggtgtaagtgtggtggatgaaagacggccgcaaatacattagcactcttctcattgagatgtgaagtttttgtatcctctccttgactctggtctagcccgtgagtacttccacaaataaaatgcagtggaaaatgaggttatgccatttccaagtttagctttaaagaggactggcagttgacagattctttctcttggattactcaactccagttaagaaatataactattgtactgtaaaaagccaagactgacctcttggaaagccacttgaaaaggtcatgtgtagaaagcaaggggtattcagccaccttccagctgctccagtcctcagccattcaattaatagcactgataccctgaacattttaggtaaagacacattttctccagtatgccctattccaactcttaatcccaaaacaatgaagtataataataacaaattttgctttaagccctatgagttttggtaaactctgctactaattgaatttgtgatattggaaattttatttaaactatttacacctgcaattgtaagtaaataaaatgatagtgcctatcacattgttatgactaatgagatactgaccttgatgtttctaaactgtatatggcacataaaaataagcctttaactccataacttgtatttccagcctagacttctcttatgagacccagacataatcatatatccaattgctcattaagcaagtctacttaaacgttttatagcacttcaaacttgtatattcaaacttttcatattccctcacaagctgctcccttttctgtgttccctattttggcatatggcaccccgtctatttagtttcacaagcgaaatcctcagttatctttgatggtttctttttattatctggaaaaatctgctttttttaaaaaaaatatacaaaacaactcaaaaatgttttcacttcttctcccactgctgccaccttccttaactcatctctctctttctttctgtctttctctgactattctgatagccaactcatgtcactcagacttctgctcactgattacatcaacttttggcactgctccaagtttttaccttgttctatccgagcaatctttaacagtaaaaaaaaaaaaaaaaaaaaaaaaaaaggtaattattgtgatgcataaaactattcaatgaattcaatagaaaacaatttaaaatttgaaacacagtgttacagactctccaaaatctggcttttggcacctttccagactgataatgagtcaccgtctttgttggtcattacctttcagccacacaacactttggcctattttaaaaatatgtcccgccctttctcatcatcagggctttgcaaagcttgtttccttctgcgcacactctcactgagttaactagcaattattttggcttttgtacaatcatttcttcctcaggagaatgctctctgacaaactcggctttgattaaaatctctgaaatgtaatctctttatacagtatcttcttcataaagttcatataattcaaatggattccttttgtgtgtgtgtttttattattaccattcgtattatttaaggccatggcacagagagggttaaaagtggaaaccagcaattaaaggtagggaaaactgataagatatgatacaagcttcaatattggaagaggccagactttattaaaagatggtcacatttctcagcactgtgagctatggatcatatgcatttatttactcacatgtatacacacatgtgcgtgtgcatatatgaatacataatgatatataaccacagctatactttttcatcttttaaaggttttatttataggattagaatacgggttacaaatgttaaataaatagaacagttactagtttccacaaacatttgtttagtgtataaatattccaggaaaatttctggaaatacaggaaatagtattatctaacataaggcaaagtgttctctacctactctttgttgaagattttcaccaaatactagtaaagttttaaatgcaaagatatcttcaattttgaaaggtatggcctttcagccatgattacaagcaggcccttatttcattttctgttccatttaaatgttcgctttaaatgtcacaagtttatggcatgcatattaaatagagaaatataactattctctgtagacatgagagtaagctttaaagagatttgttagtctactttaaaccagaatcacaacctctgtattaggaaacagtgtaaggaaggaaaaagatgaagatgaaagttgagcttcccacttagctcttaggagtttggttaagatctctaggatcttaaccaaaacattcagattctccatgcacaaaattaagaggtaagaaaaggtcaattcttagtctcacccaattttaacattctaccatattttagttactcagtcgcctaaaattccttctgggcacttcctattaatacaaagtcactattgataaaatggtcatatattgactattgttatccattgaacattaaaataatattaggttggtgcaaaagtaattgtggttgttgccattacgaatgcccttataaatacatggcactttaaagagaaattgaaaaatgcgtactatcatttgtttatatttttggtgttatatttccagcatgtagtgagaagcattaagaaaacagaattctagcttaccccgagaatgtcaattttatcttcagatatatgcctttcacatagagaaaaatcaacagacttagggaaacaaaaatgaaagtaacatcaggccaccaaagttctataatgattatattgtactactattcaacaaattgtattctaatatatgcctgtaaatgctgagaagtgtcacaattgtataacactgggaaagagatgattttaattttgcttttttcattgtaattgatttattagactctctagagttattaatcctttgtaatagagtttaaacaattgtaacctcagacacttgcctttgaaattgtgataatttcaaataataaggcatacccagaaaactttgtttgcatgacttaaaatatctatttgagctacagaattacataagccttcttcttttctataaagtatcaagatctacaaaattatatttcaattactttttctatacaatatatttcagtgggtgcacatagatagttattggatgaaaaaaatgtaaaacccatgtcaagtatgccagcctgtgctgtgtatcaccaactgtaatttaaatgtggctattttattcttatataattttggcttttcattgttcatgatatatactaattagctgacattttaccttcatttaatatattctttttgatatcatacaaaaactttcagtgtttgattagaatatgcttgaaacaatgtttaatctgccatactttctttcatcttcactgtaatacagtagagcactgtgcgcctaagagacaagcttatataaggccagctttggctttgtacagtggagcaggtgggtctgaattctattctaatgcaaaaggagctccacaaaatttgtccatatttacgtggaaaaatataacctgttaattgcagtgtttgagaatttatatatttaaaaatcaatataaaatttccctaaagtcttctcagtttttgctaatttaatttaaaaacaatatcataaacattataagtcaggttctgacattttgagatttttttaaagggtcaaatgcctgatttaaaaataatttcatgttcaacatagtattaaatgctttccaaacactccatacatactttggtatttatagaaaaagggctattatgtgagatgcaaaactactgttcctttttaggcatgtgaactgatatttcatgttttctttaatagaaaatatctccatatttataggcagttcataaaccaagtgtaggtcatttggaaattcacattaaagtttaattattgcacactgtacaatagaactaaaaaaaaaaaagaaaaaagaaaaactaaacaaattcctcccatgtaactgagatatggtacactttgaccatcttgtcctcattcccctggtcacgcctctgtctctgtaatcactattgtactctctgcttctatgagtttgattgttttagattgtttagatgtaagtgagaacttgtgctgtctgtcttattgtgccagcttatctcatttagtataatgttctgcaataccatccatgtcttgcaaatagcataattttcttcttttttaaggcagaatactatttcatagtgtatatataccacatttttataatcatttcattcattgatggacatttgattccataattgattgagttgatttcaatcaattgaattgattgattgcataattgagttgattccacaacttggctgttgtggatgatgttgcaataaacatgggattgcagatatttctttgatatattgattttaaatcttttgggcacgtacccagaagtgagcttgttaaatcatatggtaattcaaattttagtttattattattatactttaagttctggggtacatgtgcacaacgtacaggtttgttacataggtatacatgtgtcatgttggtttgctgcacccatcaactcgtcattaacattaggtatttctgaggaaattccatatagtttcccgtgagatctgtactagtttacattttcactagttgtatacaagtgttcccttttcccagcatttcactgacccttgttatcttttgtcttttttataaaacccagtctgacaggtgtgagatgatctctcttcatggttttaatttacatttttcaaatgatcaaccatgttgagcattttaaaaatagatctgctggccatttggatatcttcttctgaggaatgtctattcaggccccttgtcatattaaaattgtgtttcttgtttctttgctgttgagttatgtgagtttcttatatatcttgtatgattaccccttatcaaatgtatggctaaaatattttctcccaatctttagattgtctctttactctgttaattattttctttgcagtgcagaagcttttcggtttgatgtaatttcctttgtctatttttgcttttattgcaaccccgaccatctactttgtgttatgtatttactttgtcaaacatgacatctaatcatgccattttttcagagacattgagacgtcaaggggatgaggttctatattctgagattttctttgagaaaactcccattcattcttatgaaataaaggagaaaatgattggttattgaaacaaactaacctgctgaaaatgaacgtctgttttcctttgaaacttgcgctcacttcctttaattgacccaattgctgccactttggcctccggacgctccccgcagctctgtattgattccctgggaaggttgcattgaggcagcggctctcaaacctaatttttccattcagttttactttctattagttgaaacagacaacaccatctcctcactaaagatatatgctacggaagtatacaaacaggttctggagcctagggcattcattaaaatagaaataccgtaaacatttattatatcagaaatgggagactgcacaccactgaccaaacaacagatgtgtcaaaatgatgcattagttgaattttgccgtgctttcctcttccttttccacctgagaacaaagcaatgtaccagttagaaaaagtaaaataaaataaaatcagcgactgagttgcagagtaaatgatatcaaaactctctgcagatttaataaaagtaaattactagaggtcattacttttcatgtttattgatttttgcagtcaatatcattattaactagtggagaaaaagatttatcatgaagttccaaaatacagagttaaaggaaggagaaagttcagttagttctctatttaaggaaacattatactcacgagctattatcaaaaaaacaaagaattgatagtcaatgttttttaaaaaaagttttctacagtcatgaaaaggtatagattgtgtaaaagaaggttgtgtttatttttaaaaattaatattattattgtgttaatataaaaattttaaatgaagcaagaatgagtaaaacattttttccacttgagtataccaatttatattttctagtattgctcttcagtttcctgaagccctctgacaacctaatagcagtgttactaataacatcgcaaactctttgtgtaaactccacaaagacaggaaccttgtttatctttctcttatcttcacagtgcctggcatatcatagaaactcaataaatattcttgaatgaaggaagaaccagcaagtttcaaagtaattttgaagggactaggtcatcaactgagtggaataacttgggtgaactgactactgcctcagaacaataacattttgctataatatcccattactatgctaatgtttcagtgcaaaagaagcacagaagaagagaccaaactccatgaacttaaaaaaagggatttatagatacagaatacccagaagccaaaacttacactttctgatatgtccagaactattttgggttaaatttttgatactattcctgcatctctgaagcaaaactcataagcacagctatttgaataaaatatctgctaatctaagccattttccctcagtcaccacagaaggctgtaatcatagatgctactatgagtcaatgattccttcaaatggtttagttatcaataaaaccatcaaatggaccatttcccatgaacttggatgaaaagtattatgtagattatattatgtgatgttaaaatattattttcatgaactaaaattcaccttaaatgtaactacttaaaatttgtacattttgaaataataaccaatctgttttaaaatttcccactgaaaagtttttcattttttattttattttattttattttattttgtcacactatgagaggcattcttgcagccccatgccaagcactaactgcatgcagagcacaatgctccaatttgcatcttccaaaaaaagacagctcaaccagacttaatgtattttggctggaaatttgtatgcttagtctctgcccaacatactttagtttgaaagagccaagctataaagcctagaatgatagtttataataggaagcttgatagagttgtttccactgatattttatcagctccagcagtaacgcaatttgtttcttagagagatgggagtgttccttgtggacagaaaaataatggtgggttttacaatgattattttggagaagtcatcttttctacctttctgcaaatgctatagtatctttaggttattttataatttgtgtataatcataaattatatatttctttgtgggtctagtttgatttgtaaaatactgagacttcatgaaataaaaatttttttttatagaaagcattcacaagaagtaaacttcagttaactttgttctccttattagaaactttccctgcatacacttgcatggagggagattagtgaacaaaaagaaacagtagagagcttttgcccatttcttatctttattaaactcctgcccacatgccattagattatcctttttaccttttataaaatagtaattgtcaattactttacacttccttttatatttatctcttttggatattcttacttaaattattaaatagaaaatgtagtttatcagtaacaagccatataatcatagaattgcacatagaagttgtgccagctacaatatcacgggtggaaagattgatttctattttacgtggcttctcaagaccacgtttattctcaaatgtagaaaatgtactcttgccaagtcaaggtaatgtaagtatttctaataaaaaatgcaggctcagcctggcgcagcggctcatgcctgtaatcccagcactttgggaggccaaggcaggtggatcacctgaggtcaggagtttgagaccaacttggccaacatggtggaaccccgtctctactaaaaatacaaaagttagcctggcatggtggcaggtgcctgtaatcccagctactcaggaggctgaggtaggagaattgcttgaacccaggaggcagaggttgcagtgagctgagatcgcaccattgcactacagccagggtgacaagagcaaaactctgtctaaaaagaaaaagaagaaggaaaaagaaaaaaaaaatgcaggctctgtggagtaaattctcagtcaaatataggtatttttcccacttttactctccttcattttctggctggcaggctggactttagtagtggtaactttggttttattccctcagaatcagtccctgagcctatgatgttatcaaactaaactggcgtaggctcaccgggccaaggtttgcagcaggagaaaggaaggcatttatttgcagggcaccaagaaaggagaatcaggcggttcaggctttagtcccaacttccccaatggcttgaagatgagggttttttaagagcaagtgtaaatttcaggaaggcagaagttacaggcaaaatcatagatcaatacatagaggttacacagtgtttggcctaaggtcatatttagatttaaagttcttctgatttgcagttggttaaaaaagagaagctttgtttaaaaatttggggtgggcagaaaagaactttagcttgtggctcctggatgtggcttcctccaggcccttcaggaaaaaatgtagaacaaagaacataagtggtcagagtttagtccttagcacccctttatctgaggtctatgtgccagtggacccatttggtgtggatccaggtttcagcaaaacaattcagggacgttagttatctttagtttctaacttccttgcctattattttgagctattatcaccttcttgcttatcaaattccttatatacttctccaggctagctaggtccctggaagaaactcaagatttttctttaattctatgtttgggtgggcctacaggccaagaggggtccctgctccctctcaatgattcaagtgagaataatttatctgggaaatgaacttaggaaatactgggaaagcaatgaggaaaaaagaaggaacgctagctaagaaagtatggttatcatcagggtcactaatgtgtataatgaatttattcttgctggggtattcttggaatttgtaacaaggcacctcataagtttcctcctgaaacctaagggtaggagtatttatgatgcactgtcatcaaccttggcaaaggcagagtgttagtgaagcaggagagttccctgacccccctacaggatgtgtgacaggggtgtggcttgtgtgttcagcaccatgcacttaaatcccttataggaaggggagcatggagacgggcaggtgcaggagctgaggtgagtgctttggggctccatccccatggtaacatgtaggggtgggtacctatgatttccaaagcccaagtgggcgtgtattacagtgcgttcttttagctttgctgtccacagatggcttaagtgttaaccagctcagtgccctcttgatacccaggtccttgtctggaatccaggaagaatcaggtcacacatggacttgaaggataaatgcagggattttattaagtggttgcattggctctcagtgggatggagggggagctggaatggggatggggtgggaaggtgatcttcccctgcagtttggccacccagtggctgatctcctctctgatcatccccagccagactcctttcagcattcagacgttccttttcttcttgccttctctaccacactgttctgccatttttcttctcttctgttcatctcctcataggttctgtagcatggggtctgaagtttatatgggcacaggataggggagcatggcgggccaaaaggcaacttttgggcatgaaaataggaatgcctgttcccacttagggccatgggtttccaggcttgcaggtagggcctctgccagggaaccaccctcttgtactcagtatttccctgtctcctgtccatatcattagttttctgacaccttgggaactgacaaagcaaataaaggctttgggccaaagggtgtatagagtcaacctttccagcattgacagggctctggggctaccctctctgcctccagcctctcccttatcagcactgtcatacagcttaatatggtgatcctgactcctctgcagccttctaggagatgaaatattgcctttaaacttttattttactaataggtcattttcactttacaagtgtattcacctatgactgctgagatattaaaaaacaaaaaactggactctgaaaaaagagtcctcacatataatttgagaagcactgccttagagggcttctagctctgttcttatatcccggtcatggaaatggaacattcacagttttatattatttcagtagagcctcaaggcagagaggatacaggacatgtaccacacttcccagggaagagctcgggtatattgtgagcttatttagagatgggcttgaacacgcccttgaagacctatgcacaccttcacatccttcatagtaaccacaagctccagatgggctgtttaccccaacccattcaccagccagatgagagccaagttcagagccggagctggccaccagaggaatccaagcattagtgcagaccacggagtgcatgagctggtttaccaggtaaccggtaaaaagcaaacggctgcagtgcagaccaagacaagatagggtggttcgtctcatggacgcttgttgttgaatcaggactttagggtcacgtagtctcaccatcatctctttcttttgtgatcacttttgcccagggtagacaaggttagctttgctatcactttgtatttggaattgattcaacctgacttcctacagagttttaagctttgatatttgaagtcaaacttttgatattcagaaaaccttttttctcatgaacttttcctatataactgtctctactagcataaacatacatacatattcacacacactctctcacacacacaattgtatttgccttaaaaaacaaaaaacaaaaaaactaagttatacttgccctttctcttcaaaacaatagttacatgaagttgtggttgctgcctgaatgtcaggggaaaaggaatgagcaccaggcagcacaatgaaagaaaccttactatgtaaaataatattcaagacttatgcagtgacatgtaaataggacaaaaataaaatacaaataaatacaactaaggctgattttaagataaatgaactcacgtctaattaccattttcattagatacctaaacatatttttacctggaataagaatcagaataccaaattttagtgatgagaattttgtaatttctgaatcatattttatgtgaaaagctttttgaggatttctttgtaaccagacatggtgtttttttaaaaaaaacacaataatacaggggatcaacagaccaagcaggtgctatccccagtcattatagtcaacttaataaatactctgcacacagacatccaaaacctatgagcattgatccaaaagaaaaatcattaaggtgaggatagaggtagccattctcctgaaagctgcttcctttagtgcctgtggtgttggcatgaatagctcaaagctgtctggaattaattcttttctaaagggactgctgaaaaagacaggaacatgtgttcttggcagagaaacaaagggttttaaagtacttcagtatttatcccactacaagcgaacttagtgcattatattaatatcacaattgtccctctacaattgggggagaagtttatagctgctgacaaaattttccatacacttcaatcagaaagaaacaaatgagctgtgtctatgtgtatggtgtgtatgtatgcatgcatgcacatattttgtgtgtctgtgtacctgagtgtaggtgaacatggaccttttttttacatgaatgggtcccctagcgaaggaggcaagacctttaaattttatcttttgaagttatgtaaatttttataacaaataaataatatatatccatgggccaaacaaaaactaaagtaatcacaaattatgagtttcaaaatcaaagcacaattgtatatacaaaacaaaatccaaaattaataagaatattctaaaatattttcatagttaagcaaaatgttattggttcatgttgagaaataaatgttggcttctagagtccaggaggctttctaaagttagaaatctttctttctaacgctacactttaacatatctagggatacttcatgagaaatctaatattcatacttaatttttctattaatattataattaatgtttgataatggtaactccaatatactgcaataactttagatattagaacaattcttatcacaaacatatttttataacagggttttcaatcaagggtcaaagaatcacaattcaaatagaaataatttaatgagcacattttatattttacatactttatttacatgaattaaacatgcaaagtgtcttagtttatttaggctgctataatgaaattgatggaatggcttataaacaacaattgatggaatggcttataaacacttgtcacagctctggaggctaggaagtctaagatcaaggcttccagcaggttcaatatccggtgaagtcccacttcctagttcatagaccagagattttctgattgtattttcacatgttggaaagggcctcttttataagggtattaatcttgttcacaagaactccaccctcatggtcaaaccacttctcaaaatcttcatccccaaatattataacattgagggttacgtttcaacataagaattttgagggaacataaacattcagtttaaagtacaaaagtaaccgtattcaatagtataaaggaaacctaaataatgattcttgtcaaactcatattgtccaactactgaacttcgaaacaaatgagaagtcgtgccttttcattaatgatcaagagaaagttgttagttctgtttcttgatccaaacttttgataacggagaatggattattacaacttaaagttgaagagtatatgtaacaaactttgactgtctcaatgtggcattcaaataggaaccaagagacagccaaaccttagtattcagcttttctccttatgggtccagagcattagaactaaatgcatggagacacacccaaatggaagacagaatctcactttattatttgctgaatgaggggcttataacttattgtatggggctctctggcaaaataaaaagaaaacaaataaaccaataagtagagaaaatttcccctgctttccttcttcttattctgagatggccagttctcagagcagcctcctttcgctttcagatgtaggcagaaagtaaaccacaaggaaagaatcaggctattttaaggtagagtgggcatttggttgtattaaaattgtgtaatattctggaactaaaaactctcctaatgcttcactgctgcacatccctctttccaacaattttcttgaagtaaatggagctcttttctaaaaaaataggaaattttggaaagtacaatttcactgttgttgttacacatttgaaaaatcccacaatagggctctttggtaaaaattagattggagagtgtggtctgtgcctagaaatcaaattgagacttccattttttttcccacccttttcccaaatccaaggtgggtagaagtccagagcaaatccaaagtccgtttagtcaaccagacattgcaaatgggaaaacctgctaggctttaagctgagctctgcctaagcaggtcctctgggctggagtggatttgagagccccatctgacacatgacaaagtaataacacttactgatagaatgtagctttgacaacttctgagttaacgtgggccagttatcagggtacttcttagccagattggtctatagttttagatttcacagaagggatctaaaattgaattctagcccactcagggtttattaagcttgggggaaaatggacagaatgtaattgagttcatcaatgatagtatgaaaaaagttgtcagtttatgatgatgaaatatatagcagcaaagcaattcaatactttgtctactgataaaagcatttgttccctaaaagagtatttgggaaaccaaatattccaaaatagtagaaaaattgctgagtgaagatacctataaacaaaatgtgtttttaaaaatctgctattaagaataacagattgacttaaaattctgacacttaacgaaaaaaatgctgccatttagccattttatcacataatatttatcgcttatgttgtttacatacttgaacttatattttctgcataacattgaagtatgcattttatcattcaacattgtgccaaaagcataattttcttttcaggggaagccttgaggatattatgtaaatagttgtgtagcattctttcgtatatacaagtaccataattgattaaaatatttactttgttgaccatttaagctgttaacattcttttttgctgctacaaacaactctctcctgagaatatttctatttatattttttcaatttcagatcatttcttagagtacatacgatgaataaaattatttggatcagagtctatgaacatttttaggactcaatatacagaatacacaatgttttaaagtttgtatcaatatttatttccttcagtctcttgtgaaactgctaaaattaagtattatcaggtttttaaacctaggctaattcatcaagcaaagaaaaagattgtagaagtatttttaataatatagttatttaattataaataaaataagcattttgacatatttgtttgtcatttgtggtttatctttagtgaactgcttattgtggtactttatctggtttatagaagtatcttttcatttcatcagtatgcaaaaaaattatagactatgtgtatcaatttttgccttattgtgaatatcctcctagttgatagcattatattgtatgatagttttattttaaaaacattacaaatattttaaattatggttttaaaattaaaatattttaatgttacaatatttttaatgaagtagtttaatgaagtaaaattttttcttctttgtagtgttggtttgaactgttacttcaatctttaaaagaatttattttgcaagaacgcataaacttttgcctaatgtatgttacttattaactttaaacattaattgtttttggctgggcatggtggcttacacctgtaattctagcactttggaaggttgaggctgacacatatcttgagcccagcagttcgagatcaacctgagcaacatggcgaaaccctgtatctacccaaaaaagtaccaaaaaaattagccagttgtagtggtgcatgcatatactcccagctactcgagaggctgaggtggaaggatcacttgagcccaggagagagaggttgcagaatatttagaaggcgagactagaaaaagtagcttttaaaaaaaagtgtaggccaagcattgtggtctcatgcctgtggtcccaactactcaggaggccaaagcgggaggatcatttgagcccaggaattcaaaatcagcccgggcaacatagtgagagcttgtctctacaaaaagtaaaaaaataaaaataaaaaataaaaaaaactgggtgtggtggtatactcctgtagtcccagctactccagaggttgaggcgggaagatcgcttgagcatgggaggttaaggatgcagtgaggagagactgcccactgaactccagcctgggtgacacagaccctgtctcaaaaaaaaaaaaaaaaaaaaaaaaaaatatatatatatatatatatatatatatataaatcaagtttttattcatcttgtattcatctgaaattagatgctatgggcatgtgaattgttctctttgtgtgataaactttccattgattaatgtggtgtttttaacacgatttattatgtggatacacacttatgaacatagctctttcctgagataaagaatcttttccatttttccgcacatgtttttattttagcattagtaccaaactgacttcatttgtgtgcttgtactccatgttatactccatggctatataaatcagcaactacacattttggagttttttgtttgttttttgtttttgagacagggcctcactctgtacaatctgtcacccaggctgaagtggttgttttgttttgttttgttttgttttgttttgttttgttgtacagaccagtgcccaagctggtctcaaactcctgggctcaagtgatcttcctgtctccaccccaagtagctgggacaacactgtgagccaccatgcctaccctacacttctttttaaaagtattttttctagtctcaccttctaaatattctaaaagtattaaagataattttgataaattgagaccgaattaaatacatatataaatttcgagaaaaataagatctcgaaaaatacgaactttgccttccagacacagaatacttgtcttctttgattcaattttgtttccattcatttcaacaaagttttgcagttaccttggttgtattttattttcaccttgattttttttcttacacttaggagttgttttgtgtctgtgtgtgtgtgcatgtacacttgcatgtgtgcacacctgcatgttgttcttaccttttttattctagctttttctattctcctgacttactttacataatcgccaaataatatctatacttcttttcatatagtttgccactgtctattgccattctgtttatttaaagtcattcatttttcctctaatcaagtagttgcttttttatagtataatgatcaaatggcaatcttacttccctctttcttctcagatttccagaacctactttacttttctgcatgctttaactatatcttataagtcttcaaaagggaacatttagaagacggtgacttgagcatttgtttctgatcatttctctcttccaatttactatttttacatcccagccactaaaataattaaaattttctattgagatgtgtacagacatcctattccatctgaatctttggagagaaagtgtaggtatcagggcatcttttgttgcaattgagagacaatcaataaactaaagtcttgaaaagaagtgtgtctatctaccaggcttgtgcaagtaagcagatttctgagttgcctagaggagagatcatctccttggagaaggaatcttttggaaaaaggaagggggtttgcttctgctcgtttactatgtgttctctatgagaaggaagctgtttattctgattcagacagaataagaggaagcagttgtattagttgaagcccacctctcctggcttgcttctgggagcagagacacctcctggggtgaggtcccagattttcaattccattgtcaatgggtgactaaagaagacatcatatttctatctgccgagggctatgtgctcatactcgacattacaatataattcaaatggtcgatggaatctcaaaatgacacagagaaataaaactaattgtcaatttggaagaatcctgtgacttgaaagggaagaaagagtttaataacttgaaccgttgtctaatataaatatatgaatgagggcaagaatgtaagaaaatgtaaataggaaatacaagtaaggagttttaaagagatttaacacaacaaaaaagattttggagctgaaaaaaagtcatgattctcagattttaaaaatatttaaatgtgaattggttaaaaatgtcaggagtcaggttatacttagattgcaatataaagtgtgatttttactcatgctatgtttatttgaagttttagtcaaaagtcaaaccactagtaagtggtagaagtgaataaaaaacacatctgtcattgtcataagtccattttcttctcaattatattatctctccgaggtttaaaatcaaagtgagagccagttgccagttttaaggtgagagggaagggaaatatgaagggcacagggctcccaggaagcccagaaggagaggcctcaaaagaagactgtagggaatttgaatccagcttcacttaactaaaatttggctcaggtaggaataagttacttttcctaaaatgagaaagctcagtcacaaataaaatgttctttttctttttttcttctaaggatatctaagtaattcaccaggagagaaaaaatgtgttactttttgccaaattaataccatcttaacctgaattaccaaaacatggaaaagcctcagagaaagaggacatagttaaaaattgaagacaaaagcaattctataagggcaaaatacaatcaaatatttctgtatgtacatacatatatacatgtttacacatacatatacatatctgcatatatatgcacacaaatatatatacatatgcacatacatacatgtatatgtgtattcatttattgataatgcatacgcatgaatgaaatgttagaaataattgtatactttaattgctctactctcctgtttctctatttttacatataaccaaaaaaattttaacatgttcagttgatgatttatcgtagtcaatgatcccctttatgatctgaatctgcatgaaaaataaaacattttatttctctaggaaggcaaaatattttgaaaaaaaaacaaaagttacatattttggtatcagaaaacatcttattgtcttttaaagaaagacacatagaacaatttaattatagagttgaggtagttttctatgtatatcaggccctccaaacacacccactaccatttcaggctggcattcaaaacatcacttagtcactacccagcattccattttgtttgactacatagaaataacatttttctgcgtggatgaatggctaatacgtacaatggaactgacttattttgcaaagcatttcaaggtcttccagttaatttgacacaaacttattccattatgtaaataaaaattacaccatattacatgggctctaaggaaaatgacaaatgcagattgctatgcatagatacatagagccatcattaggaatatgtttggtactaatgtgggaaaaaaacaacaatctttctaattagccatgaagaaaatacacatacatattaataactggtaacagtgattacctgaaaccaagaaatcagttattgtacaaattcatacaactagaaaaaaatacttatttttcttctttaaaagactatttgtaatactaatagaacttttcaggtctttttttctctctctgtattctctctctctctctcccttcatccttttcacctcctttcaatctgactagataatattttaaaaatacatttgtttaaaaaaattcacccagtctccttctctggcaagggagaaggttgtttaatgagaagaacagatgcttcactgtctagtcctccagtagttcatgttgtattgagctcagcagccctagtcatatattgcactttcgttctgtcattcaaatgttgcaaaatcccctcaagctcctttatttgtctagtgaaagaaaagaactgttttggtcatatcatttcaaaatgtcttgttgtcacaagacaacaatcttgataatcttgaaaatcttgataaaagacttttgaaatgtcccagaaaggccaaatatgtgcttgtattatttatttcattttttattatgctagaatttaatttttctcttaattaacctttgggcttttttttctgttacctacccattgtatactaacttaatttttgtaataaataagctccatgattttaagttctattgctttaggagatgtcttgatttattttagaccactaaacacctgaatttacaaacttgctgcttccaaatgcatccaccctgaacgttctcaaaactcaccatctcttaaggacttagcatacgccaacattgcactgtaaatgctttggaatctgttatttaccacccattccctgcttttgagcttggtatttttatccacttttttttttttttttttttgagacagagtcttgctcttgctgtgtaggctggagtgcaatggcacgatcttggctcactgcaacttctgcccccccaggttcaaacgattctcctgccgcagcctcctgagtagctgggactacaggtgcacaccaccatgcccagctaatttttgtatttttttttttagtagagacagggttttgctatgttggccaggcttgtcttgaattcctgacctcatgatccgcccgccttggcctcccaaagtgctgggattacaggcataagccactactcctggcctccacattttgtaagtaagaatactgagagagaaatttaataatgtgtttaatgtcacacggcctagaagtagaccaaatacgaatcaaatgtctatctgtccagtaaatcattacaaaataccaactcaccaattttattgctatgaaataagctcaactgtgctaatatttatatttttataagactgctgtttcttactgccttacctttccccaacctcatgtccccaaaacacacacatgtattttctcccttcgtagaaagtcatatctcttaaaagtaaggaaatataatgaaagaaggttggtcgtgaattaaaggctatcgataaattttcaaagcaataaataactattgtggctacatccaaaatcagcattccaaaacacatttcaacaaagcatgtcacattttaaaaaatgcaattctaagatacaaccacatttttcatatgactggaatcacttggccttttgccctgtgctccatgaaatcagtgatgttgtacagagaggggaaaaatagatggctgttctagacctctgaatctcctgccaagtccccctatcagagagactatgagtaacccttccctgcctggcatcataattcatcactctacctcctttctgcttcctttgctacctgggagaaaagcaatgtaaaatttaataagttgaataaaagttatttttcccaccatctgtatggattctggaagcgtgccttgcaaagtacttttcattactaggagctatgtaataccaaaatcctgcctaccagctgttggcaccagagtaagtctaagaagttcttgagcggccaaaatttcatctcatttccctctgctgtgaagtccttttatgcatcttagtgccttccacccttggaaagctctgcaggggaaggacaacgtagctgaatatctgtgaaggctagggtaaacacaagcactttgcttcactttcttcaattagcttgcccaaattcagaaggaaagagtagtttctcaatataatctttcacattcatgtttcaatatagtaagtctcatcagcctcataaaattaaaggctaccataattagccaaagcatggctgatttatgttttttctcatttaaagatgtttatattttaaatgtctatagaatattacagatttttccctaaaactcagttatttctagttttttctataactactttttttaaagaacttttttttggcttttattttttggttttgttttctaaatgtatatgactctaaacaaagtgttttgcaaaaccctcttttgcaatgaaagaaaacactctttctgcttttttattaaagacaattgtttattaacccaaaatgactacttaaagcaggtcccatctcctcaaattagtctgttcttttgagtgctacagacaatccataaagccctttagtgtctctcctgggtggtaaaaatgcagttgtgttacctgtacttatacgttgggctttctaaactttatatcatttttattgttcttatttggactctccccaatttaacaagacatttttttaaatgtgtgcttgaaaaatgcacacgataatgttcttctgaaaaaaataaactcccttatcctttatgtaatacctctgctatacattcacatatgagccgcaatttgccttgtgcctgaagcattacattgcaaatttatgttaaatgagtggcccactatccaaatccttctcctgcaggattatttcattttcttcattgactagtttatataatggttctgtctctccaaataaagttactcctttttgaaacacatattcctgatccaagcctatcccaggatctttggtgatatcacctgctaaatataaacccttgattcaaatattggccatattaaattttgtagacattgtagtcagatcatccaagaacatctatgctaattgcattgccctcaattgattttattttttgtttttctgtttgtttttctccctcatttgtttaaagacagtgacaatcaagtcagcattatgattatttggcctttggtgcccatactgctgcatcaattttgcaatgaaccattaaagttaatgtctgaatagtgtacgcttgaagtcagactcttcagaactttgagacaaattagttttcaaaagtgtattctaggtcatagacaattttgattgtacacaaacctttcttgtgtcacacttctgagacgtgggaggcaggaggaggttagtggagctttgaatatatatttaaattccaagagcagtgttctgacctagaatgggtacaatgttcaaaaatcattaagataggatttttgaaggcctaaactcaaatgggaaattgtggcaggtggatatgggattgccccctccttgtcattcagtttgggcacagttgatatcacctctttccaactttgggatctggttagaaatcagatgggtttattctccctccttgccacagtaatcaatttagcaatcctggacaaaataacaaaagtttgtgccttttcttcacctccaggtggtcccatcagcatctatatttggtctactgattgtggccatgtgaaaaaaacaataatcactatttttcaatataaatatctcatatgaaaataacatgaaaaatattttagtaagttttacaaatttttttctagcaaatcttcatgctgttatgttaaaagtagtcatgagcattcctagttcatcaaaaaacatcatttgagttttattagtcagcaggtttgaccattaaatgtaatttaaaatatcttagagttggtgttatttttagtcccactatatcagcagtccccaacctttttggcacaagggactggtttctaggaagataattttgatagggttgggggttaggggggatagtttcaagataaaactgcttcacctcagattattaggcattagattctcataaggagcatgcaacctagatccctcacatgcgcagttcacaatagggtttgtgctcctatgagactctaatgccaccactgatctgaaaggaggcggagctcaggccataatgctctcttgcccactactcaccttctactgtgctgcgcatttcctaacaggccacaggctgatacaggtcctcagcccaggggttggggacccctgcactgtattactccaacctgaaaaatatttgaaattcccaattcaaatgtaacatcataggtaggaaatatattttggttgtagtctttgtaacctttgacctccgatactgaactttgaaaaaaaaagactaattttttttttagagtagttttaggttcacagcaaaattaagaggagggtacagagatttcccacatgcccttctttctccacataatacctaactgtgttagtccattctcacgctgctatgaagaaataccagacattggctaatttataaagaaaaacggtttaattgattcacggttccgcaaggctggggaggtttcaggaaacttacaatcacggcagaaggcacctttcacaggggcgcagaagagaggattagtgtccagtgaagggagaagccccttatacaagcatcagatctggtgagaactcactcactatcgtgagaacagcatgggggaacctcccccataattcaaattatctccacctggtcccacccttgacatgtgaggattatcacaattcaaggtgagatttgggtggggacacagagccaaacaacaccaataacctccctcattaccaacatcccccacaagatacatttgttacagttgatgagcacacattgacacatcattatcacccaaagtccattgtttacatcagggttcactcttgatgttgtgcattctatgggtttggataaataaaaactgacatatatccactattatagtatcatacagagtagtttcactgctctgaaaatcttcagtggtgtgcctattcatatcgctccctactcccaactcctggaagccactgatctctttactatctccatagttttgctttttccagaatgtcatattttccaaatcacatagtatgtaactttttcagattgccttctttctcttagcaatatgcatttatatttccgccatgtcttttcatgactttctttgctttagtaagataaatctcaaagcagctaagtttctatttctttgcttgtgaggctatagtgtagcttatatctttactgaatcttgtaattatgtctgacctggactttttttttttttttaatttcctgttatggagtggaagacctgctgcttggcctcaggattagtgaagagctaatctgagttttagtgatacatgaactcatctcaagatttccctgtagaatggcagagcctgagtcctctggaatcatctacagatagtgtcaccctattgcatctgaacactacacttatcattttaacagaacatgacatttgggcctctatcattgcctaatgaccctactaaaccttgctagtttgttttttccaaaatgtttttgctctcttctaatccacttgcatgctcttatgtgaaccacttctttctccctaacctttacctgtattttcaacttataacctgactcatgcttcacagagaaaagacaagcaattgaatgaaaactttttggacttctccctgggctatccatgaacgtgtggatacacctatctgcctgccttccttcttaccataaaggatgatgtgtcttagattttaacagtggttaatccctccactttcaccatggttcttattccaccttttctgcttgaggattttgctgttataattagtctcttcctctcccacttgatcaactagatcatacattctagatcttttcatctctaatatttcctactttaaaaggcacaataaaacaagaaatcaattttttgctagtatacacaattacagggctccagtcttgtttactggtccatctttctctgtcagtcttctaaatattgaggtgacccaaaactttattctcagcatctcccctctactcgcctctttccttcactttacttctttctgtttctttcctatctctgtacgctctacctcagtgattttctctttcagagagtcattgcaaacgactctcgaatttgcaattataactcagatttcccagcagaccaccagatgtgtatatagccatctacttggcctctgcacttggacatctaattgggaattcaaacttagtgtggtcaaagcagatgtcttgatgtccaccccatccctctcttatccttagcaaagttgttcaggacaaaaatataggaatcattttaatttccatgtttcatatatctattacctaaatatccaactttaactttcactgttacccacacaatgggtgggttctatcctttggtgagtgacagtccaatgatcattaccaaggaaaatttaacaaggagattttattacctgcaagtaaggagggcacccaggttagctgctaaagcagtgccttcctgaccaaaggtgaaaacagagctttcattgggctgattagttgagccattgcatgtagaagtggagtaaaggcagcagaggctcagtcaccagtcatgcttgttcatgctttgcatgtattgaaaatggtgaatcagttcctcttggggtgggggtgttagtatggtaatgctgagttcaccaaagtttatctccaactctgacatctctggatccaacaggtttttgttgttgttgttgtttttcctggactgtgcttcttcctggaacttttgaaactacaaaatctcagggtgaaacaattaccagtgggtagatttatacagtgtgtacctgaaaacccagggaccctgggttacctcgccaacaccacctctgaaacatgttctgaaagtgtctacttttttccctcctcactatccgcaccctagctcaagctacctctactacttcgtcttctctaatagcttcttaatatactatagtagcttccctgctttatgtgttccaaacatactctatcagtctcagaatgaaatctaggcaccatgcttgctgcatgatctgctttctggcttctgcctgatgttatcgcatgttctctttcttaagttctatgttctaatctccaatttatagaacatgctgatctgtttcttgcattcaggcctctgcattcactgtttcctctctctaaattagaatgttcttttgtgccctacgagtcctgtgaatgtttatctcctcctatgaaaggactttcccccactttaattctcagtacttcacttcctccagtcgctctttattccatcactctagtttgttcttttttacacattaatagacacaatgtgaatctgcttactaatctgcccagccctctcctttatattgtaaattccatttcagcaatggctttgttagtcttcctcactcttgtatgcacagcagttagtaaagatacttttgtgaaagaataaatgaaattcctttacccttgaacgtgtagagctcattgaagtcttctaactttattccctaacatggatattttacaaggagcatcttttagcaggctttgtaagcagtttggtgcctgcattcttgttctgactttgttcatccatctctcttggcagcacaaatcagggacaaggaatccctcgtctcctcctgcagaaatgtcaggtttggtttggttgtcatccacagatttttatttattccagcacacactgatgggctaatgggcctcctaaagagactcagcagaaattctcccttccagctggagactgaagaactctggcttaaatgaggagaaatccttgacaatgttattgctagataaacttttatcctgaatatgcaattttttcctatgtattgataacctaggtcattaaagatgattaatgtctgccatattccaccagcatttagaacaattcttaaaaccagttatagtggcactaaaattcattcatccagcattcagcataaaagagattctttaaaattaacaaatcaattataaatatatgtagtgtgtatatatatgtgtgtgtacatatgtgttatatataacacatatatgttatatataacacacatataacatatatatgtaatatataacacacatataacatatatgttatatataacacatatgttatatgtataacacatatatgttatatgtataacacatatattatatataacacatatatgttatatataacacatatatgttatatattatatatataacacatatatgttatatatatataacatatatatatatcctaaatttcctcatacatagtatctgacaacatatgtgtaatttctgcaggaacaagtaagccataaatggtgctagacacctcatccacaaaattccacttagaagatttgatatttgccttgagttatttaatcattccataatagttgaaaatgtactctatggcaggcacagttctgggtgccagaatctgatatggacagacaagaaaacacacctgctttcctagttgttcggggaaaagtataatagggaaataaaccagtacatttatattcattatgtgatgctaagccttatgaagaaaatcagctgggtaagaaggtaatagaaaaagggtgaacagagcattgtattctcaatgggttgcctctctggcctcttcgataaggtagtataggaaaatgtgagctatggagtcatcttgtggagaacattcccagcaggagaaatagtaatgtcgctgttttgctattctagaagtggtgtgttctgaaaacggaaaggatgcattctggctggaacaaaaagatgagataacaattttgttttcaaatcatactattgttcatagctgcttattggcatttcagatttgggaatttgtgggttacttgattagaaagacatgggaaatcaaggacaaggttaaacaacaagagaaagaaattagagttcaataaagcaaaaacagaacagtggaagatgatttaatagtgttatgatttgaatatgtcccccaaaagttaaggtgttggcaacttcatccctctgctcttatgaatggattaatgtcagttttatccttatgaatggattaatgtcagctctaccttcaagaatgaattaatggattaatgtcactgtcacaggagtgagtttgttatataagccagctctgtctggctctctttctcttgcctatttgccacatgatcccccacaccacgttatgacacagcacaaaggccttcaccagatgccaacaccatggacttggacttcccagttcccagaactatgagctaaatacacttttgaaaaaaataaattacccagtctgtgatagtctgttatagcaacagaaaacaaagtaagacagatagtaaaaaagatctctgttaattcatgttctagaaaggataaaatatacttctaaaagtatattactgaaagcactgtttctgtgatgacgccttcaaaaaatcattgactggaaaacaagtttgatatatgctttgctatggtgactatagaataatattattttatactatatccagacatatgagaggtataaaaataaatactaatataaaaaatactaagttagttgtgttgatcccagaatcacagaaacttatttaatcacagaaggttttacacatgtaatacattttgaaaacaattgcctcagaagtaagagtcagatctgatgtagcgaggtgaagactgactaatgaaggtgaaaattgtactatagtaaaaaaaaagatccaaatgcaatggcttaaatataatgagacatagttagactcaatgacatgaagttatccaggtaccaaggctagcatggatgaagtggatggttgagggtggaggatggtcagctctctcatcaacgtgtggttttcaaggattgtgctattactcattacctctcagctgagcctcatcaacattggataccagcatttttctttgctgtgtcctgaaagaagagtttaattattgttcatttctacactgatgataaatgtgtgccatcgttattaaaacattatcctgtcagaacccctgtgtcttacgttagcttgtctcatgttccttgtaccctacaatgtcacaaaaaacaaagctcaagatcaagtatggcaaattcccttcagttgtaaaacccttttggtgttctgcttttctcattgggttccacatttagtgtgttttgtttgtttgtttatttgttttttccttatttctggtcagcccatcaatgcatttaaggtagtgtttgttgtatataaataaattcaattaggaaaaaggaaaagctatttattcagagcttgctagtgcaagggagtcagcaatagtatcttgcattttggcagagactcaaatgcaggcggaagagtgggaaagctttattatggaaaaaagaaagacttcaggaatgctctgattgaggactattggcataagaaaactaaaggcaggctaactagaagtagggtatgctatgtgactggataggaatgcatatttgggctttctttgcttgggcttaggaaagttatctgttcataagtcctcttatttgggatcaattgttacagaagtttgtgcttggcttccaagatggttactagagatagcactctgacttctacaagtctgttttataactggctggctcccgggctctttattgtagataaggggtttcctgggcaggttgctgcagattgtgggtcagatccacatattatacttcccctactccccacttcacatggtaaattataatccttcataaggcctgagaagcccgatgtgatcttatttctgcctagctgtttgtatattgtttctcactagtttattgattttttttttcttttaaccaatatgtttgactcttcacagtagatggtttgctcagggaatctatatcaaatttttagtgactaaggtttggtccttagggtttttttctacttatctttttaatactcctttctttaaattttctcccaagtgatttcatgcagtttcatatcttcatatgcattctttatgctgatgactcaaaattacagcttcaaataacgcctcaccttgaactacacacgtaaaagataacacattacttgacatctttacttgaatatctagaaggcatctcaaacttctaggatttcacagaactattcagatctacctcacaacgtactgtactgtccactcccaaaccatatacttcccagtaaatgacacttctgttgactttgttgttcaggctaaaacttagggtccttgattcttcttgcctatatccagtaactcctatcagatttgtctccaaaatatatttcatactttagcaaatctccacatttctgtcactaacatcttagcccaagcctgcataatttcctgactaccaatagccttctaaaagacctgcctttctttgttctttttcctatgcagtctatcttttatacagcatagaagatttcattttcttcctcaaactataaaatatcaactttctgaattcccatttcacatgataaatcatgatccttcatatgtggcctacaagacccaacgtgatcttatacctgcctaattctcacttatcgattctcctctctccgttttgcttttcacgaaatacaattcttaacattagactaatgatttctgcctcagtaacatggaacctgctgtttcttttgcttgaagtcatctttttccagattttcacaaagctactaacttttcttctttaggtttatacttaaatatcatcttttcatagagaactttcccagctctgagactcacagacattctctaccacattcctatattaaatattaataataaaagctcgtgcaagcccttgaaacgatgtctcccctatgtataagctccttgaagccattaaaccatttttctgattcactgacataggtatagttctaagaacagtaccaggcatatggcagatactgaataaatgtttgctgattgattaaaagaaactatggctggagttgtgctataaaaatcaaatggtgaaagagaagcagtattcaggttttttggaatatggaagagtagggtgccttctggagataacagctggctgctatgattttgattgcccataaaacattcatgggtcaacagggaaaaagagattactataaacacctccttccctctagaattttacctggggaaataaacaaaggtcaaggaatttttattgattctcccattgactagatgttctgaagcagtggtaattaattaaggaactaaaacttaagtacaggataatccattgcctgaagctagagacagcagcagggctggagattgctgaaaagcactacagttctcaactacaaagtgtgtgtaaagagtactgcaatttggctgagggctaagctctttgaggggacaataactactggggacagggagggactctgtaagtcaaagcaattgactgcaaaatcaagccttatgttaaggaggcagctttgatgtaattgtgagagcactgatcttgacatccagagatcagattcagtctcaagttactacttcttcagtaagttagatccttaacttccccttatctctactccctcacctgtagaactagcagagtaacaactgtttcatagtttattgtgactaatctcaataacgtggaagtaagaaccacagaacaattatacaaattttaggaataagccctaaatacttttatattcctccttcagataagacatttgttgacaactaattgtagattacattgacatgaagaaaaatttagcttccttaacaatgttcattgttaatcctatattctccatcccaccttatcatttaaaaatcaggtatcattgagtattgcaatcaaaaatgtaaaacctgcttcaaaaggtgattccattatcttgtaaatgcataaaaccttgtggggagaaggaattaatgaagcaaaacaaacaaaaaaacaagacatttgggttatttgaagcagttcagtgacatctcgtgtcacaatgccaagagtgcggttctatcatccacaattgccatccacaattgcctttgtctgtgggaacttctttaaactgtgctcagtcatatgcatgctttacaaacttttttttttaacattggttacagatggtcatatagcatatgacaaaatataggctcagaaaaatcaaataatggatccaggcactgtgcaatcatctgggggtagtgtcctgagaaaaacaggcactgtccctacccttcttataaaagtgcacaacacaatatggaaaacagggctttaattaagcaaacaacattgtcaaattgcaaaaacgagaatatcacttggggcaaatgcaccaaacgagaagctatttcttaaaatcaggtgtactaaggagatgttttcttgattgggaagatttgggaggagttttaccttgcatgctaacttttaaaatatgctaaagattctaacttttaacctgtgtaatggtacttttggaaaacttgcttttccatttttagtatgtttgaaacattttgtttataacaataatgttcatattatagacaatcctgcatgttttctatcttctctttcactatcaattattacaagaatttcaattagctttggcattttaggaatattatgtattgttattttctaatcgccatgttataattctataatgtttatgtttagaaaatcttgtatttattgtttcatttattttttctatgacttatgggcaaaatttcaaataatgtatgagctacctatccatctaaattctaattttcctttttaaatattataggattttttttctggattgaagttcttgctttcttttttcttacaaacacattttcaagcccaacaggtatctttttgtttgtttgtttgtttgttttgagacggagtcttgctctgtcgcccaggctggagtgcagtggcgcgatctcggctcactgcaagctctgcctcctgggtttacgccattttcctgcctcagcctcccgagtagctgggactacaggcgcctgccaccaggccaggctaattttttggtatttttagtagagacggggttccaccgtcttagccaggatggtctcgatctcctgacctcgcgatctgcccgcctcggcctcccaaagtgctgggattacaggcttgagccaccgcgcccggcccccaacaggtatcttaaaaaagaaaaatattctggtaaagtttgccgatagtttctaaaacagtcaaaatagtcatggcatctcccttctgctctaataccctgccagaaatgagaaagagagagagggacaaagacagagagagagagagagagcgatcactgtgttagaaaagtgggcaatcatatagaacaatacagaagtcaccagactgagcaagttaattatccctaaaatatttttatcctagtgagtgatgaatcctttaaatatgtgtccttaaatttgtgagatagtttacattgtagtgtattgcatacagctctttaatgtattcacacagatcatttagtttggcttaattaattgtttggtctcttttgcagagaggcatgtttggtagagggaaaaattcctttggataaaaatgcacctttgtaaatgacatgcaccaggttgtgtgtttttcctctaatagcaccaccattttgggaattgacctagatgcccaagaaagtcctcattattgagaatttatgtttctctggtggctttcatttgctaaattagtctctgctgcatattaaacatagatagctaatgccactttattgctgctggtcctattcagcatctcttttcacagaatgcaatctacataattagaaaatagcatgacttctgaatctggcacatcaggagggtaaagatgtcgtactcttgctttcatttcatatgccaacctttgtaacactgatgggataataacattctttcaattttataatggtaataggtgtactgaattgtgttgctggaagtacgaatgaaacaaagggaagatatgaatttattaatacaagaaaacataagattcaagttagttatcaaataaaattaaaaaaacattttgtattgcagaaaatcgccacatctgtactgtcactaaaaataattgcaagacatgtgagacaaatagcatgctttttataaaccagtctacaaactactcaaattcttgctatgtatttcatattcatatattttcccattattcatttgtgtcccatttaagtaaagctcataaagatattataaggtatattcctaaaatctctacataatatctctgttatttgagaaaatatcaaattttacttatgatatttttgagggattacaacataaggccaattatatggtttggatttgtgtccccaccaaaatctcatgtggaattggaggagagacctggtgggaggtgatttgattatgagggcaaattgctattctcatgatagtgactgagttctcacaagatggtttaaaagtgtatggcacttccctttgctttctctcttctgccaccatgtgaagaaggtgcctacttcccctttgccttctgccatgattgtaagtttcctgaggcttctcagtcatgcttcctgttaaacctatggaactgtgagtcaattaaacctcttttcttcataaattaccagtctctggtagttctttatagagtgtgaaaatggacaaatacagaaaattggtactaggaaagtggggtgtttctataaagatacctgaaaatgtggaagtggctttggaactggttaacaggcagagtttgaaacagtttggaggcctcagaagaagacaggaagatgtagaaaagccgggcactttctagaaaattgttgtatgattttgaccaaaatgctgctagtgatatggacagtgaagtacaggctgaggtgatctcggatggaaatgaggaacttactgggaacaggagtaaaggtcactcttcctatgctagcaaagagcctggcagcttttgccccttccctagagatctttggaaatttgaacttgagagagatgatttagggtatttaacagaagaaatttctaagcagcaaagcattcaagaggtgacccagctgtttctaaaagagtatatttgtatgtgtgaacaaagagattatttgaaactggaacttatatttaaaagggaaacagcataaaagtttggaaaaattgaacctagccatatggtagaaaagaaaaacctattttctagggagaaattcaagtctgctgtagaaatttgcataagtaaagaggagtcaaatgttaatagccaagagaaaggggaaaatctctctagggcatttcagagacctttatggcagcccctcccatcacaggcctggagacctaggaggaaaaaaatggtgttatgggccaggcccagggctcaggggctctgtgcaacctcagaacagggcgccctgcatctcagttgctttagctcccatgactaaaagggaccaaggtacagcttgggccatggcttcagagagtgcaagccccaagccttggtggcttccatgtggtgttgggtctgtgggtgcacaaaaggccagagttgaggtttgagaacctccacctagatttcagaggatgtaaggaaatgcctggatgtccaggcagtagtctgcttcaagagtggagccctcatggagaacctctactagggcagtgcagaggggaaatgtggaagtgattggaacatgggggcagatttccaccttgctattctcgtgatagtgagttcttatgatatgtgatggcttaaaagtgtacggcacatccccctttgctcactctctctcctgtcaccatgtgtggaaggtgcttgcttctccttccccttctgctatgattgtaagtttcgtgaggcctccctgtcatgctgttaagcctgtggaactgtgagtcaattaaaccttttttcataaattacacagtctcaggtactatttaacagcagtgtgaaaatggactaatacagctagaattttatttattgatatgtatgttggtagctagtaaactaaattcaaccagccattattaggtatgaatgatatacatggatatatcttagatactgaaagggaagttaaaattaagaggctgcttcaagttgattagagtaaacttgaaaagcctgatatgtagaactagtattttaatatggcgctgtcttggaatagtaaactaatatagtcaatgttgattcatggtcactttcttgtctttgagggaaaagggtgtattcgtatcttttttatagggaactgaaataaacatttccaattttgagtgcattttagattgaatctttagaatgttttgatatagaaatctaaattttaaaaaactttataaaacaaatgaggttttatttaatcacacatttattgaaaagatgccttcctcaaattcatttatcataataaggcatacatgatcatattactgtttcaacagtattattgctggttttgagagttctcatctgcaaatgtatgtttatgcacacatgtatgcatgcaaatatatagccatacatactcaaatatgtatctatatttatgtttttatccatatcaaagtccatatctatatcactaactatatcaccatctatgtctgattatatacctatcgaaaataagattctgctggtagtaaagtttatcctcacttttttcactgaacaatatgtcataggttttttttgtcattagatcagcaaaatgtatatgtatttgtgtgtaaaatatattatagataatgtagatttggataatcattttattagttttacagtatttcctggtgtggcatttcatacttatttaaccaagcctgtattattgattttgtaggttattttagatactttactattatatataatgcctttatgtatatctttgattaattgactattttcttagttctctttctgtaattttgatttattgataaatcataaatacttacatttaaaatggttccacatagtactcaattttatctccagaaatgctgtaccagtttacactcttaccacaattttgcgataaatattatcatgataactaaaattttgccactgtaataagttaaatcttggtagctctttattgttttcattttcctttgctcagtagtgcctcttttgatttgaataatggcttttctactcaagttcttctgtgtatttggaattgaattaaatgaatttcttatttttctactgaaataattactaattctcttaattgtgataacttttagtataagagatatttacctactgtctatcatgaacacaacacttttttttttacaaaattttgttctctttaactttttaaaaaaaatttgattgatactagttttcttatggaaacaatgtttatgtggttaaatctagcctttttccttcatgatttctaatcctagtgtcatacttagaaacatctttgctgtctaatatagattatagacttatattttatgtgtgatttttacatgttttaccataaaatatctatagcactttccttttaggcatgactttttccccaatagctcaccaacagtgctaacataatttctcaaattaagtttcccttccacagctttgaagtgccacatttacttatttacttatttatttcttatttaaaattttttcttagagacaagctctcgctttgttgctcttgcttgagtgtagtggcaagatcataactcactgcagttttaaactcctgggctcaagtaatcctcccacctcagcctcctgagtagttagaactacaggcacatggtaccacatttagctaatttttaaaatttttttgttgagacgaggtgtctgtatatttcccgggtccacaacaattctcccacctcatttcccaaagtgctgcaattacaggcataagccactgtgcctgacctgaaatgtcacatttttgattaccaggtttacatatatatgtatgtgttagcaggtacatgtatataaattatatgactattttagaaataattcccacaaataaagtgcaataaaatttataaatagacctatatatgtgtgtatacaaaatatttaaatattaatacacaattatatataaatatatgttgtatatcgtatatcaatgcataggtcatacagtttgggtctgattttgaattttctactgtgtttcactgatttattcagagtcattaatataagtcactctaaaagggcagtttttatagtgcatgaaatattccaataaaatatagtatataaattgtggtatataaatttatatttaattttttaaatttatattttatattgtagtatataaatttacatttcttgttgcacactcttcatctggcatcaatacttctacatgtcaatagcatacccagtgttgcctctcttaaacatttactgatgggatcactgctatgaaaccccttcatatggcagccattatttgtaatccatttctcataacctatttaaaacaatcacctggagtacattttgaatgtactatgtttaaataacatatagcacccaagtgcatgaatatatagaggcaacagttacttgagaaaaaatagatatatagacatcaaaggcaaaagctagaaccgagccctcaaaagggcatataatggagagtgaaccttaatgcttatcttcaatctgtattcatgagaaactgagaaacaggaagctgcatctggcatttgtttgtgctacttccaaaataactggaataagtgtgacattagtaaagaactacaaacctattaaggctgagtctgcaagttgacaacctgggtgggcatggtggctcacgcctagaatcccagcactttgggaggccaaggcaggcgaatcatgaggtcaagagatcgagatcatcctggccaacatggtgaaaccccgtctctactaaaaatacaaaaattagctgggcgtggtagcgcatgcctgtaatcccacctactcaggagactgaggcaggataatcacttgaacctgggaggcagaggttgcagtgagccgagattgcaccactgcactccagcctggtgacagagcaagactccgtttcaaaaataataacaaattttaaaaaaattgacaatctctgtgataaaggtgttgctaaaatgcttggagcaggaagtggaacacaagatgaatgtgggagaaggtagtgctgatgcatatacaacagccatactacaggaaccctggcaggagataatggtagcttagacgaggtggtggataatggagagaagtggagagagtcaaataatgttttcttttttctttatttatttattcctttttttttttttaaattgagacagagtctcgctctgtcactgaggctagagtgcaatggctcaatctctgctcactgcaatctctgcctcccaggctcaagctattctcccgcctcagcctcctgagtagctgggattacaggcacccatcaaattgccccgctaattttcgtatttttagtaaagatggggtttcaccatgctatccaggctggtttcaaattcctgacctcaaatgatccagctgcctcggcctcccaaagtactgagattacaggcactgcacctggccaagtcaagtaatattttctaagtagagccatcatgttcatgaaatattagctatggggaaggaatgaaaggaaagtaacttggagaaatttaaaaacaaaaataccaaattctgttgtacaaatgaataacagaagcctaggttttagggagggaaacaaatgtacttcaaaacagattgaatttgagatgcctttcagaaatccaaaagggaaaatcaagtaggcaattgaatcacagaggacatgattgggcacaaaatgaaatatgtgaggtggcaattgcacctgcagttatagatgagattaccaagggagagagcaaagggatagaaaaggggctaagatttgagcttaaataactgtataggggagaatgtacctgccaaggagaaagacaatgaacattgaaagtaaacgggagaagaaaagcaagaaagattgtggcagagaagacaatgaaaaaatggtataagaaccagggaccagttatcattctggaattttgataagatgttaaataggagaacacagaaaatattttactttaatggcggtcacatgagattttagcaagaatcacgtcagcagagtcgtgaagctcaatgaacctggactaggttgggttgaggatggaatgaaaaatgagaaaggagacatctatgagcattggtggtgctttaaaaagttttattggaagtggagggagaggggtttattttattggctgaattctttttgagacccttaatctcctcttcattgtttgtacttcttttttggtgttataagttaatgtttatcactaaaatatttcccaaaagcttgatccttctggaatcttcttcctctcagctcatagtagtttcattttcccaagtcctcaggacaaaaactttagtgttatctttaactcacctcttaatctcatgcttcacaacactttgtgagtaaatcctgttggttctgtcttaaaaatgttttcaaaataagttttttcatcacttccacagaaaactatcttgtctaagactttctcttgctttatctgaattgtaattgtaaaatctccctaagttgtatttctaatctgtctttgccccacttcaagacagttctcaagagactgatcctttttatacatattagatcctgtcatttccatgcacaaaacactccatttaaacatgagctagtgatatcctagctcacttaaatgctaaagtttttacaatgacatcctaggtcctcaaggattgctgatttagctcaagattaattgttctccttgctgttcctcaaacacaatatcatactcaagaatgttcttggcccagggcctttgcattaactgtattttctaccagaaatagaattcccttagatatttccgtagctcccacccttatctctttctgctcaaaggtcatcttatcagtgacaccttgttaaataatattactcaatatagcaaactttagtcccttctccccaacctcatgacattccttatcccttttctcctttttcatcctctatgccacatatcatgtaatgtattagagattttgtctattcgcttgtttttttacgtgtctctctccattacagcataagctacattagggcagaaattactgactaatcttataactgttctagttctaatgaccataacaatgcctcatgtactgtatgagttcatttgctatttcatgaaaaacaaagctgtgggaatagatatactctcaagaggaatgaggagtaagcgtgttaagctatctgtaagaacccatggaactccattatttaagcagtggctggagaataggattcaaaataagtcaggaagtatacacaaggcagaaggaacacctgcagagattgatgtcataggaaacaagaggaagtttgaagtagatcacagagttgttttctatgacaaaggctgtgaaaaaattaaacaaaatggaaactgaatacaaacctgggagtttgtctaatgagaggtgattgatgacattgaaattgacttctaataaagaagattggtaaaatatatgtgagtgaactaggtttgcagtaggttgtgataaaatggagtatgagaaaatgaagaagtgaatatagaaaacaccaagaatgctggtaagagggaaatttgtggtgaaacgaagaatttttaaattttgcaatttctttttcctcctagataggagctgagcaacataactggaacaagaaaacgatgaccatattatgaccaactaaatgttatgccataaaacaaacctatattacaacagcaggtctgcaaaggtattacagtgcaagacaaaacattaatatttgtacagtgcaatggtgtgatcacaaactgctcttgacggaagaggtctgcatcattttaactgtgggtgaatttataatcaaaggatttgttctttgtttttgtctttattttttatttatgcagtttagcccaagatgtgtctagaaatgtcatttttttaaatagcccactgaatgtattaaactgggatcaggcaatttggcctatcgtatgttgcatttcttcatctgattcctaatatttcatcagtataatgagtcatatacaggtgatgattatcacataaaatttacatttactaaaatatgagcataagaaggagaatagacacagccaggaagcactgtcaggatagtatatgatgttgtcacgtaaaattatttactaaagtacttcctgaaaattcaatcagcaatttgaaaatcagtcatttaaatttcaacaagatatcagggagaactgagtttcttaaagatgtgaagcacaagagggtgtccctaaacaagattaaggtatttctattagaaaattataatagaatatattgtaagcaaaaaataatacatataaatagctataggaaaaaatctaaatatatagtaatcaatgataacagcaaaggtgattaagtacaaatcataggaatacctaattttagtacatttagttattcaaaatacccatattttgttgaagttccctgaacataagtttggaaagacagatataaaatactaagaaatgtataaattggttactttttaaggaaggggaaaaataaagaggcaacctgataacaccacaacattctggagcaatgaaaatggctgggaattcatgtaggaatcatacgtttccattatgtgattaaaaatatgaaatacattacaggcatggtggttcatgcctgtaatcctagcactttcggaggccaaggcgggaggatcactggagcccaggagtttgagaccagcttgggcaacatggagaaagcctctctcaaaaatatgtatatatatttcatatgaaaatgaaagaacattaacaaaattatacattaagcatgaatagctactggtttaaggcagaagcatattaatattttaaataacgtattttaatttgcatggcaagaaaatcatcttaattatatatttaaattattttaaaatataaatgtatttaaaaatctaaatatattttgtaaatgtttgtataacattaaatgttctaaatataaaaataatattgtctttctatataaagtttaatttcttccaggaagtagtctaaagcatcttctagaggcacacacagctttataattttttaattttgtgctttatcatacttttcatttcatgacttctctacctgacatcacactcaaatatctagattagtgctttgcactctgtaatccttaacaaatacttttagatcaatttaatgggtactttgcaaacactgtagcctttgttcccaaactcagattattacaccaccatagagagtttgtctttgtttatatcaaccaaaattctatcagttctgatagaaaaaagcattaatattctctcggctggcattatttcctgaaagaattgtcctgagggatttagtaaggtcaaatagtagagataataatttattaacctttatgattaggtgtacacattagctgtaattaaactgtagaaaattaatactatgatttttaaatgagtaatataattatacatgaagatctatttgcaatatattcatatttagcatgttaagggaaacatcgtgtctgaagcattagttttctagttatttcactaacttcctctatgatcaaaaataactatttttaagaataatcacttataatgtcaattttatttctgtgcaagctatttttgttgtatatatataattattttgactttaaacttgattttaaagcagttttaattattttattgttataaactttattcctaaagtttattcctataaactttattcctaactgttctaaaataagatacctataaacacatgcacacagagttgagattaactggcgagtcatgatttatacctcaatagtaacccacagaagtaactgtgattggccactttcatattttcagctctgctgtttttgacctccattatttcaaataatatgcatttatttctgtctagtgagtgatttatcaagttggcattcttattgacttcttattataaaaaatagcaagaacaaattttctcatactgttctagtaccatgtatagtatacctatttccctttcctatttacttaacaaaattttgacagattatgggtatttatttaactaaaaatattcggaaattttacttcttaaatattaataaaatgaacattcttcatatggaatataccaatattgcttgacatcctgtccataatttaagatgtgcacatgagagtccctcttctgtctcctgctaccttccagttcctaccgtgtattgtgggaaatgacgaaagtattcaaggttattcattgaagttgtcagttgtaatggtaaaggcctagaaacaaccaaggtggctctctcaaagttgaaataaactgtgatactcatacaacatagagcactggccgggcgcagtggctcacgcctgtaatcccggcactttgggaggccgaggcaggcggctcacgaggtcaggagattgagaccatcctggctaacaaggtgaaaccccgtctctactaaaaaatataaaaaaattagccgggcgtgggggtgggcgcctgtagtcccagctactcgggaggctgaggcaggagaatggcgtgaacccgggaggcggagcttgcagtgagccgaggtcgcgccactgcactccagcctgggcaacagagttagactccatcccaaaaaaaaaaaaaacaaaaaaaacaaaaaaaacaaaatagagcactaagcctattttgaaacaagatagaaatgtatatagtaataatgttccgtgttccacaaacattgctaagcgaaagcaaggtgcagaaaagcatatgtagtatgtcaccattatgaggaaaataagtaaatatatatcattgccttttaaaataagcaaatatatactattacctcatggaaaaaggcagtaatgtatacttgattttttttacaaggattttctgtaaaggtccccctcaaaacataaacagtgattacctacaaatagcagaaaaaaaaaaaacagtggaaatttaggggccagtgagtttttttatcgtacatcttttttatatatatttattctgaaccatgcaaatatattagcatctgaaaaactactataaattagttattagttaattagccatagttaaaacatagttaaataatttggtgttcaatcaaatactttcttataaagcttcctactgtaggttgatcccaaaagtagggaagaaataaaagttgccttattaagactatatgaataatgttcacttcagaacaaagtagttactggttgtacagaaagagatattgaatcctacctaattgcccatcattcttccaaaaagtttatgataataattaaaataaattatgtttttattttcatgactttttcaaaatcatgctacataataatttgctattcattttgaaccacagttttcttgtacagatctttactttttcccaaagaatattattgccattattttagctttatgctttcactattactctaagattattagccctcttcatcatatttattacatgtgtaggggtgaaggttcactgaaactgaatagacaaaaagcaaattaataggaaaatgcatacaaattaattttaatgtgcatagcataaggaaattacagaaaaatgattacccagtaactcaatgtggtacagatgtgtataacgccttcttcataggggaagaagagttaggagaaatggggccgtctgagggatagtaaatgctttttatggggaaaatgaatagatttaatgctcagacaatggttaataaataatttctttggaaattaaattgaacagagagtttgatttggaacaaagtctgggctctaggtgtagggtttagttttcaatctcctcctctggaatatgagttttcatcttttctggttaatgaaatttcagagaaggcaactctgtttctctttagcatatctggtttctaggaaagtaagggaacttgagagaacagattaatcctgtgctcgagagagacaggtgattcagagataacagcagggtaggggagaggccagagagaccttgcaactatttctttaaccaaatttctgagtgaaatagtctcgtttccttcagtcccctgtttaaaattttattttcagaaagttgcacatattaaagtagggttggtagctatggatagagaaatcagggtagtaatcaagtggcgtgagacctgcaaaagaagaaaagaacatagattacactgagaatgagtacatagaaaagaactcatctaagcacttttctccacacccaattaagtcagttttatttctgagaatagaccagtccaattaaacagttgagtctcatcttaggagatggtagtgcagatgggttctcaaagctaggtctctatatatgatgcaggcaaacaaatctttattaagaggcatttctatggaaacagaaaaaaaaagactaatgtctggagtcatctataaactagtttttcaagtctggagggcagtcagttgcaaagatttttttatctgagctgaagcatcttcagttggaggagggcagacagcggcaatctgacagattttcctagcacagaagtggtccatgcacaagccatcacggtgacttctctggagtctatttattacatgggtgaccagtttcagtttgcagggctttaggaaaaaggccattttaattttagtaattccaagtcagaagggtgggagagaaattgaaaatgtttgtttggagattcatagcccaatattggaggaaactgaatattcaggattaagtctaggtaatttaaaagaaaaaaaaactcaaaagcaaatgaatcaggctagaatttagtaacaagtgcactatagtttcttttcttaggttcattctaaaattaatttatttctttatttatttgtaattatactttaagttctgggttacatgtgaagaaagtgcaggtttggtacataggtatacaagtgcatggtggttttgctgcacccatcaacccatcatctacattaggtatttcttctaatgctatccttcccctagcccctgatttcccaaaaggccccagtgtgtaatgttccccgccctgtgtccatgtgttctcattgttcagctctcacttatgaacgagaacatgaggtgtttagttttctgttcctgtgttagtttgctgagaatgatggtttccagcttcatccatgtccctgcaaaggatatgaactcatcctttttatggctgcatagtattccatgatttatatgtaccacattttcattatccagtctatcactgatgggcatttgggttggttccaagtctttgctattgtgaacggtgccacaataaacatacgtgtgcatgtgtctttatagtagaatgattaataatcctttggatatatacccagtaataaaattgctggatcaaatggtatttctggttctagatccttgaggaattgccacactgtctttcacaatggttgaactaatttacactcccactaacagtgtaaaagcgttcctatttctccacatcctctccagcatctgttgtttcctgactttttaatgattgccattctaactggcatgagatagtgtctcatcgtggttttgatttacatttctctaatgaccagttatgataagcattttttcatatgtttgtcggctgcataaatgtcttcttttgagaagtgtctgttcatatactttgcccactttttgatggggttgtttttttcttgtaaatttttttaagttcttaaggttctggatattgccctttgtcagatggatcaattgcaaaaattttctcccattctgtaggttgcctgttcaatctgatgatagtttcttttgctgtgcagaagctctttagtttaattagatcccatttgtcaattttggcttttgttgcagttgcttttggtgttttagtcatgaagtccttgcccatgcctctgtcctgaatggtattgcctagattttcttctagggtttttatggttttaggcctcatgtttaagtctttaatcaatcttgagttaacttttgtataaagtgtaacgaatgggtccagtttcagttttctgcttatggctagccagttttccccaacaccatttattaaacagggaatcttttgccattgcttgtgtgtgtcaggtttgtcaaagatcagatgttgtagacttgtggtgtaattttgaggcttctgttctgttccattggtctatatatctattttggtactagtaccatgctggtaccaaggctacagtaattacaagtttcttttttttctgaaacaatttttctctctctggtttccccatttttaccaaagataaattattaataagacaaatttatttgcaaaatgtttcatccttggcctaattatttgcatacatcttacaagactggtgattgttcatatagagtctttttaagctggctttgctggaacttgttcatcaggaatttcagattagacttttaaaagtctctcaaagctggaaagccaagccaagaatttgacttgctctcaaactttgtaatacctttatgaattgggtgaatacctctcttcttgagatcccccaaaatatcttcagattcctgggcctgccaggaagtgacattctttacccaactctaagacaaccatgtgagtcatacatttaaggtatcagaccagtttttcccaaggagatttttaatggctccataaatttaactttaatttccaaaggcagtctggtcacatctgataacatgacgttccagtcaaagccttggtaaaataaccagtgttttcaattatgtcctcttataataatataaaagagactcttattaaacttgtgtaaatagcgtatttccatgaaataagaatactcacaaacagtttctgcttctggagggatcaggtagagtgaaaggtaaatgttttaattttgctcacaaaagcatattttacaaaatttctgtaaagctatagatagctgaagagagagacagtgagagagacagagaaaagaatcgggaacattttaaacaaaaaagtcataaatataatttcattccttcatcagtttagttccatttcattaattattgttttgtttgatattgggttagtgattttatgagtctatgttcttaaaattaaagttctggaaattttgacccagtctaatgacataacctcataattgtcaaaaacctgtatttctgtatttgttacagatttttttttctatccttactatgaacctccttgaagacaaaatacttcaggatttgcaaaaagcattcagaaaaaaagaaagtaccacaataacgcaattacttatggacaagacctaaaatggccatggttaaacatgcaattaaaaatcaaatttggttattttaggtgtcttaccacaattttatataataattataattacgactaataacatataccaaggcatatcaaaattttaagaatctcaaacaaatttggaacacatattaataaacattcatataaatatagctcaaagaagagaaaacatcatttcttatttgacacttcctatataatttaatacataaaataagcgtgtttcttatctctgtttcacatgcttcaggggcctctggatcatgctaaagttaggttgatgtcaaaaagacttaattttgattttgaaatatgattttgggaagactctcaaaactgtcaaaggtttagagcatttgatcaaaataaaatcacagatcactataaaaaaatagtcattcatttagccaaaataataaataaaatatttcaaaacgcaaaaacttttactctttgatagagtaaattcagtttttaaaataatcaaaagatctaataaaaacagcaagagacacacagaatctttctctttttctacccctacctttttgtgaagtttacaacactttttacttttataatattaaaattttgtcttgaagaaaaaatcaaattttagttttatatcagtttactattaaggctaaagctaattttttttcttttctttttttttttttttttgagacggagtcttgctctgtcaccacgctacagtgcagtggcatgatctcagctcactgcaatctccacctcccaggttcaaacgattctcctgcctcagcctcccgagtagctgggactacaggcgcccaccaccacgcctgactaattttttgtatttgtgtaaagatggggtttcaccatgttggacaggatggtctggatctcctgacctcgtgatccgcccacctcagcctcccaaagtgctggaattacaggcgtgagccactgctcccggccataaagttaattttaataaaaccttgtaaacaaatctgtcaatctcagtcaactttgactacacacgataagattttcatcaaccttttatagtctcttaaattttttaattctttttccccctactgcttataataatctaattttatctataccattgtatcttttttttattttggaataacttttagatactctttaacctaaacaaaattactgttatttaacaaaaaccacatcctcataccgtataacattttacttttctcatacactctgtatacagaactgtttcttacatacagtagttttaattatatagatctggggtcttcaaaccctgggccacagactggtaccatggcctgttaggatctgggtgggacgcagagcaggaggtgagtagcccgcaagggagcaaagcttcatctgtacttacagccactccccttcactctcatccttccctgagctctgcctccagtcagattagcatcagcattagattctcatgggagcatgaaacctatcgtgaactgcacatgcgaagaatttagcttgcactctccttgtgagaagaatctaggttgcacactccttgtgagaagattccaggttgcaggcttcttgagagaagatcatgcctgatgacgtatcactgtctcccatcatcgtgagactgtttagttgcaggaaaacaaggtcaggactcccactgattctgcattatggtgagtcgtatcattatttcattatatattacaatgtcataatagaaataaagtgcacaataaatataacccacttgaatcatctccactgccccggtctgtggaaaaattgtcttccacaaaaccagtccctggtgccaaaaaggttggggaccgctgacatagattagttaaaattttcgctcatagtagccttaatttctagtaaaactgaggaagcaaataattctaatttttagactttatgtaaaacaatttttcagtgtggaacagtacatatttactaacaagcccagatatataaacttaaacttctgtagaatatgtttcagtattttaacttacttggaaatgactcagacatttcgtgattgtctatcacttaatttacacgactttaagattgtataacactgaaaagatttttttaaataatagaaattacaatgattatttgatttgtattccattatgtaataataatttggggttcaatcaagtactttcttataaagttttctactctaggttaatctcaaaattggggaaaaaacttatcttattaaaagtgcatgaataatgttcatttcagaacaaagtacttagtgataacagtcctaaagaaagggatatataatcaaacctagttaaccattcttccaaataagtttgagataacaatccaaataaattatgtgtttttttatattttcataaatgtttcaaaatcatgctatttattaatttgctacccatttgaaccatggtttatttgtatagattcttattctcttcatttatttcccaaggagttttattgccacattttagcttatgctttcactattacactaagattattaacgtcttaatcatatttatcacctgtaatccacttttttcttgaagagctgctttcaagaatcttccaacttcctgcttaaatctatagatattattaattctgcttactgtacagctatatcttgatttttttttgcattcctggattaacttcactgtttcttaaatcccatagttttttgttttttgtttttttttccttgaattttctggaccacttctcccacccttttatgttttcaaaaaaaaaaaaatcacatgggaagtacaattttcagagctttgcttacttgaaattttaacaatttgccttcatactttaaaattggggtgggggctgtgttagggagggtccaaaaagaagaagaaaatcacatcagctattcaaaaaataaaataatgtcaaaaaattatgcattactgaaaaggcaaataaaaaaaagagagatgatagaagtagtaacatcagtaaggagatatcatctctagggctctgaggtagcaaaggatgctcaactggcagctcaggaactctgagaaggagcctcatagggttaatcccagacctcaggaacttaagagaggtccagcctgtgagtaagcgcgtgtacgaagggatgcaatagactgggtctggaagtggtggaaaaaaatgcaaacaaaaagctgtgctatgggcagaaaaagcacagttggggatatgtagctaggaacattaatcaaacaggaaaaagcagtaccctttgttatatatttgcgtgtgtgtttgtgtgtttgtttttggcaggtgagtctccctctagcatcctgtattgtgagagattaacaaagaatccaggtggcaagggaggaatatgatttgcaagtccttgtcccaacatcataaagcagagcatagaataatggcttttgaaacaagaaacttaggtttcctccgaattttaaagggcttattgcaatcactcatggtgggaagatcatcccagtgaaatctcatttctctgtggtaaacttttgtgggaggaaattactgttctttctttagctgttggaagaattttccccacctagaattattttttacttatcctaagtattctaaaatttatatttaaatttataataaaatgtagaataattttaatattattttgaaattgggaaattttagattttatagataatttattttttcccatttttcttttctctctcttttcttttctctcttttctattagttaaatatcaagcttcctggattgatgtgttttgtttattttgctgtcatattttcgatttctctctctctctctttctgtgtgtgtgtgtgtgtgtgtgtgtatgtgtgtttaagagacagggtcttattctgttgcccaggctggagtgcaagagcacaaccatagctcactgcagccttgaactcctagcctcaagtaatcctcccacctcagcctcccaaatagctaggactaccggtgcatgcccccatgcctggctaattgtttagagacaggggtctcactatgctgcccaggctggtctcaagatcctggcctcaagtgatattcctgtctcagctttccaaagtgttgggattataggcatgagccactgccgggcttggcctctgtttctttttgatgagtgcatattctggattttcttcaatttaacctttaggattccctcagaatattttatttccatccaatcacacgatttttccttgttttctgattgcttatatttactgacagccctttttataaaaaaaaaaccttactatttgcttatttttgtttatcttattttaatttctttcaggtgatgctcaggattcttacatgttttgtttgatccacaaataattaatttttttcttttcaaatttttctgtttattcatgttagaccatttcttttgtattcttaatgctcctaaaatgtctagtgatccttatttagccattcatgttttaaaataaagaactgagtcaattaacataagtaactgatatggatatcctcttctgttgtgaattttagcttcatatcctaattatcttccataaaaggatcacacgctgggaaccagtaaacttgtctttagtatgtgtgtagaaagtaggctaggacctctctcactaaatgccggtatgtagaggatgatattcttgcacgccaacatcaacactaaaaacctcaactattcccaggcagatcgtcatacttttttagaaaagcaccatctgttttttgctctgtatgtatgccaggtttccaatcactctcaacaactgagttttcgagagcagtgtgtagaggagtggtccttactgggaaatttcttcacaggcatttcttcagataaccttcctgtttttggtcgtattacccacttctattctttgttttgtaatctctgtttggagtcattgggaagcaatattggataaatcagctcttatattcactataaacttctgaactggttttgaatgttgacaaatatccacgaagtgctatctctcaatatcctcctaggggcttttcatatgttagaaatgcatttctagacctcacacaggatgcaaccagaaatccttccccgctatgcccttggcaactgaggttggatagataacagagctctgcccattatgaggaaggcaggagtctgagagtggaacttctgggaaaggttgtactttattgataaaatggaacagattcaggtaactcattatcccttcctctctcccttcctccctccctcccttcctttcttccttccctaaagggaaattaaattcaaagaaacagaaaccattttagaaccatgaaaattaaagcaaaaattctgaggatggcagagcaaaaaaggagctgagactctgaagtcattgtttgttgagcaaccacagtaaccatcaactgcctaccttcactcttattaagaaagaaaagcaaatccatatttgattaagctactgttaacttggtttgctctataactggtcaaatgcatttttaactgttaccagcctgctcctagtccttcccaacgtcagtcagcatgtttgctctttgatatgaagctattctgtttagaacttgtttactattattcaaaggtggcattgtgagaaaaaaaaaagtcatacttctgcttggtctgccacagaaagctggaaggtttaaaatttcataggagcacacttttgccaaaggaaatggacatgacagtaagcattatttattggaaataaaaaaatcaactagcagttgaatatccattatgtataataatctgtattagaaagcaaaactataaaaattaaagcatttcctatgtattaaaaatgtttagggactgagataggataactgtatatatgtctctctctatatataagacatctatatatctatgtatatatataggatatctataggatatgtatctatcatctatctaataagatgtgaactaaatgaaaaaatcatttaatcatgcctaatattaatatggcctaatattatctagggttcattgggtgggacagagtggggttggagtgtgtggtggtatggaaaagaattactggggttggtgatatatgagttgagagttgcattttccagagagaaaagccaaaggaggataattcaggaacacagtcaaactgttgcaaaataatattgttaaatcaaaatatttgggaattggagtgtaaggatttttatctgatatgagttctctgggttgttgggttgtttcattatgcagccaaatgggaaaccactatagaaggagaatggcgtggttgtatttgtgttttgtaaggactactgtgacagcatggagggttatatattgcaagtgggcaaggctgtgaacaaggaaatcagcttgggttaaattcaagtttgaatgtttcttgccattttcttggccagtggttctcaaccaggagcaattttgcaccctggggagtattggcaatctctggagacatttttataagtcacaatctaatagtgtgatgggtttgttactgagatccagtgggtagatgatgatacacaggtcagtactccacccccaaacaaattatcggaccctaaaggggaggctgttggcagactctgacataggcaatgtgatagtcacagataataatagagaatgttatgacagggaacaaaatcactgacagtgtgtttattgagggaatttggtcaaggaaggagttctggataccacacctaaatatatattgccaaaggaagacagtagaaggaatatcaagaaagaacaagatggggaaatcaaaactaacagacttctcaaaaaatgctgcttcaaacactagagagacgaaaaaaacatgctatatattcccattaggttggtgaactttgaactgaccaatgatttgccttaaagcaagtttagtaggcagttaaaaccaaatgtaatggtcaggggaatgggtgaggagttaaataagtatgagcaatatgagggagcttcacaaggtttacagaaaaatggaattaaaagtaaaataaaaatacagactttatttctcaacataagctccatcaaaatcaagacaattttgtaagtgatgatacccgccatttagtccatccttaaagaactgaaggtcctgggaatttaaccatgtcaatgtagccttttttacattattaactgcaaaagtgtgcccttttccaacaaagaccagaaataattggaggaagaaactacacgagtttctgtcattccagggagagggaatggcaagggcaacagcactaagataaaaggatcctttgtgttcccaactgtctttaaattttcttctggcttttcatctagcactacacttgtctagttgttggaaacttcaaatcatttttgaaagaaaaatgaatgttcattgcatgctgaacatatctaggaattaaaatctctaatttatgtatgattatcagttacgttggttagaacacgatacttaaatataagaagtttcaggtttggtctttgcatgaaaccacgatcattttctggtcactctctgcactgttgacactgtccttaaaatataccctaatgattgttaacagggagtcaccaagagtgttggcttggtgcaaatactactaccaccactgaaagaggcaattcatattgtaagccattctcatcttgactcagtaacattacaggcacacaaaggagatactatattagcatactcaacttcagaatctgcactaattttttatcatcatttattccatatcaaaagtagtttaatggtggtttacactagaactaagaattatattggttacttggctccttatcaggtagttatgttgataaatgaaattatttccttccattgatatattctactttatcacaaacattgttatttatttgataagattctatgtgcaagatgtataatgtggtagctaacacatagctggcccttaatgataataatattattatgaatccaagctccagagagcagaatttctgcctcttttattttctgttaactgagtttcagttgcatagtaggtgctcaatacataattgttgagtgattgaatacacaaatgaaaaataatagctaatatttgaagacacagacataaaacatacaaatatagaatagttgagattaccatttttaaagaatgaataattttaaaattaaaaatataatcattatgccaaaaggaaatggtaaagctgtatgagaaattccattctattaagcaaaaataattattagctataattaattgaatgtttatcatgttccaggcatagtgtaatgtgatttacataactgaaactctcacaataatctttcaagttggcattattatctcagttttacaaatgagaaaatacattgaaaaggttaaactttgtgcacaaaggaaatgagttttatgatgtccaagtcattcctaagtacaataacctggtgttttcttctgtattaaaccttctcaatgacccaaagactccatcctctttttctgggaacttacgagtcctagctcatagtatggaagtaggagggtggaaattcagggcaattagaagattcattaaaatctcggggcacaaatacatacccttaagttagaccaccaaagcaagatgaccagccagcttttgctaaaaacagctaattcagcacctcagtaaaacatattgataggctcattggaaaacgaggagttggttttcacattctaacccatcttcctggatgaatgttctgcagtctctattgggcttatgaactcctcagactggcacttgtagagccagtttcccttttctccacactcttcccacttctaatcccaagaaaatgcttccttttccttccttacaactctaacccaggttaccttcctctaggatccaggaatcctgcctgggtactttgaccactttctatgctctttccaatccatagctataaagtagactataaattcagcttttctcagagcctactgttttgaatagcaaacactcattggggagcctaatactgaaactcacctatacgtttctttgcattactgttctaacattctaattctcactcaggagatttggattctgctgacgagagagagagagatgtattaaaaagtgcaaaaaataaatgcttactggtatcttattttgcacttattcaagatcacctacatttctctgaggtcaattgcagacatgccattcaaacttaataaaaatctgcagttcataaaaccatttaatttgcctctttttttgtaattattttggtattatctagagacagtctttgtttaaatttgtaatttaatatactctttgaatattttgagattttaatttattttaaaacaatttatattaacatttattttaacttattttacttgattctaacttaaattaacaattatatattggctgatgattaaacatcagtaatttacttcattatttgtttatttttataccttttgaaaataattcctaaagtattttaaagtgagttgaaataagacacaaaaaatcaaaaccaggtttaaaattaaaaatataattaaaaagaatagacaatactgaacaaatcctagtcttgagtttctgagaaatcatggtaaaaagaaagcattataaactatacagttcttattgtttaattaaaaggaatatatctgttttataaaaggtgaaaaaaagtcctgactttggaaaatattaatgaaatatcttctctatgaaaacttcggttgtaagcagtagtttgcaaaataattaaggaggaatttctacatggtcttggggaatatataacccagtggagatttactaaatttattcgaatgtaatttatttaaaaatagaaagctaggatatgtcttcaccagcagcttctcaatgctacagacgcttattaactctcttatttcttacccagataacaatttcaatgacaaattaatgtagctcaacgtgaagaattcagttgatataactttatacatgagagccattcaaatgaaaagaggactgtctagctggtcttttaggccaagagttgtgacccctcaaagaaattactctgatgttatcttaattctagccataacattttgtacttagtgtggatgatgtcaggtgttttactgagagtagttggctcacaggaacaattgagaggtatttccacacctaataacaaggccaagtattcaacaccagagatgtcagagatgtcaggcacctgagctgcagacagagctgagctgccatgtgtcagctaaagcaacaagaggccaacatgagagtaaacagtgaagaccttaataattgtttactgcaagagcatattcaagagtttaacactagagaaagtggtgattccctctgttacattcttactctgacacttctcgctagggaatgatgctcccatagagggtcagatagatcaggggaggtcacctcactgtcatgggaacttggaacacaaggctcctgcagtttaatggacttggggcctaagaagagggagagatgtagggttaggagtggaaaagtactgattattgagttggagtgatggggaaagtatcttcaaagtttctctctcttcagcagaggaacctgaagaagacctctggtcaaggcctaagataaggagacctaggaataaaggttcatgggctaggaaaacaaatatacataaaagtatggttggccaggggacactgtgtccttgttgcaactccttctagagagactgcaatgcacccaccggctaatcacccagtgtggtatggggaggccagctttccctcatgagacctgccaggtaaattcttcagagttgctgatgaccaggcctgaaaaaccacacataggtttttaaccggaagccagaatttttaggaagtagctactgctcttacatgctaaggccgacgattttatgtcgtattaatctaaaagctgatttgaattatttctgcaagatggattgctaccagacactatgtgagtctaaaggcattcataaaacataggtttactatgtttaatgttatcttaatggaactatatatatattttatagtattttatagttataaagggatgtacagtcactccttgcctattctccagttatatcagcccttgccctgaataaatcctattacagcaatttaagatatacacacaatctatctgtagacaactttacttttccctgcagtctgctagagaaacaggtacaattctggcttcatcttgagaacagcaggatttagataagctttatggaggctgagagttcctctgtagcctgtgagattagcagtaggctaaagaggatatctgtgctagaagaaaaggaatcttctttctggaaagcagtcctatacaaagttacggtgatctgacctggagtctcattttcaaaagggaggcttgcctgacattcctagccagttggcattagcctgatcccctcttgggcctccatagtccagttatccaaaagcagatactttggggctacaccaaaaactaggacaggtttttgtttttttcttttctttttctctttttttttttttgagaccagtctcgctcttttgcccaggctgggctgcagtggtgcaatctccgctcactgcaagctccgcctcctgggttcacgccattctcctgcctcagcctcccgagtagctgggactacaggcgcccaccaccacgcctggctaatttttttgtgtttttagtaaagacggggtttcaccctgttaccaggattgtctcggtctcctgacctcgtgatccgcccgcctcggcctcccaaagtgctgggattacaggtgtgagccaccgtgcccggcctggggcaggtttttattgaaatttattcagagccattggtggaaaaagtccctgtgaatgtttattaatccagagtttaatgtcaaagtttactaagacagagaggtaagaggacttggtagttaactcaagaaacatcgacttaaattaaagggaaaaaagtgcttactgaaagatgagataaatcagcgtctggaaattcagagggaaacaaggttgtagtaaattggaggctaggaaacaaaagtagtacattaaatggggattcgattataaagcagcaagaaacagctgctttttcattatttgaaataatgaaaaagatttgaaagattatttgaataatctttatctgtatctgagtacaatcttctacgtcatctgtattttagatctatgagttttaaccatatctagctggagactctggctatatcctataaatatttgcatatattagtcataagagtgggttgatagtcatggctaatgagtagaaaaactccctcatgacagatcaaaatgctaagcccttgcattgcatatttgtggcatgcaaattcatactaccttgaaacgtagaaaactcatgctgaaaataggtccagaacagtgaaacctaaaagatcctggtagatatggatgtgaaactgtttctgggaatacctccacaactgatgaatttcataaaaaacaactgctgtaggtattctaaaattacaaagctcatatagaaacaaattgccttgaaaaagtcaacaattacaaaaagtcataaatagtcacatggattatacaatagcaaatgcaaatagattgccaataaatgaaatttaaatgttcaaagggaaaaaaaagaagaaaaagaaacctaatgtgaatgtcagatcattattaaacagaataacaaatttataaaaacaattgagtaggaattctagaaataaaaatatgatctttaaaataaaaaaagaacatatgaagggttcaacatgagactcaatagagtaaatgacttaactaatgaattggaagacagatctgaggaagtataaaataaagatataaagacacggaagacatgaattagaagttaaaagtgaaagagaagtaaatgaaatgctccaaaatcccactagtgagaattagtaaagaagagaatagagcaaataagagtgagaaaatatttacggagataacataaagtttttttttaattatagaaactgatacgctctcatatttaggaaaaacactctgtcccaaaaaggataaatacaagcaaagccacgtgttggcaccttatggtgaaattgcattgcattgataataatcaaagaaaaaaaagagcttctaaagagaaaacacagattatctacaaaaagttataaaggggcatcaattttttattagtaaacaatagattcttaaatatgatgaaataattcctttaaagtgctcaactaaagaactgtcaactatatgagaaaaactcattcaaaagcaaacatgaaataaagaattttttgagacgacaaaagcataaatgttacatgttgaaataagcagcatgcaattgcatctacatgttcaatagagaacaagaaaagagtgagcaaaataatgtttaaattatttggtatttggtaaacttgaatataaatcataaatttttaaaaaatgctaaaagtttgaaaacattataatatggaattgtaaaaatgaaagttggtgctgatactttggaaaaaattggcaatagtaaagttaaagattaatatatctttcaaactacaatgtaacttcttggtctatttgggtgttaaacacagatgtgactaagaaacctctacatgttccagataaaagaaaatgacacagcaaaagggttcagagagtggcttagataagcaatagtaggtaatgagttcttgttttctgaggcacgactcaagctcactttttaattttctattcaacaataaaaatacagtttggtaatattttgcatacaaaattttaagggtcaaaattgtaaaatccacctcaggtttccaggggagaagctctagaatagagggtttagtgattttgcatagaggttgcctgtaaaatcctgttaagtagagaatcaactaaaatatctttgtgataggtattatgtatttctgaaactctttaatctatgtaataaacatgtccatcagattggaattgatatcctaggtaatagatactttttctgtaagaattctattttgttttggagattttgtgctatattggtactaacatgtcaaaggaaatatagaaccctcttgagaactaatgaaatcaattgaatatgacaggaaattatctatttcctggatgactgctgaccctccaagaaaatctagtctttaaatcaatattaaatactaaaataaataagattctgtgaagtattggagcagtacagttaaatatattgttgatctctccaactaaaatcaaagagacatctctaaaaaaggcagaccacaggccaatagtgaacaaaaaaagggaccaactatagtgaataatgtatcatagggtggatataagaatattattttgttaaatatcactagtcattttgtgtttttgtttgtttgtttgtttttgagatggagtttcactcttgttgcccaggctggagtgccatggcacgatcttggctcaccgcaacctttgcctcccgggttcaagcgattctcctgcctcagcctccctagtagctgggattacaggcatgtgccaccacgcccggataattttgtatttttagtagagactgggtttctccatgttggtcaggctggtcttgaactcctgacctcaggtgatctgcccgcctcggcctcccaaagtgctgggattacaggcatgagccactgtggccagccgatatcactagtcattttgaacaactatatggattatggcttctcaggtcttatacaaatgactatcctttgtgttttgacttctttactagaaggtggagatatcacaaaacctgtatgtagtagaaatattttcaaacaaaatcagataacttattattcctccagttcctgtgaaagacattggtcctcacaaacactgcaaaaattagtagtaatgtttaaaaaggactacctgaattgtgacatctattctgcttgtatctataaaactaattggctattggttctaataaggagtcaccatggaatactatgcagccataaaaaatgatgagttcatgtcctttgtagggacatggatgaagctggaagccatcattctcagcaaattattgcaaggacaaaaaaccaaacaccgcatgttctcactcataggtgggaattgaacaatgagaacacatggacacaggaaggggaacatcacacaccagggcctgttgtggggtggggggaggggggagggatagcattaggagatatacctaatgttaaatgacgagttaatgggtgcagcacaccaacatggcacatatatacatatgtaactaacctgcatgttgtgcacatgtactctaaaacttaaagtataattgaaaaaaaatagtaagctggtgtaaacagatgtctgtttggttcattaatcatttctaagtaaattacattgacttttcaataccatttgcctactaaatctttctcagaatagtaacatggatactgtcacatggaagaaaagtaggtttttagtcaaggatctagtagttacataagtattcaaagtccagcaacttcaagtagctacaaaatattcctacttattcatgctctttattactctggggaaacagttaatgtaaactgtcagggtatgtgtttgaaatagtagcacctatatttaaatttacaaactttactttagatagttcattttgtgtgtctaggaaaataaaacatatgagtgtcattgcaaccatcactgaggttctaagtgagcccctcatcagttagcatttttcacaagttgtgcagaataagaaagagaagaaaagtcttgcactaggtagggttctctctataataataaccaataggtataaagagatttactataaagagttggctcacatgattatggaggctgagaactaccagaatccaaggtcagaaagacccaggagagccagtggtttagttccagtctgaagacaggagactgatgtctgtaagcctaaacagtcaggaagtcaaaattccttcttactcagcctttttgttctactgagtttttcaatttattgggtgagtaaagcagaatgctctgctttactctgtccacatattaaaatgccagtctcatccggaaacaccctcacagatataccacacaatttttgatcaaataactgggtaccttgtggttcgatcaagttgacacataaaattaaccattacaagtatcagggggaaaaggaaagcggaggtgcaatagaaatttgaatttggggctgggtgctatggctcatcccagcactttgggaggctgaggcaggcggaacacctgaggtcaggagtttgagaccagcttgaccaacattgtgaaaccccatctctactaaaaatacaaaaaattagccgggcatggtagcgtgcgcccatattcccagctgatcgggaggctgagtcagcagaattgcttgaaccgaggaggcagaggttgcagtgagccaagatggcaccactgcactccagcctgggtgacagagtgagactccatctccaaaaaaaaaaaaaaaaaaaaaaaaaaaaagatatttgaatttgggaattttgggtttttctcatattatgtcatttaattttttcaggaaataaatttaaaattctatatgaaattctcattgactttttgagaattcactgaatcaatcaatgaaagtatcagagattttgtctcttttagttctaaggctctcatcaatgaagaattttgttaaagccaaaaatacgaacatggaccattataattttttttcttgcataaaagaattgtactcagtcaaatgtagcaagtattgtaattgaaatgagtgtatatgaaatgacaacattcacagcagagacttggaatggtcctagaattggttgtcctcagagttgtctaagagttgacagagagaagaaaatatgatgaagccttttcaacagatgaaacaagataatagcatggcacagtatgtgacacagggccatttgttagccattcatctgaaacatgactaaaataatataaacagtagtctgaatgacccagttgtaaagttgtgaataactctgtcaacaaaaatttttgcattcccacagacaaaccactaaataaagacaaatgtcaacctctcagcaattgcctttcagttatgaagaataaatggctctggatagaaacaatttaaatggctgtaaaactgatattaaccacatggctgagaaacagaaagcaaagctcccatttgttgcttggctggaacatcccaaggcagatgagatttgcaggcccagcacaaaaggcctcttagggacatgatggatcttagtccattggcttcactggttaaaatgtagcatacaaatcttggtgggatctcaagaaaaacagttaaaagggaaataaaatgcttataagtatgtaattttattaaaacaagttgttacttttataaaagacttctgaaataaagaacttgtcaaataaagagaatgatgaaacttaacagctaaaatttgatcattgattggtgagctgttcctgtctctgggaaggtaaaacagaatattctctttcttttatgagttatcttggactctagaacttttagaggttcccctttatcttttcttttttggttattttggaaggcaaggcttataaaaatataaaaccttttttgagcgatgttatgagatgggctcaatgttggatacagctaaggcaagaataaaaatgttagattatcttttctcttttttgaataatttaatgaagatgtgaattgttctcaacagctgatcatatgagataaggaaataaaacgtggttaaaaattatcggaggccatcagtatagctatcattacatctgatgttgcatcaaaaatcttttaaagaagataggatgaactgtggaaaaacctgtttggagaaagtgataatagtactttcacaatatttagttagtcagtagcatattttaaaaattaaagaaaaaagtgcacatatttcaggatgtgctatattagccaacaagcattttctgccaacaatcttcctagagagttgtcagagaaatctaaccttacaaaagctgccagttatttataaaacagtggcttaaacctaaaggataccttggttgtacagaacagactccagattactattaataaatgctttctatgccgaattccatatgatcaaaggaatcagacacatgttttgctgattgctgcatacctacagaaaggatatcttaatgttaaatgttgcagatttggatgatacatttgaatctctggatatactgacacccataactcctaaaagaaaacatcaggactgctgttcattatgaagcaactcttatgttctgggcagaacccacggaagagaaaagaaaatggagctaacagttcatttgttttcttgccttgacatttttcaaggaaacattaaaaaaaaattttaggagtagtaatctcacttaattttggcaggatatattcctatactaagctttcctcttggtggttggaagtcccatttggatcttcaaagagccctcttctcacaggcaatcagcatcattagataatcactcaaggaattttgtttcagcagcaaaagaaaatttccaagtaaaattacttaggagaactctggaataaaataaattgaggttttctcatattttaatttttctaaaaacatatttgtaagaactttcactttttggcaataatacagaacagaccacccagcccggtcttacaaatttatactatcaaagatggagaggaatgatgcaaatagcatctatgttcatgtcaatactacatgattaagtaaagtgaacatcttttgaaatcagaatattgttttcttttagatttctgataaattatttttagttttattttattttgaagttttactaaacattaaaaaatcagtacagaaaagatgagcttaagttaattgaatgaaataattttactgacatttttctgtctgatatgagaaacttagcactttaccccttcttttgtacaaatttttactataatataaaatttgagattttagatttacattcctattcactatgaatttttattttaatgattattttttgaaattgcatttttacaactacagtgagatacttgggggtaattttctattttaggttttctgctaactgttcatttgtagtactactacttatatacattttattttttgtaacactttattttttggagcagttttaggctcacagaaatattgagtagaaggcacagagattgcatacatacctgctgcccctacagctgcacagactcaactcttacattatcatcattcttcaccatagtggtacatttgtcatgtttgataaacctataattaacacattatgatcaatcaaagtccttagttcacattaggtttcactctgggtgttttatgtactataggcttgcacgatgacatgcacacactattaaaggatgagactaatttcactgtcctaaaaatctttgccatccattcatcctccctgtgcaacccctggaaaccaataatcttttaactgtcgcctgagttatgttttttccaaaatgtcatatccatccagtatttagccttttcagattagcttctttcacttagcaatatgcatttatggcctttccatatcttttcatggcttgatagctcacctctttttagcttaataatattccattgtctgaatgtactagagtttatttatccagtcacctactgaaagacacattggttgctttcaattttggcaattacgaataaagctgctataaatgtccatgtgtaggtttttttgtggacataagttttcaactcctttgcgtaaataccaaggagttcagttgctaaatcctatggtaagggtatgtttagttttgtaagaaattgccaacctgttttccaaagaggctgtatcatttttgattcccatcagcaatgaatgagaattcctgttgctccacattcttgtcagcatttggtattgtcagtgttctggaatttggccattctaataggtgtgtagttgtatgttcatgttgttttaatttgtatttccctaatgacataatgctctacatgctatacattaaatatttgtgttcccccaaaatccatttgttgaaattctaacacccatgacgatggtattaggaagtaggatctttaagacatgattaaattctgaggctggagcctttattaatgggataagcactcttataaaagaggccccacaaagagattccttacccttttaaccataagatgttatagccaaaagatactgtgcatgaattgggaagtggaccctcgccagacaccaaattttctgatgtctttgatcttggactacccagcctacagaaaaatgagaaaatctgttgtttataagccacccagtctgtgctttcctattatagaaaacaaaacagaataggacagtgcatttttgagttctttattttgatacacatttcaccgagaatatataggtaggtaaatttcttgttaagggtcttagcattttttagaatgtcttttgttttatttgagtaatagtggatctgttatgcactgcattcaacattttttatgaattagcaagaaaggttttatttcactagcctcacattctgatcccatttttctcacttaatgaatttatgctatagcattatataggtaagatattatttaatctatcagtgattagcatttttcttatttagatggtattacataatagcacagggtataaacacctgaaaattacacagaaaataacaagaggagcaatttgagcagtaaaaacatatgtactatgaagtaactgtagtattagagaaaaatagttcttaaaatcagacatctttatttctacttctttttctatagacagtacaatgactatataaaatgttacaatgcacatatagatctgagttaagcaatgtctattatttttatttttaaacattttgtcattttccccaacactgtgaatgctgctttgaattaaacatttcagtagaaatcaaagacatgtttatacagcttgagctgcaacagtttgccttataaaataccttgcaaataaataatgatatacatatttttgcctaaactcttcaggaaacgcattgagatttaaagctcctttcagacaatgaccaaagcagacaagaccctctggagtcctctattttctgaagtgttccagcacgatgctttttgatgatcagctgtttccctgtgtgttgagcttaacttgttgggttgtattttccttgttaaatgtcgaactttttattcgtttacttgttttacaaacaaaattacaactactcaatctcttcaattttgacaatgtcttaccaacaaaattataactactcaatctcttacttattgaaacaagacaaacaaaagaaaacagcataattgaagatttagctgaagagaaagtaattagaaacatgccaaataatttcatacctaaatcaaagaaatgccaacgtgagcatgcacattgtttgtacagttaaagcttctcttcataatttgaatgcagaaaatacttatgagggtttaaaagggatgaaagagccacattcctttgactaataagcttgtttataaatgaaagtcaaatttaaaacaggcatttttgttagaaaagatgctgttttatgcaaggttacaaaaccgtaagtagttatggtcagggctcttctggagaaagaaaaattgggagtcaatttggaaatataatcatccttcctaataagaaaatgctgtcatcagaagggtataagtcattcgttcctcatcatcaaaatctacttgccttaatttatctgaaccatgccagcaggtatatatctatagaaataaagggattgaacaagttgtcaacttacagctttgacaatactgctaatcagaaactcagcaagctctactgtatcatgcttcaatcattggaacaataaagaacccagagctttagggtatcacaagaaaaatgtcagaacaagttatacgtcggcactgtgaggcccagagattgacaatttaattaggattaatggtaattgtttttaaaagaaaaaatgaatgctcagataatttccttggaagttcaaacacaaataaacaggacaactttactgtttagatatatgattctttttattatacaacgagtataaaactgaggtgttacatgagacctgcctgctagagatagagataaactttgctcgaacctccaaattttattacatacgacagtcgagggactgtctcaaaaccttcaaaaagtcatgcttcttttgtttaagtggctcaatcccactcccaaacatcccctccctgctaaaaaaagaaaagcacacaagccattcccatcaacctgtttgtgaacttaataactttactaatggcttacaggtatacatgctttgcataatgagatttcattgtgaactattcttaagagctctatatccttcctttctactatcatttattcttcttccttttgaggatcaacacaaagttaccactttatgttacatagaaacatttaaaatctttgatgtctcacattgaataccaaaggccttgtccagtattttcccccatcaattatagttctctttctaagtgtaatactgatgacagctgttaataagatataaaatagggtatttaaacattctgaaggaaccttttagaattgcttcaggaaggtatagagcaaaaagttattgaaataattttgagaaattgttttaagttggaagtacatataaaatagcttagtgaagatgatgtaaaattgatagattgtaaagagcaaagaaagcacacatcttaatcttcttccatttttctcaaactcaaacttttttagtgcaatatggtttaagaattccaaaatattggtttcacaaggagataataagaaactaatgatgtatgtaaatagaaatatgtttccaggtcttgattatttccatttcataactccaaaatagactttcaattgttagaacagagccactattattaatctttgagtaattacgggaatgacatggaatttatgtggcatttcaaaatggcagaaaagacaaatggatcgtggaacagtaagcctgaagtaaatatcttagaacattttataatataaataaaataagtttgaatactaagaaaataagaaattacagtgaggaataataatgtcttataaggaatattaatacctaattaatattttctttctgtgaaatgttttcttgaacattgctttaaagcaatgccaaatacagtatttcagataagcctctaaatatttagctcttacagacaaaattgaataaaatatacaaattatatgacagtattaattaaaaaaatgagttgaatctacctagatacaataggttttaaacctatttttaaaaatgagttgatgtctacctagagagaatataaatgctaaacatgtaggtattatatgtgatttttccatggatattttatgatttattctacgattatcttataatttgataatcatataaaagtatattccgtgaatttttaggtaaaaaaatgctgtaaacaaacagctaatgtgttagaaatctcatcaatatttatcaggttttcaaaggatcaaattatcatccaaaattaaaagaaaataacttagttaatatcaaagaacatattgctctgtaataaatttttgaaaaatcctacaatgtaaggaaacttggcaaaacagcagtccatgtgtgaaaatctgagatttttagatgactgttatcccaagatgacttttattatctattatcccaagatgatttttagatgactgttatccaggctggtctcaaactcctcgtctcagtgatccacccacctcaccttcccgaagtgctgggattacaggcataggctactgccccaggctaagatttttaactacattgatattctctgtattattcctctgagagcttgagaatggtaaggatcagaaatgaagtaaaaaacaaggtctccaatcacatatgaaaatacaaaaattattctgaaaataactcccagttacaatgctatttcaaagcacactttttaaaacagcaaagtgcattacagtttttaattctaaataaagttaaaagtgaaaatatttagaaaatttaatgtgattttcttactttgattttgggtttataccaatgaagcaaatataagctttttgtcttattttgctgaaataatttaaaaataaagaaatacaacacaattttaaagcagtacctttattgctttttaaaaaattttccagtggattaatctgtttatattattctaaattaaattagcatagatgcatgtgtgtgtataatgtattatatagtttatttgttctagcaaaattatttctattagtgcactgccactaaaccattattacagacagaataataaaaattgagtaaatttttaactttaaagcaaaattcatgagagcaaaaacaacgtaataaactatcacaccaacgtaattctaactctcacatccacacagatatcttacctgcaatagctatttttcagtcgtgttttatcttccagctgaaaatgacagtgaattaaactgaccgtattatatgctatggtaatcacatattgtctaaaatgttattctaattgagtcattttagaatgttttcattatattttcctattacaaataataaaaacaatgaaacactgagtccttattatgtgacaggcacgcttataaaggctttatgtgtattaactcatttaatacttaaaactaactcttcccctattagataggagtctatgatgatgagaagtctcaggacatctacgtttgttttataatatagtttgtttcagaatgccatgaatttattttactttattattgttccttattttgtcagctttacagaataattcctgaatataatcaatgcaaatttttggtttcaaaaattttattctgaaataactcaaatgtccatcaacaggaggacgtaaaaacaaattgtggcctattcgtgcactagaatggaactgagcaatgaaaagccagaaattaaatgcatcaacatgaatgaatctcaacaacattgttgagaccaaaagaaattagaataaaaagagacgaaattgtaggcttccattattaaaaaagtttccaaataggaaaactaaactaaaatgaaaaaaacaaaatcagaacaactgccaattctggagatttaagggggaatggtgaaaattgactagaatgaaaatacagaaacattctggtgagaaaaaaattcttctatgacaccctagggttatgggttatctgggtgtatctgtttttcaaaactgtaaagctaacctttgtgcattagaatatgtgatattttaccttcaggaaaaacaactgtaaatagagtagttatagtagtgattgagatgtggagagtagacagcggtataggtggtagatgaatgaaaaatgttgataaaagttgagtgatgaatacatggggctttattttactatagctttattttatatacttggaatttttaatttgaaatataaaatttttaaaaagccatttcaagtgttttccctaaaggctgtaggttactgtcatcaatacttggttaagaggtacataaagtttcatagtattaacaaataaagcattagataattataggaaattcaaaaagaaaatttaaactaagataaaactagctctaagaaaggaggggcccggtgcagtggctcacacctgtaattccagcatttggggaggccaaggcgggtggattacttgaggtcaggagttcaagacaagccttaccaacatggtgaaaccccgtctctactaaaaatacaaaaattagttgggcatggtggcatatgcctgtagtcccagctactcaggaggctgaggcatgagaattgcttgaactctggaggtggaagttgcagtgagccgagattgtgccactgcaccccagcatgggagatagagcaagactctgtctcaaaacaaaaaagaaaaaaaaaaaccaaaaaacaaacaaacaaaaaacaaaaaggaataaaagaaaaaaaagaaaggtgggtggaggagagctgctttccttgatttgtaaatttctaataagcagtgattttttttttctttttttgtgaactgaagctactcctgaaatgagaaatagacaatgcttctagcttttttccagacttttagactttcacttgaacagtaatttcctgtatgtgtgagatacacagatacatagataaagccttttttttttgcaactatctcatcaaatctcgtattcacaataaagttatttccatgttgagtacatggtcttaataaaaatcgtgttatgaaagcatacagtgggttgtgtaagcagtgtgtgaatattggtttcaatattacactattgtatttcttgataatgctagagaaaatgtaatttgcaatgcatttatataagggctaaaataatttgtggcatcatttttattgcgcattcatggctcatatcagtttaaagcttaaaaagctgtatttttctccattaaaaagttgtatctcactctaacattgcatttcagatttatttcagtgcactaatcatagtaacagaaatgccacttattctaacacatttgaaaaaactgaatggactcattatttggttattatcaacttttagttctgaattcctatgggttttcatgcaatgcactctagtacattcagaaacaggagagagggttatattcaggtagaagcagtttggctaatgtgttggatattttacagctattttcttggccacgttataacattctgaaaaaaatcacagaatcatccatttaacacctcattttagactgtgctgtgttctaaccagaggtcagcaaacttttgctgtgcaggatcagagagtaatgttttaagttttgcagaccataaagtctcttgattcaactcagtcattgtaacaaaaacagtcataaacaatgaaatgaaaggacatggccatgttctatcaaatctttatttacaaaatcaacctgcaagctgcatgccaacctctgttctggactcatgcatcacaaacttcaatgtgcataaaaatctacaaagattctcattcagtaaggtctggtgaggagcccaagaatttgagttttgaactgattttctgtatgatttaagctacatgacttaaacattgtgcacctcattttctatagctgtaaaaagagctcaagagtttcttccctacctgctcaacacattttgtaaaaattgagcagactaatatatgtaaaatttaataagtagcatacagagtaagaaacaagcattatgaagacaacgtattgaggatttcttcccacttgactactttttcccagttctgtacaccagaatctcaatggtgtaagtcataatagagccataatagggtctatttcaaatacccttctttcatagtttccaagaacatgttaaagatttattagtttccaattgttgctgtaacaaactatcacaaacttaggagcttcaaacaacacaaatttttcctctcaagtgctgggggtcagaagtttaaaatgaatcttatgggattaaaactaaggtgccagcagaacagattccttctggaattttgaaggtggtacctgttccctgccttttccaacattagtggctgccctcattcttttactcagggcctcatatcacatagcctttatcccttttttttctcatataactttcttttataaggacccttggataattcagaatcatctcttcatccccatatccttgacttgaccacatctgcaaagttctttttccatgtaaagtaacatattgataggttctgggtcctaggacatggatatttttggggaccgtgattcaccctaacacacaagagtatgaacaaggtaaaaataaagtcggggggtggggtggggaattgagttttccatagaaagagaatgataatggacagaacatagaattctgaaactttcctgtcagagttgccaatgtttagggtcctagagcagagaggataaggtgtcctttaagaggaggctttgtcgaaacctgaaccaatagcagaagggtgagatatgcctaactaagttggagagtttttggtctcggtgataggcaggcctagtttgcctataaaactgaaaatgggctaatgaacattgcagcaccttttcctctaggcaaagtcctctaagcccttcagccttctgtgtttaggttgattgtgtcaaccttaataacagagagggagactctctaaaagaaaatggtatgtatttgagaatcggcattgcaatgggaatacacaggccatagtaaactatgtgcatattcaggaaggtaaaagaagacaaagcattttaaagaaaaaatgagaattacataattattttgagataattatacttggcgacaaagattaataacaagggtggcacaagtccaagtttggacaggcagttgcttggcagatgttctcaagaagcattgtgtgtgtgtgtgtgtgtgtgtgtgtgtgtgtgtgtgtaagtttgtaattacatttgcacaagattgtggtttttgcagtcttctgtgatagtttttgttatcaggcattcatatataagaaccctcacttcatggccttccccagctctatttgtcagggttttaacacaagtgactccattttgattcttacagctttcagacatttcctccttttgatcaagatctttacccacaacccacaagcattgatgatcaatttcctgtatttaagttttgattgtcccttggtgcctagatgaacctgtcctggttggtctggtctggtcccacatcagagacagtaattgatgagtaagtcagtgtcaaaactttcttatctacatttgagcaatttcaaaggaggtatggaggtagtggttctcaggctaggtctacctgggtccatggtaagttcaatatgtctgttccacaggtattgattatcatctcaaagtgctaggccaacattactctcataggggttgtacctctggaaaaaattaatgagtaacaagaacaaaaattaaaaagaaaaatacaaagaaaaattaatagtgatatgataatctcagtttacataatagtttgagctataaacctgggcttaaaggaaaccaattaaataaatcaaataatcatgggaaattaggtgacacttttttttttttaaccacgtggcctattttcttactttttttgtatatagacctcacctttccctgagggatttgtccagatacagcatgtaatgttagtaatagcaaagacatttccttgtttaaccaatagattacatagagcaattttatcatctagtatcccatgactaggctgaattcgagcagagcgtgagcaatggctgtatgagaaatattgccatactcacccactaggtagactaaagcatctcatagctcaggttcagtcaagttaccagcagaagctactgaatgtgaaatttcaattacaccattatcctgccaagtgtaaaaagtaggcgttaaaaggggaaagagtctcattatgatatggagtcttgttccaatgtcttggaaaaaagctatctacagcatgcagctatcaacttatcattctagtttgcagtttgaatgtttctggttatggcaccaggcagtttggtgaactttctgtgtgacccatacatcaggcacgaaacttacctcttagaattcatctggtttcagcttatacagcttcagtacagaccagttcccatttttagtaatattacggaagtgttaatgggaggggaatggagtttataacgagcaaaagactattcctaggcaagttattagaggagtacacatgctcactagtgaggaaaagcccctaactcagttatctccggttagggcttactaagtcccttctgggtcagaagagcccagccacaaggccaagtgcagccactgtggccatggttctctttttgctgactgtcagtatctccaaggattctatcaatgggcagcatttctaagatctctttcctggggggaacccttacctgctcatgtctggctatgtgcctattctaacataaaaaggttggactggagaaatccagaagaattcaggatctagtcagtttatagtaggtaataagaactctaaaacaatgcctagggctaaagtcttataacaggtgttttatagcttttctttagaaacaaaacatttttctctttacattgatcagacaagaatctcagatggaaaaatctttccaggcttggaagccaaaccaaggcagatttcagattttaccttcagtcttgaagtttctaggactgtcaggaagtgacaatttttattcactgacagtaaggtttggaacccttgaagctgggcattctatgctagttctcaaaaaagatattccagttaaggctttgttttataattaatgcttccgattgtatcattttctaaagagacagcaaaattttattaaacttatacaaataaacatattaccacaagaatacccacacatagtttccaaatttcagagggatcaaatagagagaaaaagtaaatgtttccacctttattcacaaaaacagactttaccaaattgctgtattaactacgatagcttaaaagaaaaagttttcttaaatttggaaaataaaacatttaagttaagaatcaatagtttcaaaaaagtcataattttttttttttttttttttgagatggagtctcactctgtcgccaggctggagtgcagtggcacaatctcggctcactgcaacctccatctccagggttctagtgattctcctgcctcagcctcccaagtagctgggattacagacgtgtgccaccatgcccagctaatttttgtatttttagtagagatgggtttcaccatgttggccaggatggtcttgatctcttgacctcgtgatccacccacctcagcctcccaaagtgctgggattacaggcatgagccactgtgcctggcctcataaaatttttatcttcatcagttaattaatctctgtaattaatttttgttcagcttgatattgtttggaagtttctcaaattggtcaggttcatcatttcagaaatttttagagttctaagaattttttatgtcatcctttgaccttaaagttactagaaacctacacttaagagtacttcttagtcttttacatgcatctgaaggaagtgcttttagagaaaaatcaaaactgtagatgacagagacagatgagccatagttaaaaatctgatggaagtttgttataatcagcaattgacaagaaaatttggttatttttgtaatatacaacataataaccagaattatgtctgatgccatattaggtttctaaaccttttatgcaattttggattatccatatcaataacatacccataaatgtaattgaaagaataactagcatcacttaccatttgacaatgtttcctacataattcaccaaattaatgtaatgatctaatatctctataggacaagagttccattttttgaggctctctcaaggcccagctgaaaaatcccaaagttagttctaggtcaaaaagacttagaattttgatactgaggaagctcatcaaagatgccaaaaggttcaaaacacttcatcaaaacaggactgcaggtaactgtgaaataatagtatttctttaaccagggtgataatcaaaataaataaagtacatgactgtaaaagcaaaataaaacaaatttaactttttcaaagttcagctttcctaagttatcaaaaaatctaataaaggcaacaaaggaaattatcttgataaaacatgaaatccttgtttcgtaggcctgttaccaaaaaagaaaaaaacaaatctactgaagagtgattgcttctccttaaagaaaactcttttaggtaaactggaaagtaaacctagtacttaaatttaatcagatgtagtaagacagtgtacaaggttatgattgtacaacataatacacaggaatgtaaacagaaaattaggaccttgagcaagggaatacatggctcttagtaacagcatgggaagtttcctggttacatgaaaaaaaaaattagacacatcaagaaatgccaagagcacagaatgaatttatgcttgaggaaaactttgcttttttaggccttcaagaaagaacatttcagcatcaggccataacagcagagttaagaccgaagaaaaaattatgagagctgatgaaaaagttgaaggaaagagttatgagcacagccaagcaaaaagatgtaccttctcaaggggagaaagaggaagaacaaaaggcaatgatgtatgacctgcaaatcacataaagttagataaagcaaaagttgaacttctgagatagaaacttgagaagcttcaagaggaaaaatctacctcaagaaatgaaataatctaaataaagacagaattttcaatctaaatccagaaaaattaaataaatctcaggaagaaatatggcacaaatagaaactgtaaaacaggaagaagctgcagtttagaagatggttgaatggttgaaattttttttaaacatatttcggaattaaaccaaaacctagcaaattttactaagagcaaacacttcaagaaaccttattgtttgaacacaaggaaccaaattgttagttttgtatcagtgtatttttaataccaaagctcagtctttagaaagacacacaaataattctcttacaattatagccaacctgatcacacacaaatttccatcataaattcatctttcacaaaccttccatcacttattcagacattccatgacatgagcagaacttcagctttgtcctacacttcctctttcttacataaccagtcatttgactttaggacaaaaatttaccacataagattctttctcataaaaaaattattatttttttgtttttaatctaccttaccaaaaatgcattttcatatgtataactttcttcatatgtctttgttctactaactggttcctctccatcatgtttctacttacttccttctaagtccatattttgatacaaacttttaataacctctgaatttagacaaaattattctttagttcagtaaagaacatatttttatttccttcttatactttctcttatcaaaaacatctttttgggtcactttctatacagtattatatatacacattagaatttttaacacttaaaaacttcttttctagtgaaaacctaggaagcaataaattttgcactgtgtcacttatcagtattatctagataagaaccattttataattttttagaaacatgcttccctgtaacataattatgtgaattaatagactcaaatatatatagtttttctataaaacttaagaagtcaataacaaatgtatgcttacatttagaaatttttgttttagcatttttttcttatttggaagtgacttagacatttaatgagtatctatcacttaatttaaaataacataactttagactttcaaacttcaattagcgattcaagatggctgactacaggcatccggtacttgcctcctccacaaagtagaaccaaaatagcaaacaggtaatcacactctgagtagatcaactaatacagaacaccggcgttcaatagagaagtgacaggaaacacctgaagtgtaagggacacgaggaacacagtgcagcttgctcagcaaggatcagctggcagcctggagcggctccccagtgtgggcaaagggtaagtgagtgaccccagtggttcacattcccaccagagactcacatcatagccatagaaaagcccctagaccctcggagtccctgagactaacataggaggctgcttggagaccacacaaaggcattgctcaagagagggagctcacactgggtttcacacaatctcagcccaaagcaggtacagccatattgaaagcccagcccccaccagaaggtaccctaactggggtcccaacagtccctgcatctccatatttctgaaacctcattgacattccctacccacagccaccaccatagctggctggctgctacctccagggctaaaatgtgagccgttggcaatgaccccgctgtcctcagcaggaagccaccacacattttcacgtgcctcaaggaagccgccaaacattttcacatgcctcaaggacaagcttacctgccccagccagggctgaaatgtgactgaagtaatactccccagtcacctgcatatgactgctgcttctgaaagtaaccccattctccccaatagcagggccgcagtgcagccactgccacccctactcaagcattctgatgtgggcctggagattaccttgagcctgcctactacagccagtgcctgttcacagcatgtaggggcctgaagtcaggctttcctagcctggctctacccctcagtacgcggccactccatctgagagcctgggaactacccagctcagtccaccattgttgacacctgagtattgctactggggcccaaggttgggcccatccagcctgccactaccaccatagcaggcacaggcccacatgcaacagccgcaggctggggactggtgcattcggcccatcacagccactgccaacaccagcacagaccacttgggactcagaggttattttacatgtacctaatttagctttaacaatcatacttggattacttatgaaaactaagatattaggctaagctagtcatcatttcaagttatttctctgataactctttttctagcttatgattatcaggtgatcacctaagtaagaatctgaagtatatgggtattttgccaataactcataagatatagttgtttttattaaaccaatactatgaaattggtcttatttatcgaagtgttatacaaacaaaaatcatcctgtttttaggcttggtttatagtttcatgattttaaaacatttatcagggacatacataaaagtgtctaaggtccgggcgtggtggctcaagcctgaaatcccagcacttcgggaggccaaggtgagtggatagcctgaggtcaggggtttgaggccagcctgaccaacatggtaaaaccccgtctctacttaaaaaatacaaaaactagctggtcatggtggtgggcgcctgtaatcccagctactctggagactgaggcaggagaatcgcttgaacttgggggtgaaggttgcagtgcaccgagatggtgccattgcatatcagcctggacgacagaacaagattccgtctcaaaaaaagaaaaaaaaagtgtctaaacagtaaactcaggcaaaaatgtacagtgacaattctgaagatatttcaatttttattttgacaaattttaaaacagcttactgatcaaagatgcttcagtcatggaaattaaaaggcatttaggctaattgctatattttttaatatgagcactcatttatctaaaccaacctgtataggatcccttaaggagttttgagctgactatgccagattttaccatgtagataaaacatacaagaggcataaacatatatataaaaatttaaataaagatcctatagatttccttttagaattttaatcatgagacagtaaaacataataatataaactcttcagtttataacagacaattagagctgaattatatttctgataatacaggaactgtttacgtggctaaaattttgccctgataggtaatgtaatgaaggttgtggaccataattttgagtaaagtaatttggtttaaaacaattattttatcttttttcctctgttttgagtttttaatgagtttcagtgttaaatttctaaatatttacactttagttaggactggctatttttcttttgttataagaaaaacaaaacatccaagcggccttggatttttaataaccaatctttttgtttgttgtttgccagtctggttgtttgactagtgtcaatgcagggcaggatgcttttaagaaaaatatttgcaggcttttttccccctctcctatgtggcagggaaagtaatctttatgcccaacagtaataccttatgttatggctctgagctcaagattttggcctgtttgatttgaaggcctaacctttataaacttttatctagttatttccttttagaattaatcctttgattaattgtttcatcatgctaagcaattgttagtctagcttaatttaagttcacatttccaaaggtgtctagattgttggttgctaaggagctgttgtaatttgtaaagtcattaatttgaaagccctttaagactcttatctcttattttggtttgaaatgccctaagaaaaacttctaagtggcttttgaaattagcagcattacattatcttaatacaaataaaaacgtcaacagattcagagtaagtagaaaaaaatatacaggcagaaaacttagacagctctacatgttaactgtatagttggttgcactttctaattcagttctaagagaaaaacaacttggggagtgcaaacgaaccccatgatggcattgattttaaaacatgcatgaggaaactccacattggtggctagagtcccaaacagcttggcatgccttaaagtttgagaatcctatttcattttttaatttatctctcaagatcatgcccaccatttaaaatgttgggcgtttattcctttcagaacatgatcagaaacaagcaagataaaaaacagccaaatcatttacagatgcacgcatccaaaccaaaataaaatcagagtgctcacaaaaatgttaacccaggcatacagatcgaacaaaatattaaacatgtgtggagacccaaaagtaaatttgacagaagagacatgcctcacagagagaatgtagattctgtaggatccaaaatactcaaaccacaagaacatttgtctttagtctcaaataaagtaaaaaaagaacttgccaaagtaagagtcctagaatccaagaggagatacacagtgggctcagttgataccacactccattccaggggttgccaatttgtctgaggggatctcattttggtcctgcctctggcaccatgatcccaacctaaataacaaagaggaagacattctaagagaaaattatatttattcaaggataggcactgcaatgggaatacacacggcaaagtaaactatgtgtgtgttcaggaaagtaagggaacacagaggattttaaaggaaaacaatgagaattacatcattgttttgaggtaattattcttggttacaaggatcaatagcaaggtgggtgccagtcaggttggacaggcagttgttgggtagatctcattacagaatttttttttttttttttttttagcataagattgtgatggcctttgtccaaggttgtggtttccaggcttttgtaatattgatgtaacatagcattcaaatatggcttataaatacggaatcctttataatttaagtttaatataattactttattccaggattcaggccaagaatcatttcttaattttccaggtaatctgtaaaaagataattaaaagtgcctatatttttgttcatactggtctcatctataaaattgatcactgaaaaaaattgtaagtgctaagtatacaaaaaaattatatatagaagcaagatttatgatatatttgtttctaattgtaaaatattttctttctactgtgaggtttcaaagtaattaaaacaaacttaacagaaaatatttgtaaagttaacatataatattaacaatctgttttttcagcccatgaactgacaatataggtgtaaattgtgccatttgttgttagaaactgttaggttttaaaataaatttaatcacatgatttttaacatgaaaattaccgcagttttatagaacagaaattgaaaatatgaaatgaatgcatttggttctttttgtctaaaacaaatcattctcaaatagaaatataatataattaaatttttaaaaatggagggaattgaactccataaagagatatttcattacacattgggcatccttgtagcctatgtgagtttttggccactatccctgtatttctatgcaccctctatctactcctttcatgagtatacctcatgtaatattttaagttgaaacaacattgcttattttatctggagatcttgaagatgagtaaacttttttatttgttatatttagccaatcctaaaagtgttctattacactagaaaaacaaacatatttttacaacctttgggcttttgtcaaagaagatttaattttaaagaaaatatatgtaagtactggggcatcatttaaaacaaacaagaaatctcttcctttgtgtaaataattataagtaagtactggggcatcatttaaaacaaatacgaaatctcttcctttttgtaaataattataactagtaaaagattaattcaactgactgaaagaaaatatgaggatcatatttaaaatgaaaaaacagtatttacttatggttcattttgtttaaaacactttcatcttccatgtttcaccatgcctttaaaatatatatatatatatatatatacacacacacacacgcatatatattttatatatattacatatgtatacatgtatatatatacatatatattttatatatgtgtgcatatatatacacacacacacatatgtgtttgtgtgtgtatgcttttattcatgttggaattcatgctgtctgcttctttcctgtgctcttttgtcagtgttttcctgactctcagaatgcaaaatctgcttcatttttaccacagaatctcagatttcatctaggtagcatgtaatttatatttagctgtagattctttgggtgtgttttcttacagagtagatgataaattccttgggagtagagattgtttgagtttttgatgcttctccagggcactgacttactacactgttcattgcacacactagatgcatagatttatgtttactttaacactggtcaaccatgtaaaattgacatcagatattatgactgatggataagtactgttcttctcatggcagagaatcaatgagacagctctcctgttttgtagagcaaagctcttataaaatagtatatattattcttcagagtatttattgagcacttaaaattttttgtttgaaatggatagaaaaaagaaaacaaaagatgattttaagagaataactcaaaaatcttggaagagatattttattttgatcctaatgcatacaagattaactcagcccatctggttatacaaaaacacaaacagtttcttcattaagtttgaaattttgagctatccaggatttgctttatctctaacagtctgtgcagtgccaaatgttgatatctcatttccttgactgtgattaaattttctttatatcagtggtgtagtatttgaaaacacccaatttaataatatctttgtcatatatttttattttttgaacacatgaattttgtatttccaatgtgatttagatgacattttgtttctatcaccaaaaaatcatcttttccaacagcagttcaactctgagattggaaatactttaagcctcaacattgtcaattttggctctttgtcattttcctcaatagggttactttattaatttcagggaccttaaatattgtggtatgtatgagtgtgcacgtgtgcatgtacctgtgcctgcatgtgtgtttttctattctcccatgtccattacttaaatatatgttattacttcatgttgaatttgtcttataaacaaagccaaaaaactctatttgtgtttttactagatataagccatattctttagatgaatcatattggaacctttcagtgtttttatgaatgcagtgtttaaaacagctaaacatctatctaaaaatgttcctctttgagatttgaagaaaaaaatcttactcttatgaatctatctctcataatattgccatctgatcctttaagtatcttttttcccctaatcaaatttcaaaagtcatgttgtcacctctaaaatatagaaactgggacattttctgccttcatttataaatatttatatgtcagtgtctacttagtgtttgctttaattcatctaattttgtgtgtgcatgatagaaactacttacaggattttccactgaaaattacaaatgaatgacttaactgagaaatgcactttcaagtgactaatgaaccaagcaaacaaatagcagaaagaacatcaatgtgcttattctcaaatcttcagcaattctgggctgtccattagatcgttagttaagcacagcaacacatacaaatataaattagcctgaactccagtttttctcccttaagtatgtggctaacttgctagttgggtaagataatgaggtcatgatccaggaactatgaatagagaatccatagaactggttctgcgtacattagtataaaccaatctacatagttgcacatttcaagttgttccatctatgtagaaattagattattgggatttggaagtaataaatagattattcattgttgattcatttcaacatatttattgagcatctaaactgagtgaggaaaattggtttaaagcatagctggctctcaaatattctattgtgtagtgaaaaacaaaaagacaggtaaacaaatactatgaaacactcttgggtttgtgttgaaactatggtggatatcaatgaatgcaaaagcatctcctgtgctgcagcctgatttgtatggggttgagataagcagtggaaagtgtacagcacgggtgaccaactgaactgaggtttggataaccagggcttctttagtcagtatcatggatagagaaccaggattctagtacatgcacttactatgttcaaagctgcagaagcatggaaaggcatggcatataataaaagctataaaatggccatacacaggtgactgctgagaagtagagagcaatgtatttggacaaagtctcaaagatcacatgataaattatctgattctctactagcagatgcagatttttcttgaagaaaatgtagaagaaaatgagcaatgttaaagaaggtagtcacatattgagtgttttgtttgtatgaaaaaaattctgacaagtcctcagaaaattagttgactgaagaatgagatcacattaggaaactttctatggtaagcttgtttaagcaattatgagggtatggattaagatagtaacagtggccgggcgcaatggctcacacctgtaatcccagcactttgggaggccgaggcgggcagatcacgaggtcaggaggtcgagaccatcctggctaactcggtgaaaccccatctctactaaaacaatacaaaaaattagctgggcatggtggcgggcgcctgtagtcccagctactcgggaggctgaggcaggagaatggcatgaacctgggaggcggagtttgcagtgagccgagatcactccactgcactccagcctgggcaacagagcgagactcctctaaaaaaaaaaaaggtagtaacagtggacatgagaaaatgaactggattaggaaaacatggtttattcatcttaatgacctactggataaagatataagaaaaataggaatgtagaatggtttcaacctttatattaaacaactgggtagaagagggtattttataacatgagaaacatgattggaagggagactggagacaatgataaattaaattttggacatgctgcagatgaaatatatgacataattaagaaaagttgaaatctggagtatggagtcagagtgattagtcagatattcatcaactgtattagtcaagagagactaacggttgtaacaaatagctaccatatttgagtcatgtaacacagtaaagtttatttcctgctgatacaatagcagagcagagatggtcctacccaaagcattaaataaacaaagatttcttccatcatgtggcttgtccctcctctgagtcttggtctttggcgtgtaaatgaagaaaaatgtcacaaatggcatgttggtagatcacattcactcacattccatgttcagaatccagtgccccagccgcacctaactacaaagagggctggacaatgtagtctaggtgcatgcctacttttttactaaacagtgagatcatttatgatgagacctcatttgactctttcaaatttaccatccattgcttcttagcagtcatctaagtgccagcttttctaaagagaaaaacgtggatattggggagcttttataacaataattataacttaaatattataagctatacttataattttgatatattagtttttatttttaaacaactcaattttcagattagtgaaattttccagaaaattatgtattcttgaaaattaaataaattaattctgcagaacactgaagttctttaaaatccatggaatccccagccctggatgctgtactggattcatcttcaagacactgatgacacatccaggacccataaaaggaactctgtacttaggaaaaagagagagagagagagagagaaagagagagagttgccacataacctttgctcttaagcttaaataaaagcaataacaaattctcctctactaattgagaattagtagaattctcaattgagaattgagaagcaaacttctaccagttcatagttagcgtccttcagggcttcaattggctattgcaataattttaccatttaacatacgttaatgctttccgacatagattttgcaaatatcaaggtattctctggcagtgaggttacatacataagatttttcaaatcactgagaaaatttaaatcacagtttcattttgaggggagatacattacaaaatagtaaaaatacaataataatcaatatatgagaaaaatttaatgatatttgttaatgatatgcaaacttcttgatcaagcaccctaaatatcacattcctctcacactgagtacatgcatttggaagttgaaacactagttttaattgcataagttaaaagtcattaattctgtttctctttaaaaatttttaaaagacagagataccaatttctattttaaaaataatgaagtaacctcaaatgctttgaggacctatcaaagtccacttcttgtttttagttaggaaataatttcagtttctaatgcttagctgtgcgttctatagccagactcatacaaaagtttcaataaaatgatatttcattgaacactgtgaatgagagataaatttcatagtttagcttcatacttttataattcaaacaagcctcacattattgaagtcagtagactctatattacctttaccttgaaaatctgaaactatttgatatttcagactggatatgggactttgtaaaattggattaaatctagatcacattgaaaaatgccttctatcaaaaaaaagaaaaaccttaagtgatttatcttttttcatcttttattttttatgtgtaacttatttattgattataaaactctgttcaattttttaaaaacatacctgggcattagtctcctcatatgtaaaagaatgtatagtctggcctatttagtctcaatgatcccctttaatcccacagattcataatttaatatttatttttctccatgaccttgaaagcgatctaaagatcagaaaatgtttaaaatgtgtttgtttccccacgttgcagcttgatggcatcagattttgtggtgatatgcctatttaaattttgaaaatgttaatttagtttattttatatattaaattattttataattgagaaaaattatgatcatatagaatacttgcatataattatgcacagctccatatacatagattgtacaaggtaactgactatagaatgagtaagatcattttcatgctagttttagtcattttcactcaataaaatatttactaaaaaataccaaccatgcaaagaaagagtcaagctacgatttttattatgtaaaacaaagaccccatagcaattaaaagtaaataattagtccccgaaaaacaaagcctgcttattcttacctttcctattagccatggaattacctttattttctttctatattaactaactcccatatacccctttttaatggacacaaaattttattatgaatgtgttaacagaagtctttatatgatccatttagatttctcattcatagagagcatttagtcttagagactagaataaatgaatttgggagtaataattcttatatgtcattattgactgttttttgttattgatacattaggaacaattaatacttatataaatttaatacacctatgattgcttttgtattttcttctttttaactttgtaaaaggaggatactgactctgagagaaggaaagtagttttggtattttcaattatattttgaagctatatatacactttacactctacataaatgcaggggaaatgctatttaagaatattatcaaaaacattgtatataaatttaatctcacaaaggtgtacaagattggaatatggtaatagtttcttcttcagttaacagataaattgactgaaagtttatttgcagacattttgcctgagccaaacaaatgacgtctatttagagaagaaatcagaagagtaaaatccatgacctgaatggagagaagccacagaatgaaagggacatagtgaacatgttagtaaaagatttgccaacagactttagaaaacaaaacaagaaaaaaagccaaaaaactacaggcagacagatgaagggtaggtaagaaaccacaatggattcaatgtgttctgtgatatttgagctctttccctgaattttctccctagttggatgagaatctactcattcaaattgattacaactttgagcaactgcaagaacagagaggcaggtgcaagttatgaaagaatctggtctttgaaatcactatgccatagaataggaaatccagtgattttacaaaggcttgaattgtctttctttaggctaccaaatagtaagccagctgcatttggtacagagtagtgattgccgaaagctttggcaactgagaaaacaccaacctacagtgatttggtggtgttgccatgagcagatgagctgctgcggagtcctgataaagttgattacatattttgcaatataatattgatgaaataggttctaaaagcatttgaaaatatcagctttagcagcacaaaccattctaaaacctcccaaatgaacggaattatgattggttgaaaaaacttataacttgttcagctcagttctctttatattttatttgtaaaatgaagctaaatgatagactatacagattattatgaattacgcagacccacaggaatattcaaatcctgtctctcaatgattttatcatacttgatattttaggtgttacatgttattatattactcctttttgcatttttgtcctttgcatttcgttttatcgaggttcattagtctattgctttccttcattttcctttttttttgccaactatctcagagtcaaatttgatgtctaattatattaatttacttggactgcctatatatatatatatatatatatatatatatatatattttttttttttttttttttttttttttttttttgagacgcaatctcgctctgtcgctcaggctagagtgcagtggcgcgatctcggctcactgccagctccacctcccgggttcacgccattctcctgcctcagcctcccgagtagctgcgactacaggtgcctgccaccacgcccggctaattttttgtatttttagtagagatggggtttcaccctgttagccaggatggtttcgatctcctgacctcatgatctgcccgcctcggcctcccaaagtgctgggattacaggctaaataattgttatctttattcctggctaccctgtgttattttatacttaatttctaagttgtctctcatttttttgtaataagaaaagtttataaattatttcttcctctactaaagtgattgtatgaaattctcagaaccaatatttcctctaacatatacttttaaaagtaaatctatcttgtatataaccgaagagatagatcaatcgatcagcaatgatttggaagggaaaggtggcagacaaaaggaacagaaaaattaactgttacttagtgggaactagcttgatgtgttccaggaattttataaggccactgtgctagaccttattgagcaagtggagaaaagtatataagtttggaaaatcatactggacctataggatcttataggtcatggtaatttgagttttattcttagtttggtgattgctcactgtttatgcccttaaaaatgttaaagtgcttcctttaaagaggaaaagtacattgaatatactttttaaaaattgattgatcaaaaataaaatttcagacaaatgcataggtttttaaatattttagaataatttgacaaacacctagatgtttacacaattctagaattttaacagaactgttgaaaaacccaaggcttaagtcagttagggagagaattatatctcacagccaagagtgttaaatactgagccctaaactggggtattaatgtaaccttagttcctgatagatgtaattaatataatcccaattccaggatgaaatcctttatattctagaatatagttgttcaggtgtgaaattgatgaatgtttttgctgagagttgggccgtctgtagtactttcttccaacatacttgtgccttccaggcaaatttgaaaattttagtaagtatatttcttcaaaggattgaattctgcccttttagaaatagatcatgtccccctcacgggaagcaactaccctgttctttacacaaatatattttcacttatttttttaaaaacatttccaagacctaatttttaaagccactttgttgtcattctgattactcagaaatattgcatttctttactgtgttaataccaaaaaaactttcctatcaagttttcttaaaatgtgtatattgtactccatatatattaggtgttcaacaagtacttattaacattgtttaaatagtctttttttttttattacatgcactttccaaattgtgaactctgaaaacagaccattagttctattgtatgtactctgagggtgtttagcacaaatttctgctctcataatcccaacaaacctcataccaatttgttgtatcacaactgatatcagaaaattcgttacatttctttatgcccaaatatttccatacttaaaattacctagcctttttgcagctacatgttgcagaaaaaggtgtcatgcacaaggtcatgttttacctttaggctacattcagcaagaaaatgaatttataaaatatagtactcaggagaacagatatatggtattttgtaagacatccagaaatttagtatactattaaattcctctcacagataatatcagaaattctaatagtctacaaaagtcttgtttttatttaacaaacatctatatagcatttactttgtgccagtcattgttctaagggcttaataaatatcagcgcatttaatcctcatataccttctgacataggtatcactattttctccattttccacacaagaacattgaactgaagagatgaaattttctcaaggtcacaactagtaaatatacagtataggatttaaggacaggaacgctgtctccagaaatgttctcaactgttatgttagtctcactaactctaaatctgcatcaagaaaagcctgccttcaaattttgtatgtattcactagattgaatatttaatacataagaagaagaaattgaatcgagagcaaagaccataagaggttaaagcctgaactgacaggagtttacttggcaagggaaatttgtttgttttctatcaagtatcattggcactcaggattaaaaggaggaaagggctaatagtaaaaagtaatgtatgaatattctatgtcattaccaaaaatataaaagaaacctagcaacctcctgttaatggtatgaaaggataaaggtgtagcaagtccttctggcttctgtgtcaattatgtaccatttattacaaacctattcataattttaatttgattaatctttgccctttatgtaaattaaattagctttagggaaccaaagaaaaataattttatgtagtgttactttgatgccttacagctgagacaaggtatggatggaaatcctagagagagagcagaaaagctttttcagtgtgctggatagtaagtgtttaagtgtcagcaaaaacacacatcctgttcttagatttttccatcaattcgaagcaagcactctattagttgctgggaaacagaaataaattaaacacaacctgtttctttcaagaatctctcaatctgttgaggaaggcaggcaaaatacagaaataacatttacaatacaatgtgatatacattctgtgcccaatccgtcatttgtcagatggtacgagtacaaattcagacaaaagtttagtttgattcatattttattttaacaacattgattattttaagcatataatgagtaattagtttaagtcaactcaaggtaaaaataagcaacttgctgttgaactaagtaactaagaatactccttattttaatattttaaactcgtcaattaaaagaaaattgcttagctaaaaaaaaattctgccagtataaaaggacaacaaaagaggatggcagaattgaagttctagagctaatcaggtgtcagttgaaattgaagaaaaaaattaaaaatgaaaaagatgacaaagccaagtgaagccaaaatgtgtgactagagacattgggagttcccagcaaagaagtactaacttgctatttaacacttctatctgatagctgataataagctatgactgataggactaatgacaagaacacacacaaacacacacacacacacacacacacacacaccccccacactcattcctgaaataaagataggataaacaaagcaaaactgagaaaaataacatgtcatagatttgctgaaagaatcagtgtacacacacaaaaatttgtttttagttctagtggcacacttcctagatttattcttcagaaaaaactagaaagatggattttcttatggtctctggtacaccgttattttgtttatattctaaattatagaaataaatattgtaatatgaaataatttatctacatggcttataaaaagcatggtttattttaaaaaatatatagataccaaatgcaaagccacttacatgactagaaacaactgaagcacataacatctttgagtacacgtcatgctgttataatttgaagttttgtgcagtccttaaacattcagactttctgatcttgcaaaggtctacatgcatatcatagtatatgaagaatttaataaacataaaagtcactgcttcctccaccatattgcacttgattgcaatcagcatgttacagccacagtctaattataaaacgtcaaatgtttcatcagcttttctagcatagctctgtgctgcatctgtggtcactggcccattgaacataaattttaactccttttatgttcaattggaatctgaattacacagttgatgctaaactataccagaattaaaactcccttgaagataacttgtctgatgaactattttcaggaacgtgattttccaaacatttcttgcattactcataccaatgagtaatacttttgaaaaagtaattctgcctgtcttagaatttctagaattctagaaattctaaggcattagagaacaaaataaaggttacaatgagttcatattctttattactctcaaaaataattatttgaatagacaagaaatggttaaccagggggagtggatttttgtatacattaacagaaaatacattgaatactatggagagttttctttttctcctgttgccctattctacatttttagagacaactgtttttataaattggttatgaacatatccaattcagatattctcatatttaatgtatgtatgtatggatagatagatagatagacagatagatagataatgtcaattcatttaacaagcatttactggctgcctattgcatgttggatactggagaaatagcaagaaaatcaatcaagtccctgtatttagggtgctttatgagggtgtccaaatctacttaggtggttggttagtgactgttgttactatgtggctggtatatttgcttttctttctttttcttttatttttcctaagtaatttcaacttaagtttatctcttataagctatatgggttttatgtttatataggaaatctatcttttgatttgtctattacttttaaataaaattctattttaacttttattatgtttaaacatttgaatttttaaattatattttaaactttttatttgatttctttgtctttgattcatcttcattattttccctagtagatttccttccttgtttcttttttgccatctgtgtgtttggtaggtttgaggatttttgttttgttttgttttttgttttaccttttttgcaccatactaactttgaagttgaatttctatttttattgcaatgcttactcttgtatttttagaatatgtatctaaaacatctaaagtaataaatattgttatctgccttccccaaatttaaaatttacagccacattgactatcgtaatttactgcctgccccccattcatgaagtcttatcttgtgttttagttccttttttgtttctggttaccatgagtcatcttatttttatagtcaatacttacttagatagaacgttttcctcacagtagttcatatcttcaagtggagcatcatttttgttatcttatcttctttttttcccttggggcttccataggtctaaggttgggaatttatccctatagtagtttataatttgccctttctggaggacctggattttatctgttataaataaatttgtttgttaattttctcaagagtcctatattatggcaataaccagaacaactctgacctgcaactctgcactattagtttagtactatctctctatacacattgttccttatgactctgggatggctgttatttctccatgacttcaggggaatacaagccagtagataaagggctccccttccaattatcaggagctccactactctcacagtgattaggagaagcgtgttgttgttgaatattacttgcattatcaggtttctgaagtaaattggtggctggaagtattctgtcttaaagtttgatgtaaatagaaataaaataattaaataatggcatctggttttagttatccctataagtagaattgtaccgaatttaccagctgataatttactaaatccaggttccagtttcatttctactactatgtaactctgaaaacttgattgagttactcaatgtttctgagcaccatttctaggaaataaaaattgtatccaaaaaatcaggaaaaaatggagaaattttccccagtctgatatagttacatgataaaatcatattgtcacagagttttatatgagagggagctagaagtcatcttatgatagtctttcatttactaggtgaatattgtgaagttctatgaagctgaaggatctgctcaaatgttagtgaaaaagtgaggactatcattttatcttttctaaatcttagtatggtagtctttcctctgtactgttgtttcccatcttaaaagcaattcatcataatgtgtacaaaattataatgtcaaaccttcattgagcattatttgtccctgcagagctaaccccttgttttgcaaatgcatacatgcttataggtacctactatgcaaattacatgcagtaaaattccaattccctgtaagaattaagtacacaattttcattttgtgttaaatgaaactctagtattctatatggcatttctttagtggatttaagtcttatggaaatacaacatttttttttgagacaggatctttctctgtcacccaggctggagtacactggtgtgatcatggctcactgcagtctcaacctcccagccttaggtgatcctcccacctcagcctcctgaatagctgggaccacagctgggagccaccacacccagttaatttattattattattatcattattattatttttgagatggagtcttgctcagtcacccatgctggagtgcagtggcgagatctctgctcactgcaagctccacctcctgggttcacgccattctcctgcctcagcctcccaggtagctgggactacaggcgcccgccactacgcccagctaatttttttgtatttttagtagagatgtggtttcaccgtgttagccagaagggtctcgatctcctgacctcgtgatccgcccgccttggcctcccaaagtgctgggattataggcgtgtattattatttttttagagaccacgttgtccaggctggtctcaaactcctggactcaagcaatccattcacctcggcctcccaaaattctggggttacaagcatatatatggcatgagtatttctggatttagcttctctatcttctcatatctcagtctcaaccattctttaaaaggttatctgttttactagtatccatctaaaatcacaaagaaaaataaaaacatttttattactgtcttttctgctaaaacattttacttctcagatcttaataattaactatattcacgtggctacaggtaatcatactataggtcaggaaaactctatctcttttcatttttagggtcttgacttggcctaaaacttaaattggcatatgatagtcaattaacagaagaaaaacacacaaaattaatagaagttttatgtgacatagaagtccccataatgacatgaacacccattgaataaataaaatacaaatgttttatattaggttgaacaaagagaggcaattttggacaaggaactaaattatgtggggaggctaaaggaaaataagaatcattttaaacaaggtctctttgtacacaatgctcttggctatgactccaggtcaaagaatatttctatccctaaaacaagaagaacatctttctcataggagtttttaatctcctgttttcaggaagaaaaaggaagaatagaattcccttattacatctgctgtttatcaagtgtctagctcaaaataatccttactccaaaatggcatattttagagggcacattctgccgcccttcagtagtatcctttcacctactccaggtcaatcaattcttttgcgttctttatgacaataaggatttgactttttcaacataaatatttaaatacgtgtcagttttggaagtgtgaactatagaaaggcaaaagaaaagaaatataaaaggcaaaaacaaaaaaatcacctgtaaactttatgtccaggatcactacattcactctggttgcctctgtattaattttttattagtacaaaggctatacatgtctgtgaatttgcatatgggctttacacatctactagttttctgcataattatttgttaaatggcagcatggtaaatgtattattcagaagctgctcttttattttaataatagcctgagactgtttcccacttctgcattatgacagtatctcctattaaaatctataatgatcggtatggtttattatgctttgtctattgtctgtctcacctgctaaaatgtaagttctgtcagggcagggacccagtgcagagtcactgctggcaaactgtgggctctcaataaatatttgtttaattaaataacatgactgacatattaagataatttgggattcaaccaagttgtgtgaagtaaaaggggatctatgttattaatcaataagcacatattagctacaatcccccacaagaaaaactgtagttttgctgatatagaattttgttaagacatttaaatatattaatagaaaaattaagtatgtatttttaggcaccgggattgttgaagtagactgtcaaaacacagttacagataacagttcataatagaggacatgtgttttcatattgtcacttgctttattgaaaataaatttcattaagttcccatgtcctgtatttccagttttgatcattaatatatatttgttactgtcaactttattaagatgttagcctacctttctgaatataaagcttagctataatcccatgtagttttcttgcattttaatgtatttgcttcattatgcaaattttggtttctaaacatgaatatttttgcaagcaaaattccagcataaaggaacaataccccattatgcaaaatgttgaggattctcattatcgcttaaggtacagaataaaatgtcaatatgctaaacaaatgaccatgggtttggccatgaaatttgttaaaggcaatttgttcaattgacttcttatttatgagttcatcctcgatgtgtgcgggtgcacataaattctgaaagcatatgtgaagtacataacgtgtgttacattttttagaaaatcagttagcctatgaggaatttttgttttcatctttccctgagaggtgccaattctatcattcagtgtctttaaacattttgtggtttctagaaaagttatactacacaaaccctaagcaataatttatgacgaaaagaaacattcccagcttgctggaaaaatagaatagacagtaaaaaaataaaagtatgcctatcaacaaagcatataagcattgcaggggagatctctaagaaataatactgatcccttgggtgatgccagagagtaactctaagagctgttttttgcagagcagccagaaaataaccatgaaaacaatcctcgaatacctgaatcagcagcaattttactccatgcttctgcaaataacagagacttttaatagcattgtgaataaacttctccatctactggctgaaggtcaaattttgatctttattacttataagaaacgtatttatttgtatgtctgtaggcatacttttttcatgatgaatgtatgatcaactaaaggaataacttactctctttaaatcataacatggtatgactcaaagaatcacaaaaaattttgaaaacagtattattacattacagtataaattaagccaacaatttatattttttgaaagccattaattttattattatcatgattaagtacaattctgagtatttcttaaaatataatatatttcatttggctattgagaaatttttaaatttgctgatatgtagaaagataatctctacttgattgttttcatacgcagttgtggtattacacactagagatccattaagtctttgctccatctgttttcaaaacatcactcaatttgacagactcttaaactatgacttagaaatcagattaggaaattaatagcaaccaaaaacgtattgttagccagaatttagcagcctcaatttagtaaggaaagttatctggccatccaaaaatggtactgaataaaagagaacataaggcactgatcctcccagcaaaatcttggatcctaagaattttacaagccttataacctagtatgtcaactatttatatgtttcttttacaaatttcctatgcatgttatatctcacctgccttaaacaacacatccttgcccttctcaccaatcctaagtgtctgaaactatgaattatcaatcatttgaagaccttagctgccagctcgaagtgctcttacatttcacaccagtattagctaatagaaatgtgagcataatgcttattctgacttatcttgattatgctatccaatcaagatgtatttctgattctttcttataatttagaattactttacatagtaactgtctagatggacataaaacagccctgcaggaggttgttatagtagatgttttctatataaattttttgcttctgtggccacagtatgattgctaatttacacagtgaggtctccatagctaaggcttgtctatcaatagtcaacagctcatgtatcaagtttacccttcaccccagctcccacatatgctgtaaagcttatttgttagatagcagaaagcatcagtttatattattctgcatttttaaactgcatcagattcaaatagaaactgtttattgtaagaagttcataatttcaaacataagaaaaatacatacacacatatacatataatatccattttcagtatatctatataacagaccagttcttttctccttaaatattattttctaattcatgttcatgtaatacacctacacactggactcctcagtctgggtctggttaaaaataagttcaatgagagtgttacattgtatgcgctgctttgacctgtaggacatattgaagccatgacctatgggacatatcttgcagccatgacctatgggacatatcttctctctctctctctaggtcccttttctcctctggtttcctgaggctcctagaggtgtgtcattgcactcacaatccactccagtatgccatttcaagctgctcttttacactgctcctgcttatctctgggcctctgttttgtgtcatcttaaagctgctgccaccgccgagccctggttttcgcccaagtcaccgggggatgcttccaatcaccatttctaattataattttactgctggagttttattccagaaatctgagatcttcctcttaaaactgctcatgaaatcacctctgcatcattccacaggatgctgcttgccacagatcaccagcaaacacttgttgctcacttcattatctgacagaataccactgtccatacccttctcatggaccacaaaatatcacaccattgagatttaaaacacacacaattcctcttttccttaacatacacatactgtgagaatggttggggcagaacaaagcaagtaactgccacaaactgcacagagctatttgttgaataaggctctcagaacctggtcctgtgactagctaatttcttatgccagagtcttttctccctaggaattttcatacagaaatcctgaagaactcacccccatacctttactgggcccaccaccaatacaagcccactaagcatctcctcatttctgtcaactccaaatagtcagctctcttggaatctttctttaaggtttttcctcagtccccatataattcagtggaaactgatttttgaagagacatagtgccagccttgcatactcaatgtctgctataaatataattattttataagtttataattattgtagttatgtgtggttaacatgtagtttctaagaggaacatgtagtttctaagagatgggtttttcaaactgaataaaccagaggatgacctataaatattaccactgtgggatgaaaagattttagaaacaaattctaataaatgctaagagagaagagaaatgagttacatgagtagaatggtagtgaaggggctactttagatttggggcagggacagaaaaatctttttgagaaagtgttcttttagccaagtcccctttagtcagtaaagagtgcagcaatgatgttgcatagaaaggaaatagtatgtgaatatttgtggatgtaaaacaacccttggtggattcaaggaattaaaataatagataagtggctaaaataaattgagtaacaggtcacaatggaacaggatgaagttggtccctgggcagtagggagaagaggatcagtggaggtatacgacataataaaagatacattgtaaagggaagaaaatagagatatatttttaagcatactcacctaataattttaaaatattaataatgtcttatagtacaatgtaaaaacatgttgtattttaactgtggaagagagagttaagaaaagaagttgcagttgtgtatacttaagctatgttataaaataaataaagttctgattccataaatgcattaggtccttctcaatctactatttggcatatgacattaaaatatttgtttactggacccattatttaactttggaaactacctaaagaacacatccagtgatattagagacaattctttcacatgagcatgaattttaggtgactatgccaaaaagagtttgacatctggttaccattctatctatatagatgacatagattgataatgcaaaataataaaaaagtaagatcttagaaggaaatggctaagagaaataaagtcatgaaaaagaaaatatatattctaagcttgtttcaaatagctccaactcatcagtaaagaaaagcaaaataaaaccacgagataaagtttgttttaaaaaacaagttttaaaaagatttttttccgtgatggcaggaatagaggaatactcgtatcctgatgaattgtaatttgctaaaccatttttagacagctagctcacaatatatggcaagaaccataaaatatattttccaacattatttatgcaagataaaaacaaaatgaacgcagagatttacacatgaagactttcagtattgtaggtcccttaggattagctatcaacgtcaggaggagtgttttggacatttataaacagtttcagaagaaaggaaaagtggagcagatagggacttgaaacaattcaagagttgttgaaagaagattttgaaaaatccagggcagtgtttgtgaaacgtgaacatgcctaggaatcaccttgggatcttgttaaaaggtggattctgattcaataggtctgggcagagtctgagagtctctaacaagctcccacgtgatgctgctgctgttctccctacacttgggtagcacacttcatgggggacggctgtgacactacctcttatgcctacatgccttttccatatatatatattttatacatttatatctgtatatataaaaatatatatctataatctataatataaatttatatctatctatctatctatctatctatctatctatctatctatctatctatgtttttaaactgcgtctctctctgtcatccaggctggagtgcagtggtgaaatctcagcttactgcaacccccacctcccgggttcaagcgattctcctgcctcagcctcctgagtagctgggatcacagttgggcaccaccagccctggctaaatttttgtatttttagtagagacggggtttcaccctgttggtcaggctggtctcaaactcctgacctcaaatgatccacccacctcagcctcccaaagtgctgggattagaggtatgagccacactgcactcggaccatttcctatattttttaattgaagatcataactgaagtgttatgtttgtcagacaggggaatatgagtcaaagacgttgtttagctttaaaataataaaaccattgccatggagtttgtaaatgtagactgagctttctccaggtgttgtctgtggtgattgcatagctgtcatgcccacactcacatgtgagcttctccctggagacaactgcattcatgaatgagaagccatttgccttactgatgtttcatcatttgagtttactttcatttatgtaagaatgagtaacgaagaaaagatagctcagaagtttcagaaatgcaattttttctttcttttttctaagacagggttgagctctgacgctgaggctggagtacagtagtgagatgtcagctcactgcaacctctgcctcttgggctggagtgctcctcccagctcagcctcccaagtagctgggattacaggcacccaccacgacgacaagctagctttagtatttttttgtagaggcggggttttgccatgctgcccagtttggtctcgaactcttggcctcatgcagtctgcccgcatcagcctcccaaagtgctgggattacaggcgtgagccaccgtgccagaccggaaatgcaactctttataaagtgtcttggggaagcagtcaaatgattacttggagcaaggataaaagaattacaacattataatgagtgaaaggatgttttaaatcactataatttgttcacacagaaatggattcctaaagttatacataaaaattgccttcaagttatagctagagttcacatccgcttattgacaccaacccctaaacaacgtgctgaccatttccatcgttgtgtggagactttattctaaaactttaatatacagctttgacatctgaagagattttggaaagaagagcggaaactcgtagtaaaagggcttactgttttacctcattgcttttaagaaggcctcttacaagtctttacacgaactatgatattgcatctctgtgctcaaagaaaatgattggaaatgaatcaaaattggagtcacaaaccaaaaattggagtcgatcatattcctaaaccaagggcctaagtattagggattttaatttgaattaacatgcagatatctttttaatgtttttaagatattcagtaaatatttgcaacttctgttttgttttcatttagttacaaaaaaagatgaagtcaatgttaactcactgaagagcaagcattactaaaatgccacgtttaaaatcattttacataaaaactattattaagatctaatttagaatgatgtgtttactctgaattttgcataaattgccacgctggtttgtcacggtgctttgatcgtttgtctactagatattgttctcacagaccatacaggctgatacatttgtgaatttaatcatcttgtacaatacaaaacgtatggtcacacattcacagtaactgaattcagatgtagcaaatgctgacaaaaagctcctgaggatctttcatgacctaggaattaaacctaatcatcaaacaatgcttgcagactcatcaaagtacaatactctgccaccaggcctcttgacctttcaaggaggcgttgccaaaaggcggctgaggctgcccgggaacatttaaatgaagattttgaagaagattgaacctaatgttaggagattatctctttattatctggcacaaagcaattgtgttgtggtttttgaggtttttcttctttttttttttcattttcagagtactttattacaattaggaaattactactcactgcttcttgtgtgttaaataaaaatcatgctcattttacataaaaaatcacatgagttttttttttttttcgttttccataactaaaatgaaaccctgtaaagggagtaaaccctgactttgttttttgtttgtttgtttgtttgtttgagatggagttttgctcttgttgcccaggctggtgtgcaatggcgcgatctccgctcaccacaacctctgcctcctgggttcaagcgattctcctgcctcagcctcccaagtagctgggactacaggcatgctccaccacgcccggctaattttgtatttgtagtagagacggggcttctccatgttggtcagattggtctcaaactcctgacctcaggtgatccgtctgcctcagcctcccaaagtgctgggattacaggcttgagctactgtgccaggctcttcgttttaaaactattttttatactatcttttgaatgatgacttgctcatttgtgaggtgttttgcttctcaaaaggaaattttctttttgctgggtctcaaagccatggtacatgaatatgcttcctctcacgtagtcagtactgaaaactggcaggcatacttcggtaataccaagcaaggagactgcaagtaccattctccaggcacatacaacatgaaatatcatacagctgtgaaagatctggtggaaagctggaatcttgaggaagaaacattttttgaaaattatttctctctctaagtcagtaaatgtttgatataattctgagtgcatggctgtagtctgaaagtttatgtgcccctaaaattaatatgtcaaaatcctaacacccatggtgatgatatcaggaggtagggcctttgggaaagtaattaggtcattaaattaataaggaaatcgtatccttttttttttttttgagacgtagtctcgctctgttgtccaggctggagtgcagtggcacaatcttggctcactgcaacctccgcctcctaggttcaagcgattctgctgtctcaggctcctgagtagttgggattacaggagcctgccaccacgcccagctaagttttgtatttttagtagagactgggtttcaccatgttggccagcctggtcttgaactccagacttcaagtgatccacccgcctcaggcttccaaagtgctggcattacaggcgtgagccaccgcgcccggccatcgtacccttttaaaataggcccggggagcttgttcattgcttccaccaagtgaggatacagtgagaaggtgaggtccgtgaacgaaagaagaagccctcaccagacatcagatcacacagcagcttaatttggggttcagccttcagaactgactgtgaaaaaaacattttgttgtttacaagctactgagtttatggcattttgttatagtaacttgaaaagaccttaagacaatacataatcatctatatctacagcatattttctaccagattttaatgccactagcttaaaaatgcaaactagcattatgaaatgttggccaatattagttactatttatggaatgaatgtttaagtatattttaatgttcaagcagtatttaataatcatctttacctattatgtaattctgacaagtaaattaatattactcattagatcagagtttagattactgagatattttactcttcgcttattttttgaattctgtactataaaatgtaaatagaattctgaccacactactccattttctaacctttcttactttccattctccttttgctcttatctagtagtaagctttttaaatgaaatagcaagccccaaccagacatgtgatcatataagtttaccaaattaatatttacatacttcaaaagataatttttaccttttgcaaggctcttgtatcggttggaaccccgagaacgtgccaacagacaacaggaggcggtgtggagctacaggctgttttaacgagcgcctgggtgcagatgggctgaggcctaaaatggcgtcagcgtcaagtgaggacggggcaggggttttatagtcctctgtaaacaggaagtgtccgagtctgaagtgactgctacgtagtaccttgacagcttccttttcgatcttcagcgggtatgtgtctctcggccagctttcttcctgtttctgctatcttcctggggcaagtggccttgagccttggggctgggcctgaggagggaggagatatccattcccttaagctttcaggccccgggggagaatctttcacctttgaaatgcctgaggaaaaaactatctttttaaaattttatggatttaaacattttctgcgtgattttgatttgattccacactgaaaatgttttctacaggaaactgtagagcgtttagatcaaatgctttttccacctaggcagatatttgactttaaatatacatatatatataatatatatatatatatatatatatatacatactatatatatatagtatattgtacttctctttatctttccataactccactctgtagtttattaactgtgaaacgacatggaaatgagagataggcaattatttgtatcttctaggaaaacacaatcaagttggggagccatgacccttaaatgtcatgactgatacacataaaaaagaaaggacactttaggaagtgtgtgccatggggtgcgggggaagcctcagttgatctcattgggaaggatggaagcttttctaggtagctttaaagatcatgatctggaattggacaagctctgaagtttcctattacaactaaccattatatacttgttatatatatgcttattatatacttgttttcctgtaatcagctggagagagtatgtccattcccatagactcactgttaagtgccattatcataaagctgctttgtgttcaaaacacttttaattactaggaacaatatttataagatgggtttgatttttagttagttattataactttcctattataactaactccccagcctacatatcttctatttcttcccaacattgcatattccagcaattgaaaattatcacagctaaactttaatttgaaagagtagaaagacaatagttaccctcactgcttatctgtaggtaatgtgcctacagcaagatagaaaactatatcgagtctcagaagaaggagcaatgcagcctacaaatgattcagtggtgactaggatttgtttttattactggcattatgaaatagaatgcatttcaaactgtgagtcctacctctttctaattattttctccacactttttctttcctgcactctatcttccttttgatttcctaaatctgtttcttcattctgggaggcagcctacaccaatggttaaatatttgttagtaaatgtcatggtgtgctgaagagtagcattttaaagttatagtaatttatttatgaatacaaggttagaagacaagtcaatttacctcaagatacttgtttccctgtaatcaattgcagagagtatgtccattctcatagactcactcttaagtgccattatcataaagctgatttgtattcaaaatacttttattactaggaacgatattttaaagatgggtttgatttttagtacgaagaacctacatttcatcttttaaaaaggtatcttctaaaaattttctaaatctagtttcattgtcccaaaagcatctcacaagattttaaatgttttttatgattagattgttgcatcaacatgctatcagatcctaagctatgtttgctagttcttctcctcaggtacattaaattaattgagcatattgtggcctctgcagcatgatgttttgctagtaaatgattcatgttgcgtcccaaccacagtgaacagcaaactttcaccagaaacagatggaggaatgatcttggccatttgtggcaacctcaggttcatctaggaaaaactgaagttcatttaaaattgacctcaatatgctgttggccagatttgattcacctcaggtgcatggttctactgagaaagtaatcagcaccagcagatggccctctctaggctcactttcctaggcaattaaaaatctgttgctaggatatataactatcaaatatttgatatctttacgtggcagcacttcccctcaatttatgtgtcatgaaatttttttcaagaaatttctaacaaagataaaaatctgggttttggaatataagtgaagcaaatgcagtccccttccctttgtgctgaactactttcccgcagtacataattttcccctggttactcagattttattctcattaaaaaaaaaaacagctagcaaacttttccctgacttttccatatcaaactgtagttttatgctatgttaagtgatgatgtattactgtacttttatttaaatataatagtgctgccaatctggtagtgagggatatattatgagctgtatttttaattgacagtcactgatccaacagagactttctcttattctcatgatcatgaacagaattttatgagacagatgcccagaccaagtggcaaagttaaacagggtccatttatataatagaatttatgaagtctaatttgtgccaagtagataacttgattagatggggtaatgtgtcaaatgggcaattaactattttatgagcaatttttttcaatggaagtttttttctgtgcaaaagctatgaaacatagaattatttctaaatcagacaaagaatttagctttatatgctattaaaaattctacaaataagaaaaaatgtacaggaatatgaatgaccatgtgaatgcaactgaaattatttgatcaccttcagtaaactattcaagtagttgttttaaaacaaaaaaagattcttaaaacccaatttaggttagaaagcagttatttttggaaattgccatagaagttcattttttatttagccaccatttgttgagtacctatcagggccagcttttgtccaggtggtaactttgtggaagctagattaaggcgcaactccaggaagacacagtttgcagcagggaacagtgcctgcaaacagagcatatactggaattcaaccatcattcaccctcttgaagagatactcttttcactgaacaactggtacaatgtatgagatgatccctggcacctactgtatctaggcactggaaggttaatggtgagcaaatcggttattgtccaagccctttgaggacatgcagatatgtaaaaaggcacacattaaagaaataatcgtacaaataaacacacaattacaaagatgtattagatgttttgaaagaatagatactcagagaataatactagaaaagtttcattcatgatgaaagatcaaggtagtcttctctgaggatgtgatgcttaagctgacatttcaaacatgagtaggagtcaagtgtagagaggagaatcttctaaaaagtgggaacagcatgttatgacctttgggttgaaaactttcccatattgaaggaacttaaaggaagtttcagtgcctggagcataatgaacaaggctggagttttgttaagtgaggtcaaaatcactccagatcatgtagtatgtgttaagaactttagattttaacctaaagtcaaaggccagatgctgaagggtggtagggaggaagtaatataatcatacatgcgttgaaataaaatctccctagcttttgtgtgcaaagtagattggaggaaggaaagacaacatgcaaggagacagtgaagagatttgcagtaatacaggtgagaaatgatggtgattggtctaagaagctggcagaagtgatgggtagaggttagaaatgaactccattgacctttgtgatggactggagttgtcacagtagatgccacaatgtgagttattagcagctggatgagtaaagataccactgagggagaaatgatttactggaggaggggaaggcttggataacagatgttctcttcatggagatatttgtgagatgtgctgaaagatacatcaataggcagttgtgtgtgtgtgtataaatataagtgtgtgtgcgtgtgcgtgtgtggcctttgggagagggctgttactaggtatattagagtgaatgttgttaactcctgcatgaaattccaagttatggacatggatgaatatacctatcatatagtagtaagccaaaagaaaatcaagaaaattgctgaaaagtcataatctgagaggactgaaagaaaaaaaaaaatagcagagagcgatagcatagggcccaggagcataaacaggcttcaacacatctgttaatttgaatgcagctgtggagtcacataaaagtccattggatttgccaactgtgggccttagaagatcttagaatagtgaagaaatgtgtataatagttattgaaggaaactaagagcacatgttaactggtaaatgtaggtaactttgacagcccatgtagcaagaaaagttttgtttcattcgaaaaaactaagagaatggaaaagaaaatgggtggcattagcaactgcttcagctaagagaaatgtggtcccgaagaggattagaaacactaatacaaacttcatatatatgtgtatatacctattatagggatatataaatttatatactataaatacatgtatagtcataaataggtatgcatatatatacatatatataaagaaacagagggcacataggctggggagtggtatttttaaaagctttagagcttgttcaaagtattggagattatatatatatatagacacacacacacacacacatacacacacacacactcacacacatacacatgtatatatataatgccttaatgcacgtttgaacattaaggggaaggatctagtattgagaggtatgtttaaatgcaggtgaaagatgtaataatcaatggagggacatccttgaatctttgataaaggaagatttagagacaatatggaaagccaggcttttgtcacaaagagggatgcttctgctgtttttttctatttttaattttagtttgaaatttttcaaattgagaatagatgaaaacatagagcagtggtctcttatgtaaccaccatagatattcactaattggttgcattttgccacatttgatttatatagatgtgcatgtatatgaatacctttatgtatatgtgtatattttttcttaatccacttggaaataagttacaggaatcatgacccttcatctctgaaacttcagcatggtttttccaaaattagaatatattttggaaaaataatacagaagaaatgtaggctttgttttagtggaggaaagaaagagagggcaattataagcagtgtggttggtggtgaatactcattggcagtacagagaaaccattttgctgatggaatgaagcaacatcattcaatgagaataagggtagggagattagatccaagatcttagaagagtcaagaaaagtatataataggaaggttagatccaagatcttagaagagtcaagaaaagtttataataggtattaagggaaactaagagcacatgttaactggtaaaagtaggtaacactgacgggtaatgtaggatgccccatagaagctggtaatcatcagtttaaataatagataaatgtgattgcttagcaagtgagttggaaggataccagaatatgatcagagtgctatgcttgactttgtgtagcacttgtaacgacaagtcagtaaagattgaggcaaagatgttctagaaaaaagaaatagtatgtaaatatctgtgaatacaagaaaactcatgactaattcaaggagttaaaataatagataagtggtaaaagtgaagtgggaaaacagggcacagcagaacttgattaagtttgttcatgggcactagggataagagcatcaacgaagtcgtacaatgtaacaagaagatataccatagttgggagaaaatacgaacatatttgtaactctacttaataattttaaaataaaactttgtagtaaaatgtattatactatgatcagagagtggtgttagaatttgtgacgctttccatggagacaatatctagcatgccactctgggtatggaaggaagggacacagtgggagaggattgcttgagataagatgacaaaactgaagagccaagtggttagactgattgcttaaagggaaatcaatattatctgtgaaattagcagtaatgggatgacagtagaactatggaccttcataggatgccagaaacttctagagcattaatgtaaggaggatattacagtatcattgcttcctggtacatctctgaaaaaactattaaataaagaataaaagaggggacatttatttatttattcactcatttataaaataaagtaatgtcagtagtctaagggggtcacgaggaaacctccaaacatggtcattcactaggaaaaagagaaaaatagctgcagagagagagaaaaatgtcaagtttcaaacaagatcacaaggcagaaagattaatttaaaaagatcttgtggctatagataattttgcattctcatttgaatatattttctggctgtttttcttttcatttaagatgtttaaaagcagtggctaacaagtaatcaagtacatcagcttttcagacttctgacataatcctgcaaaaggaattagtaaatattgagatgtcaagaatgagtttttaagctatgctgagtaattaagcacgaccatgtttaaattctgctggctttagacaaaactctatatccaggaacaaattaaagataatcaatgttgaacaccctattttgtgcaatactgcaataggtgaccatggagaataaagtagtcatgccatttagaagacatgtctggcagcacagagccagataaatcacttctagtgaaaatgtcctggtgaaagttttatgtacatttcccaccttgccctggtgaactatctgcacagtctgactttactaacattgtagatttcatatacatttcaggattatttatttggatctattcaaatgcatttataattttatataattataagaaatgtttctcaaaatttcttaactttttagacattactctgtcctctctagccttacgtgcaacaaagtcaattaacatttaccatatttttatattccaaatgcctcatttttagatatacatagcaactatggtttattactttatcctgtgattctttccattatttttatgatatactgtacaaacatagataactctgtaaatcaaagtttaccttcatcctactgtgtagatagtaggtaaataaaagtaatctatgttagataaggttctaaagaaacaagcaaatggtatttaacaaagcttgaattatagttccttttctcagaaacgatttcttcaaagtaacctaaagtttcttatttccctacaagtcttcaacactttgcatattagttgcttgtatatttctaggaagtatactcatgtatttattatgtacagatcatagaaaggaaaggtttctttacgttaaactttgaaaaccaatcaagcaaaatcttccaggttaacaagcatctgttgagagccatctgtaggtataaattcagaaatgtaagcctcaatggaaattgcttattttaaaaaattccaaagatggttcgttaaaggcaaacaacatacaggcacacacacaaaaacaaacagacacaggtacacgtgtctatttaaaaaacatagggtataaattagaaaatataggagtaatttttttcagttacaaaaatcacatatatatgcctgatctactcatattaattattagacagaatttcactcactgaaattgagtacagaatttaactttatgcagcataaggaacttcagggaatggaagtttacgagaggatctagtgatagtgaaggatcaacagggagttgattatctggagcataaaacaagatgatgagcatatggccaatgaataacttttgacatgggactgacttactcttgagaagtataaaagtatttttactcgtgttcattgcttttgaatttctgtttcaaacaaaaaacagaccacctggagctatgagatacgatgaatggtaaaaataaagttagtggggtaatccactatttagatgttcccatctctaaaattatttgcttatacatttaatcaaaatatttataggactaaatctcagatatagtcatacttaagataaatagaaataactgtaaattttcattaggatgtattttatggattttttaaaaaaagtgttcataatccagaaagtaaaaaccatctgaaattgaaaattatggtttttaattaaagattttaatatactttattagtcaccttttcaagtttactacttttcaagtttactatcaaaagctagaactcaatacaaatatggagcattaccttacccttattactatactaataatagattttttctcgtttgatcctcagtcccctgcaaaatagatgagctaggtatttctattttcagttaatgtcccaacaatcaaattttgttcaagtacttggagaaatggctaggaatatttataggtttccaaatgattgagttttcaatcttctcataattactgtgtagttgttctgtaaaccgtagagtgttatgtaaatgtttgctatattattagttaggctcttccagaattcatcttccaggaaaagatgaaatacatatgctctagtttatattgataggtcatcaaggaacatgacttatattgagcttcatgtagaggattaattaatattcaggtgctcgccttatcaacctgtgcagtctagcttttgctgccaaagaggattccaaagaggttaaggaaaatctggactatatgtcttcagagtttttcaaaatacaattccaaacaactttaacattttaaggcattaatgatttgtgtttctaagttttctgtaacctttgattatctcttcattgattgtgccatctttattttatgcttaatttgtactggattttactggccactgtatattttatatactttctctcagttaattcccccagcaaccaattacgatattatgagatgatagataaatctatcatcaaggaatagctcttacaactttattaaagtggaaactgaaactcagagaagtagaaagttaattgtccgttgccacacagttaataagaagtacactagaagcagaaaccactattttattttaattccaactcctcttcttttcccaccacatcatagctgttctcaaaagacttatcagtgtctttgggagagaaacacattcaatgacttactatgtaattttgtgattgagagaatgacccatgtggcaagttaaaaatgcaaatatatttcctttacaaacataatttaagtatagaatggtagcactgttttactattttatgagatgtatattatgaatgggaattggaatcctggtgcctgaaagtatatcaagggtattaattgtgatactaatgtataaaagaaaaaaattcaaatacccatgggcacacatacttaaacatcatcttctagtgatactcattttttgaatctcttatgaaaataaatcattgtcaagaaaaatgttgccaacacagatatattccactagttttcttattgctaatgagcacatgctgcttcataggagtgatcagtgtgttacatgcaactgcaggtagatcagtgggatgcaagaataacataaagcttcagagaaggagaaaaaaaatagcatgtatacaaacaagaatccactgcattaaaaaaataaattctgttaaaaattcacaaactagaataagataaacaaaattaaataaacagtctcatgtcatcataaaagacccaaaatacattttccttataaatgcaaatattatgtgttcgtaatatggcttgagcatgaaaatagaggattatggtaaaaggtgaaaattacctttaaaaattatatatgacatttttgtccgggcatggaggctcacgcctgtaatcccagcactttgggaggctgaggcaggtggatcacgaggtgaggagtttgagacatggtgaaaccccgtctctactaaaaaaatacaataagtagccaggcgtggtggcgcatgcctgtaatcccagatactctggaggctgaggcaggagaatcgcttgaacccaggaggcggaggttgcagtgagccgagatcacattgctgcactccagcctgggtgacagagcaagactctgtctcaaaaaaaaaaaaattgtatatgatgttattaaatatattctcccatcaataaataatattctcctagcaattaaagcttggtaaacaaacacataagaagaataagccaaatcatctgatctgaaataaaggtcatagtaaataattcgtattatcaatatacatctattttgatataatcagattcaccttcctaccagtgtttttattgtgtcctacaaagcaagtattgatgttgatcttccttaaaatctgagcttttacaaaccaattgcttgtttatatctttctttgcctccaagatggtgcgttatttcaaacatgttcacatttgttgaatttgtacataatctacattaattttttacatttgaatagaaataaggtgaattacctcaatttatgcaattcatgcctctatcatggtttgttagatgtttgattgtagtacactgggtctctgtatttacttccccatgttagagaaggggacaagccattctgaacagagcattggagtaggaatcagaactcctgggttccagacatggctctaccaatagtttgtgtcccagggaaagatattctatctcgttgtacctcatttttcttgtctctaaagttaatcttcaaaggattacataagttgttctcaattctggctgtataattacctgacaaacttttaaaacctcctggtacatagtccccatttcaaatatattaaatcagaatttgggggagtagtgcaatgatatttgtaaagatcttcttagttgattctatatgcagaattcattaagaaagactatttttaggtacggggacccattagctgttggttgtcttgaatgaggtttaaccaggcccacaagacttctgagtaccaaaggcatgtataataatttagaagatggtatgcatatgggcaaaaatgttgtgtcatgtatagcacactccaaccaaaagaagtcttgttaaaacaaaattcagcgaaagttgttgcttacctgcttagagcaaagaagtaattgtaatgagtcattataaaatctatgataaaatccatgtaaatatgaagaattcagtttggtaataaaattattatcaaatgtagaaataactatatatgaccatatgtggcctgtaaatggagcaaaaattatatttatttttagtaaggttttcaagttgctgttgtgacataaaatatgaaataagaaacatttctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaagaaacatttctgaggccaaatccaatgattctgttttattggtgctttttaagtaaatacctccttatactttctgaaatatatttttttcacatttggtgagaactctattagcaacggtctggaaagtgtctgccatatacaagccaaccctaattagttttaagcctttgagccttatttttaatttggtgaaatccacgaaaagtttccaggtaccatttgaagatgtattaaaaagactaaaagctccaaatatcaagatggtcttgctaaagttttttgtttgttttgttttgttttgttttgttttttgagaaggagtcttgctctgttgccaggctggagtgcagtggcaaaatctctgctcactgtaatctccatctcccaagttcaagagattctcctgcctcagcctaaagtttttaaaatttatttaactgtttcctttatacatagattggcatatagacacttgagactatccagtgcggatgatgatgatgatggtgctggtggtggtaacaatggtgatgctagtgttggtaatgttgatcaagatggtgatggtgatgatggtgatggtgatatggtaatgatggtggaggtggtggtggtggtggtaacaatggcgatgctggtgatggtgatgttgatgaagctggtgatggtgatgatggtaatggtgatggtgacataataatgatgatggtgatgatggtaatggtgatggtgacggtcaagaagatgaggatgcctcttatcttttaccttgtcaattacaggccaaaacataaagagacatatcagctgcatcaatagtaaacctagttatgcctacaaatattttcgatgtcatgtaatttttgtgatgtttttaaacatgtgtaaaactacacttttgtactaaggatatgatagtatatcataccccaaacatcatgaactgatgaaatctcttgaaatattctttgaggataacaatttagcaaacagaatggcatgtataaacttcagaaatcagtgaaaatgttcctctcttaagttagtttatgtttgggaattgcatcagtgttttcttggtatgttattcctagccccagcttgaacctaatacttggaggataagtaaatgggaagaagtagttgacttgtcgtgtaggactgaagaagtaaacaatgagattggattctaaagacccaagtagctgggatttgccctaagagagaacagtctcccagtctgagagccccagtctaacgttagctggaggaagaagaggactgttaccagagatattcaaccagaggcttcacctattgtgatgtttaaagagattcctgccacagctgaaagttattttagacaacttctaaggtctctttcatttctataatctgtggttaatgatagaagcctaatcttttgggtaagatgcttcaactatataaaaataaatgtcatagtgatgtagtttgacactttctttgatatattgcaataactctgacttctctttttttaatactttgtgtttgatgttggaagatagaacagagctttaagtttcacttttgggttttttttaaaggccttgataatatttcaggatagaaagatacctaagcagatattagtcattttgactaatacatacacaactcatatggcaatctcatcaccaaaatccaactaagattttagttattgtgatgtaactaaatgttggggctagaaagggcaattgatttgtgaaagagaaatgtccattaatttaggagatactaaaacacagaatgtgtagttttgtgctacaacaccctctctgataataatcacaagcttttcagaggtttaatttcagaagtcgtggtaagaataatgactatatttaaggagtctgaggaacagctttgcaggcattatattatttggtcatcacaacaactctttattctattgtcttcatttgacagaaaggaaaactgagagttggagttgataagtacctcaaccaatatcacattactgtgaatgacaaagcaggacttggaatgcaggaagtcagcctccatcatctgcacctcttcccccacattccacaatctaagttggcagctcccatgcctgcattcatacctctagttactctgtcttcctgatataactgcactgatatggtttggctgtgtctccacccaaaatctcatcttgaattgtaataatccccacgtgtcaagggagagatcagatggaggtaactggatcatgggggcagtttccccatgctgttctcatgatagtgagtgagttatcatgagatctgatggctttataagtttttaacaatgcctccttcggtcattctctctcctgccaccttgtgaaggtgttgcctgtctccccttcacctttcgccatgattgtaagtttcctgagtcttccccagccatatggaactgtgagtcagttaaacctcttccctttataaattacccagtccctggaagtttctttggtggtttttttttttttttttttgagacagagtctcgctctgtcacccagtctagagtgtagtggtgtgatctgtgctcactgcaacctcctccgctttccgagttcaagttattctggtgcctcaacctccagaatagctgggactaccggcattccaccaaacccggctaatttttctattttttgtacagaggggcttgcaccatgttggccaggctggttttgaactcctgacctcaagtcaggatctgtccaccttggtcttccaaattgctgggattacaggcatgagacaccacgccctgctgggaaattgtttatagcagtatgaaaatggactactacatgcactgaaaatgaggcatttctgcctaccagttaaactatattttacatatgtgcatggtgattattaaataacttttctattcctttattcttcagattcttttcctttttcttatcgtcaaataatgaaaagcaataacacacattagtaccaggccttgccccagtttatctctcatcatttattaagacataaacaattaacttggtgtttatgtggtaaaggtgaattaattaaaggaaacgacaaccacaacaacaactcatagccaaagcatgctgttgccgtaaagatcaaagtcagtgtttggacttcagatttttcagagttataacctcacggaagaagcataacctcagattttcaaagtgaaggttatggctgaatattcacatgagtgatttttttttcattctgctttaaggacctataatatcctaaaaagaatatacattatataaaatggtagcccactttttagtgactattgcaggaattaaatagtatcataaaaatataatttcacgtgacataaactgggagggagaatgttttcaggaagggtaatgtatgagtacatacaggttattcagttcctcttaatgacttgaagaacataacagttctaatggaaggtatttcatgaacaacactgctaggcaccagtcaactcaaaagatgtagggcaggaggctaggtgcggtggcttatgcctataatcccagcactttgggaggctgaggcagggggatcggttgagctcaggagttcgagagcagcccaggcaacatggtgaaacttcgtctctatcaaaaatacaaaaaaaaaaaaaaaattagccgggtggtggcacgtgtctgtggtcccagctatgtgggaggattgcttgagcctggaaggcacacgttgcagtgagccgaggttacaccaatgcactccagcctggctgtcaaagtgagatactttctcaaagcaaaaaagatgtaggacaggaaacaaagcttctgaacagggcagtattggaagttcctgctcagccccaaaagttttgtagccatccatgtagcccagctcagaagcaacactccattgggtggtatcagatattctggcttagaagcatcacatctcaaagcagccagtatgtctgtaggtctagttttatgggcagagctgtatccccaaaacttgtatggtaaagacctcagaatccccagtacctcagaatgtgactgtatttgtagatagggcctttaaagaataattaaggtagggtgaggtcatgtggatggaccctaattcaatataactagcattgttttttgtttgcttttttgtgttttttgtttgttttgtttttgagacagagtctcactctgtcgcctgggctggagcacagtggtgcgatctcggctcactgcaacctctgcctcctgggttccagtgattctcctgcctcagcctctcaggtagctgggactacaggcactcgccaccatgcccggctaattttgtatttttagtagagatgaggtttcactatgttggccaatcttgtctcgaactccagacctcaggtgatctgcctgccttggcctcccaaagtgccgggattataggcgtgagccacaacacccagctatgactagcatttttaaagaagagattaggacacacacacacacaaacacacaaagatcatgtaaaaacacaaggaggagaagacagctatctagatgccaaggacagaggcttcagaagaaataaccttttcaacatcatgatcttagacttctggcctccagagctgtgagaaaataaattatagtactttcttacagcacagcaagcaaactaacacatcttggagtcaacatctccacaaaggatatgcagagttacaaaagccgccagcctcaggcaggccctacccatttgactgactaccctgtctgagtacccatttacagatcctcctgaatctaaatgcaatttactaatccgcagtctttgtaaatattgtttttaataagcaatgttgaacactgacgtatgtaacagtgcaatttgtgtctggtttctgggagaatgaggtgaagtgttaacgggaggtcaagttctcatccagctggggaaaggctttagtatatcctttgcccacatcatagcagcttcttttatgatgggctgaggtgagaggagagatgggcaagattttggccatttgatgtcatttgttctctgtaagacactattcttaaggtagaagatattacaattttagtaaattaaaagagatttccaaaactgaaactttccaaaacctgtgactgctacagcacattatcggggcaacatgtttcagttattttcctcagagtcctcccgggaagaactctctgaagagctgacttttaaagtgagtcttaaatgacggcatatatccagtcatgggaataaactctgtcctggcagggaactgggggaggagggctctgctattggtccatcaagagccttcctgtgaatttgcatgaggctgtggattcctctgggaaaatgcagccctagaccagagggtgcagcttgtcgaggcacacagtgcacagggtgcatttctgcaccccatggccactcagctgagcaaccttctgcgtgggccaacctcccctgtcacataagagacatctgagctttaaaaatagtagctatgaatctctctgaaatgaattaataggaagtgtaacatactggaaagaaaatgaacaagagagtcatttgctgtatttgttggctaattggaaacggagctatttataaccagtgaactgggtgattattggaagaagtaaagaatttaaatagtttaaaaaagtaaatattagaatttagccatttgatagtatgtctttttcagggatgatagggaaaagacatcatagggtatttgagtcagaagaagcaacgtgaaaagcaaagcttgatcaccccagcaatggaaaatggcccgtgtggctaaaacacagtaagcagggtacagagccagggagggggtgcagactgtggtggagaagaggggtgccagtggagaggaggtgaaaagatagtcagggacttgtatttggattttatttcaagtgcaagtcattgaaggattttaagcaggaaaataacttggttgtttttttcctcttgctttaaaaagatcattctagctgaaacatagaaaatggattgaaagtttttagagttgacacttgagatcagctaagagactgctaagttatccactgagaaagaatggtagcttgaactctgatcgcagcagtagagatggagaaaagtggacggatcagagacatctttggatttagaataatcagaaggtaccatgctatgaagaaaatgtgaggtgaaaaaaagaagtgtttattctcaatttccttctttgaacggtctatgtatagcggtgtcatttactgaaatgggcctgccttagtgaagtatagatctttttcttttcatttttccctttttttgttgttgttgttttagaagttatgaaaatccttgatgtgcactgcatgattctggcttcactgggcacactgtgctttgttctccctccactttccaaaattactttatgtgaaatttagaataacatatatcctatatattaactatagaaaaatatgaaaataaatttattggtcgagtagtcctgtcaatttaatgactattgataaaaagaaagataagacattactcaaagcactactacttcctattttattggatggagtttacatagatacattgcataatcataaagcaactaagtttcctaaacatgtgtggatcccttcatattctaaggaaggcttaaactaaggagacagagttcttgcacaccgggaagcatacctcgagaaagatgatatgtacacaaaataatcaatatgcacaatttatgcagtattatatattgtgcatatatatgataggtacacaaatattgcatatacatttagatgacacatacataaatattctgtatatttagattcaatagttggtacatacacagatactgcatatattttgttaatacttaacacgcactgcagatatttgcatatacttaacatgcactgcatataccctaagagagtgcaaactggcattgatgtgcaaagtaatagagaaagagacaaacaagaatttttttttttttttgagacggagtctcactctgtcactcaggctggagtacagtggcatgatctcagctcactgcactctccacctctggggttcaagtgattctcctgcctcagcctcccaagtagctgagactacaggcatgcaccaccatacctggctaatttttttgtatggggtttcaccatgttgaccagactagtctcaaactcctgaactcaggtgatccacccaccttggcctcccaaaatgctgtgattataggcgtgagtctcccaaagtgctgtaattataggtatgagccacagtacctggcccaaactagatgtttgaatagagaggttagcatttgaggaagcacgtaagggatttgtgtgattgtgagatggaaataagagaaaagagaggcaaaaggaacaaaacaaatgatgagtcaaaattttaaaaaatgaattttatgtccagattacaagtatcctagtttggctgaaccataagtgattttggggaagaatgtgtggctaggcatgaaggatattaacaatgctaagaattttggcattatgctacgtgcaacaaactcattgaagattcttaagcatttcaaacatttttcaaaatatttttcagtggttatacattttaaataggtactttttgttttctaccttttatatgttttctatcctgcaattttctattgctttaaccataatcttataatttattctctttttactttatgtgctcctttgcttgtctcactttctttccctctgtgtgtgtttctttcccacatacactttaggattaaaaaattacaggtgttataaaaatcaatatagttgaataattacagatgatataaaaatcaatatgaataaatgatggattgacttttaaaaatagcaactatgaaactcaaatcaattaatagagtgcacagcctactccaaaggacaaataagagtgtattcaggctgggcgcggtggctcacgcctgtaatcccagcactttgggaggccgaggtgggcggatcacaaggtcaggagatcgagaccatcctggctaacacggtgaaaccccatctctactaaaaaatacaaaaaattagccgggcgaggtggcgggcacctgtagtcccagctactcaaaaggctgaggcaggagaatggcgtgaacctgcgaggcggagcctgcagtgagccgagatcgcgccactgcactccaacctgggcgacagcgagactccgtctcaaaaaaaaaaaaaaaaaaagagtgtattcagcatatttattgagtaattagaaatgaaaataacgtttatagccagtgtacttagtaaatggattatttgaaaaataagtgaagactttaaatactgtaaaaggaaagcagataatagaatgtagccatttggggacagtaaggaaccatgatgcttcctgcctctaatctcagtggttttagaggccaaggcaggagaattgcttgaggtaaggagtttgagaccagcctggacaacatagtgagactctgcctcaacaaaaaattaaaaattagatgggcatggtggtgcatgcctgtagttctagctactgtgcaggctgagggaggaggatcgctggagctcaggagttggaggttacagtgagctaggattgtaccgtggcgctctggcctgggcaacaaagcaagaccctatctctagaaaaatagaaataaaaaagtagccattttcatgttgttatgaaacctagttagagctcttctttcttttactgtctgctcctgttttagtaatctctaaacagcttattaattatatattttcttatgtattttaataccctactgatgagttgatgatatatttctatttcttatctcaatctgaaagttctgggtaaaatcttttgtgcaattatttagcaacttatagagtcattatatgatccagacaccccaggttagaattcagtttttattttcccacctctgttgtttgggagtagttcctaaggcaacaagaaggaagtagtcagcatataggaggagaattagtaaaaatgaaaatcacaatacacacatggtctgagaagtttgctttttgtctaataggatataactttatttatattgttttggtaattcttaagcaaatatgccactttgaaatgaacatttaataaaaattcatttactgagatgtgtagtgacatacgtgaagtaattgagtaatgataaaagaaagaaaatcatattggagcatctttaagattttccttggataatgaataggtattacctccagatagaagaaatgatttaacccattttggagaaacattatcagagtttatctagatattttacaaaattattttatccccccaaactcacagctgtttctgtctcttctttcacagtgatagcacattatttgaacagaatgagaatatttacttgtctttcttagttgaatgacacatttgattactgttcacttatcttgtctaccagctccattgagcaaagaaagggtacaaatagatatcattttatattctcaaccatacataaatatttttatattcatgtaacactgaactaatagtaatatatatgtttacttagtatgtgtgtatatatatatacacatgtgtatatatatgtgtgtatatatatgtacacatatatacacatgtgtatatatatacacacacatatatgtgtgtgtatatatacacacacatatatatgtgtatatatatacacacatactaaggcatgctaatcgtgaagaaatgttacttctatgatatgactttcatagtttatttgtgtgttcttcaaggttgccctttgaagccatcgtgaatatgtcattcaatgatatcaatgactacattagtactaaaaataacttgaggctgattttttaaaaaattgatttctattgagatgtcacatggtgtaatgtaaagtgaatgggctttggagcaaaaagacttaaactggcactgtaacttattagcactgtggcatttggttccaagccttggttttctcatctgctaatgagaaaagcaggacctaacttataaaattgttataagaattagagataataactgtttgaacagcgcctgacaaatatatcataagcattaaacaacttgctatttgagttctattttctttttttaaaaaattattattatactttaagttctgggatacatgtgcagaacatgcaagtatgttacatggtggtttgctgcacccatcaacctgtaatctgcattaggcttttcttctaatgctgttcctccgctagcccctcaacccccaacaggctgcagtgtgtgatgttcccctccctgtgtgcatgtgttctcattgttcaactcctacttatgagtaagaatatgtagtgtttggttttctgttcctgtgtttgtttgctgagaatgatggtttccaggttcatccaagaccctgcaaaggacatgaactcatccttttttatggctgcatagtattccatggtgtatatgtgacacattttctttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaattatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggatgaactagtttgcagtcccaccaacagtgtaaaagtattcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgttggagttcattgtagattctggatattagccctttgtcagatgagtaggttgcaaaaattttctcccattttgtaggttggctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacatttaaatctttaatccatgtgacacattttctttatccagtctatcactgataggcatttgggttggttccaagtctttgctattgtgaacagtgctgcaataaacatacatgtgcatgtgtcttcatagtagaatgatttataatcctttgtgtatacatccagtaatgtgattgctaggtcaaatggtatttctagttctagatccttgaggaatcgccacactgtcttccacaatggttgaactaatttacactcgcaccaacagtgtaaaagtgttcctgtttctccacatcctctccagcatctgttgtttcctgactttttaatgattgccattctaactggcgtgagatggtatctcattgtggcttttatttgcatttctctaatgaccaatgatgatgagctttttttcatacatttgttggccacattaatgttttcttttgaacagtgtctgttcatatcctttgcccatgttttgatggggttgtttgtttttatcttgtaaatttgtttaagttccttctagattctggatattagccctttctcagatggatagattgcaaaaattttctgccattctgtaggtttcctgttcattctggtgatagttttttttttgctgtgcagaagctctttattttaattcgatcccatttgtcaattttggcttttgttgccattgcttttggtgtgttagtcatgaagtctttgcccatgcctatgtcctgtatggtattgcctaggttttcttctagggtttttatggttttaggcttcacgtgtaagtctttaattgatcttgagttaatttttgtagaaagtgtaaggaagcggtccagtttcagttttctgcatatggctagccagttttcccaacaccatttattcaatagggaaccctttccccattgcttgtttttgtcaggtttgtcaaagatcagatggttgtagatgtgtgacattacttctgaggcctctgttctgttccattgatctatatatctgttttggtaccagtaccatgctgttttggttactgtagccttatagcatagtttgaagtcagatagtgtgatgcctcaagctttgttctttttgcttaggattgtctggctatacgggctgttcttttcttctcttttggttccgttagaaatttaaagtagtttttttccaattctgtgaagaaagtcaatggtagcttgatgggtatagcactgaatctataaattactttgggcagtatgaccattttcgtcatattgtttcttcctatccatgagaaggactcctccctaaatcattttatgaggccagcatcatcttgataccaaaacctggcagagacacaataaagaaagaaaatttcaggccaatatccctgatgaacatcaatgcaaacatcctcaataaaatactggtaaactgaatccagcagcacatcaaaaagtatatccagcacgatcaagtcggcttcatccctgggatgcaaggttggttcaacatactcaaatcaataaatgtaatccatcacataaacagaaccaatgaaaaagtcacatgattatctcagatgcagaaaatgccttcgacaaaattcaacatcccttcatgctaaaaactctcaataacatatctcaaaatagtaagagctatttatgacaaacccacagccaatatcatactgaaggggcaaaagctggaagcattccctttgaaaaccggcacaagacaaggatgccctctctcaccacacctattcaacgtagtattggaagttctggccagggcaatcaggcaagagaaagaaagggcattcaaataggaaagaggaagtcaaattgcctcagttttcagatgacatgattgtatatttagaaaatgccatcatctcagccccaaatcttctttttttttttttttttgagttggagtcttgctctgtaaccaaggctggagtgcagtggcgcgatctcggctcactgcagcctccactcctgggttcatgccattctcctgcctcagcctcctgagtagctgggactacaggcacccaccaccacgcccggctaattttttttgtatttttagtagagacagggtttcactgtgttagccaggatggtctctatctcctgacctcatgatccgcctgactcggcctcccaaagtgctgggattacaggagtgagccaccgcgcccggccttcagccccaaatcttcataagctgataagcaacttcagcaaagtctcaggatacaaaatcaatgtgcaaaaatcacaagcatttctatacaccagtaatagacaaacaaagagccaaatcatgagtgaactcccattcacaatttctacaaagggaataaaatatctgggaatccaacttatgagggatgtgaaagacctcttcatggagaactacaaaccactgctcaaggaaatcagagaggacacaaacaaatggagttctgttttcattagatgtgtcttgggaacgactgtatcacatagattcagaatttcttgagctgggagggttttagaaactatgaggtacagaacaatttggtaaagaggtttgtaagctgcttcaacttaagccacatgggaatcttgtaatttggtacatttcagacagagactaagactcagatatcttctttttttttgagatgggatatatttaaataaatattttatatttaaaatacataatttaaataattcccaatgaaaaataccaaaaaaaaaaaaaaaaagtgataaacagggctggctgcatagacaggatattccactcccctgagggaatatccatcaagtagaccaaagcaatcatttctaggggggagtaaaaattaagccaaaggaagtgccacaaaatttaatacctgttggtttgtgtaaatacattttttaaatgtgcatttattttaaatataaaaaaatttattatgacaaaccgtaaattcatacatcagattttcacaaaaaatatactcattgatatttataaaatatactcaatattttataaaagcaatcatatcattaggcctcttttcatgcctttaatattgtgttttgtaatagattaggtagggtattatataattcaaagaacgcattcgctcaaggcctttgggaagttgatatctagctttccaagaattcacactagaagactggtccattttattgattcttgctgatagatgaaaacctgatttgctgtacaacctaattctttgagtcccatgttgggacatatttagtacatatttgctttgctttgtgacaaccaatatgtctatataagaatattctaaaaattattttattcaatctgtgaatattatcaaataaaactaggattgctttagaaagttttgaacatatctgttttaccaaacttttattccaaagtttaaaaggcaacagaatgcataaaaaacgatgaataacattaccgttccattatatctccatcttttttaaagctatctctaaggtattagttgtgggtatagggatatccttagagaaagaagcttagaggaaagagagtgaacttagctgtcagaatcgatctatgaaggtgttttctgaaatgacaaattcaaactggcttgaataatatgtaatttattatttgtgtagcaagagtccacatgaaaggtgggcttcagtgttggtagtttcattgattcaacaatgtaggcaaggacttagaccatttcaatctctgtgttctgtgatctacagtgtcaacttcattttggcttctcttattgccataagatgacttcaaatacactttagagctatcctagcctttgattaaatcccatggtagtgtgagactgcctattcctcttacaaggaataaacatttgttgagagaaaattttccatgagccccttgtgtttttgtatatcttctgagcaaagacgttaacagttttgctattactgttgaagactttttttttttttttttgagacggagtctctctctgttgccaggctggagtgcagtggtgcgatctcagctcactgcaacctccacctcccaggttcaagtgattctcctgcctcagcctcctgaatagctggaactacaggcatgcaccaccacacccggctaatttttgtatttttagtagagacggggtttcaccatgttggccaggatggtctcgatctcctgaccttgtgatccacccacctcggcctcccaaagtgtgggattacaggcatgagccaccgcatccggccgcagactattttttaatgctgtttgtatagcagacattcttgaaggatggagattctgcccctctctgagaaaagggctgatatgttttctgacaagggcaacaaagatgatgtctcccattgcagacattggtagtggtccccctctaggagtgggtatttcctaagttcagcatttctctgctgtgacacagacctgctgtgtatgtggcattcaccttagcccaatcccacatcaccctgtgcaatttgggatagggggaaactggtgtgaagctcatgccctctgatgtattgtgagtgttgtgagtaatgaattcttttgtctctgaaccaggggtctctatgtcttctggcagaaaaaataaataaagaggcttttattttgaaagtagagtaaaatcatcctttttgataaatatatttataactggattaatagtaatgcttaagtgtaatttgaaatgatcagtttctgagcctttttagtaaatattaaaaatatctacttatacaagacatgactttccacagttcttatcagtttctaaaaacatttctagtaagtctcttttcccatgaaattagtcaacattggtgtcttagcccattttgtgctgctataacagagtgctgtagagtggataatttataaaaaacagaaattcatttcctcacaattcaagatcgagggattggcattgttgaagaatggcaaaaggtagaaggacaagggggctggggtgagagagagagtgtgttttaaagggagccgaactgccccttttaaagtgaagcgagtcctgcgataatggcattaatccattcattccacccttgtggcctaatcacctcatatttgacttcacttcccaacactgttgcattgggaattaagtttccaatacatacagttgggcagacacattcaaaccatagcaggtgagttccatgtttttcctaaaccatagcagttaagtcagcaataagaatcaaccatagttagaagaggcagccctgtgccttgagctgaggccaattcttagactacagtgctattactcgttatatagaggaagagtggaattaaatttggagactcaaataaaatatcaggcaaaaattctatacccaaataatgatggcatctagaaagacttttgtacatgaaaaacatagaggttaaagcttttttactatgacagtgatatagatggtggggccaaactccaaaaaggatattatttccttatgtattttagccaaagtcagcagcacctgttttaaggaaatacgctaaatgatcgttacaccacaactctcaatcttggtagcataagatctgcaacacatacatcacaggttgtttgtatatcttctttcaggtaattcctaatttatttttataatttgtccactgacagaagaaacaataaaagttctcttcaattattagaattgaaaagaggcagataaatcatcttttttgataaatcatctttataactggatttgtagtaattcttaagtataatttgagatgatcagtttttgtgcctttttagtaaatattaaaaatgtgtacaaaaagtgaatttcacaattttagtatgttagctaatttctaagtcataccctccatttctgtttttcactaacaactgactttagtttaacaccagaggattttcttgagaatgttgagaattaatgtgacacttgacatataaatttagtatttcagtaaagtaatatagcattgtaaaaagcggttaacatgttggtcacagaattacagaaatatctcaactatgctaatgcaaaataggcgcaacaaaaattgcaatttctcagaaggaaggaataaaatactttttatgaatctttaaaggatgaaatgaagatataaaactatcaatttgttaatattgtcttcttttttgaatggcataagatgttttaagtgaaagcctattagagaattaaaattactgtgtgatacaaaggcaagagtagaatttattgaaaaattttgtgactactgaaaattggtacacttctccagagaagatacatgtatgaccaacaagattgtgaaaagatgctcaacatattggtccttaaagaaatatgagtcaaaatcatgatgatatactacttgacagcccctagcatgaatataatttttaaatgtaggaaacaagtgttgtcaggaatgtggagaaatcgctgttggggctgtgaaatgtttcagccactgtagagaaaagtttagcagttctccaagatggtaaacacagaattaccatatggcccaggaatttccctttaaagtatactagaaagaataaaaaattggaaatcaaacaactatttgtgcacctgcactaatcacaatagtcaaagagtggaagcagctcaatgtctaccatcagataaatggataaacaaattgtgatatatacagacaatggtatattattcaaccatagaaagaaatgaagtacagatacatgctacaatgtgtatgtatcatcctggaggatgaacctcgaggacattttgctaggtcatagaaactaaacacaaaaggtcatatactatatcatttcatttatatgaaatatgaacaataggtagatccacagacacagaataaaggtaggtggctgccggtggctagggggttaaaagaatatggagtaactgattaatgtgtatacgtttccttttggggtgaagaaaatgttttggaaatagagatgatgattgtacaacattgaaaatacactaaaagccactgagttccttactttaaaatggttacgttacatgaattttgcctcaatcaaaaataaataaagttcgatatttgtttttttaaaattggtacattgcccactaagtagaatattcactagaatatgcatgtaacttaaagtttattttaacctaaatattagtcacaagtcatatatagatgaatatcataattttatcatgtaaaatgcctagttgctgattacaaaattgtaaagtttaatttttaatttacaaccttttatattaagcaaaacataacagtttcatgatatttatatatttctatttttctatcatggtaatgaaattttaaaaaaatccagtgtggaacataagacttcagcatctatcagggtaaatgtttatttgttagtaaagatgctttgggagtctatttttaaatgattggacatatgttttcaaatacattaaaacctcattctccaggaccacctagtctattcaactgaagagctattgcttaaagccagctttccgtaaaaattaaatatttaattatctaactaccctctcgagacaatcaaaatagctcaaattcattagtgttcattacagtttttttaaatacatgccaactatatttcaaaagacttcattttttgacttaaggacattcagagttgctatcaaaagtttgcagtgtttgtcccccttaacctttgcagtgacaatttcaaatgaagaaaataacctctatctgtcttattcaggcacatttttaggggctaaaagttcatttttgacatattcattcactaaggataatggatatctctgttggcctttgataattatggttatgtggccttaatagggataatgaattatttaaaactattatgctgtttcttaaaatttaggagacaaatatcacttccaagtactcttctgagtgttgaaggttatgtttgtcctgtttgggttacttacattagtggaatgttttcaatgtaaaactcattctttattaccaccaagacacaatgtcaagtacttttccttcactgctatttgttagaacatattatctgattctgtattttcttcctcatatacaaagtcattacagaggtgggctggtggcttaggccagttcatcattcagaaaataaagctgttttttctacataatcattgagataagtagtgactgctgaggctgatggtatcttaaatcattgatcattcgttggggaagtagttgtatatgcctattatgtgtcagaaattgatgatataaagaacaggtttgaccataacgcatacaaattctattcaacataaagtctaatgttcacaaattgtttcatgctctccaagagaagaagaaagttctcaagttccctaatgttgtccaaaatgaaatacaaaagggaaaatatttgcaaaaggcaggttcactaatatttgtacatctgtacagaaattcccaccatgaaaagcttccgtacacatatttgagcatttatttgttcagtgagtatatgttgagcaactaccaggccacaggcacagtactaaacagtggggacacagtggagaacaaaagtgacacggtgtctgctctcttggatgttcaggtgaaatgaggagagagtcatggggacgccaactgcaccgaatattgctaacagaaaacataaataaatataaaatgcttgaaatggtctgaaggcaaattacagggtgtgctaaggcagtgttttaggagatctaatttagattacactatctgggaagccatctctgagcaaatgatagtgaggcagtcgccaaagggtaaagaggactctcctgggtgaagggtggtgggtggagcatttcccataggcagtgtgaggagcagcagcaggaagctctgctgagggaagagtgtagggactcagagatcctcctgaggaaatgacagaaagcaactttgctagagtgtagtgagcaacacaggacagtgtacaagtggtgcaaggaactgagcaagttagaaagtaccaggcctctgaaaagtgcattttaatatttatggctatatccttaaatctcagcgaaagattggcatacatgcacatattccagttagcagtattatcaccaaaagcacacatcaacatccttcttgttaactgtgttttcaggatggctgagggtttcctcatttaaaaatacttcataatattatccattttgggaaaaaaatgtatacacttcaccatatgaaaggctataatatgataaaatctaaccttttatgaatgccttagagataagggaggcagcactccacagatattcctgaattaaatttaagtcagagatcaaccaataattacctaaaatatctgtatagttctactgaaatagaatgaataataagcactaattctacaaagtaataatttaatattacatagaccccatggaaaactaaaaaacactgtgaatctataaggccaattccttgtattttgttaagtcccttttgtattctcagaaaccctggctactcctggtttgtagttctgtaacaaaatgaagactttcagtttgggggagtatttctattcttagaaataagtggtgattacaaacagtgatggggttaccttcattgttcaaggagactgaagggtaaaatgttaaaaagaatacctgctgaaagctttgcagactaatttattatttttaaattctttcattagtcacagacatgagcatattatttacacttgaataaacctgcccttttaaaattgagaagggaattaaattcaaaggactttcttatataaaacaaaaatttgctttctgcaaaattatttttatccatcttaagattctatgcagtttgtctgtttcctaatttgaaattcagactattacaatgataataataatgatgataataataataataatacctcttagatgtactaacttgaggcagatggaaatagaaaatccaagctgctattcagcgtataatcactatgcaaatattccagcagcttgtacgatttttcaaactattatctcaagagcaacaaaccattatactgaaaagttgcaaaagacagcacagtaaatagatgttatgcatgtagagtttgggacaatttatagtcaattcaacaatgttaaaataaatctagtatttttaaaagaatacaagtaagaaaagggaggcttgaagattatgtttgaaaacatttccctccctgctatctctctttctttgtcttccccattatagccacatttctttaaaaaataaaacaaaaacagattaaaaaggaatatttacttcctcacatcttattcttttaggacctattgaagctcatctattaatttatttaaaaaatattaactgaaaccctgtaatttatggtgtgctgaagattgaatggcaagtcaagtcatatattgtacttgttgccatgaaactccatctacttgggtcagtggataccaaatgtgcattacaagggagagtgtgtatgttttcaactatagtagagggatttgaattatgaggagtttaagatgtcatcgatgaagaggtacactgagaaaaaaaagtgtgtaagttaacccagcagagagaagaggaaggtgcattttaaaaagagaccaatggcagaagtaaaccgagagagtacacaggaaaaaatgggaatagctaagcctgagaggcatggagggagagaggtctatagaaggatattagaaccaggccatatgggcctcaaaggccaggttaataagttttgttttattccccaaagcaacaaaaagccatgtttatttagttttaaggaagtggagagcatgatcagatttgcattttgaagcagtaactttgtccacactgtgacgaaggaaaatttgcagtgcagggctgcagagcctgtcactgtactgcaactgttcttgtctagggagttgactacttctctttaccaactaaacccaaaggaaagattttattctcaatcttactggaacacatttgtcttcctcgtgattttttcctaggtctgcttccattgtcatattagccaccctctcaaagatttcacttacctggtggcttcatctctccctcccaccctatgtgttgatgactttgaaatatgcaactcagaagagatgtcttctccaggcacttcaaatgcagtatgttcaaaactgaactgtgtgattgccctttaatttcaatgctctttcagctttgtttacctatgaatgacttctttgttcacataaactagggttattcttgaaaccactatggtctcacttactgaatcaaacacctatgtcatccatttctgaccgtaattctctctcaaagtccgttgctgcccttggtctccataggtaactgttttggtttatcatcacctttctgttcacataattaaatatatcctattctctacaactgccctccctggaaactgttctgcaaatggtagccatagggatctatgtagaacaaggtggtcattagctctttgctgggtaaagcattagacaacttcccttgtcataaagcccaaacccctcagctactcttaaggatcctcatgacctcttctctcatatttcttgccacctgaaatctacactttggattcacttcagtcggactgaaatgcatgacttaatgtccccaaatatatggtactctttcaaatcttcacacagactttcaaattttggtacagactattctcattgtttattacactcttctaaaacttccctcttgagagggctaaactcaattttcaggattctatatagatttcattcccacttctgcccccagaaattaggttttcctaatgcttgaaattgcgatttgcctcagcatggaattcattttttcacttatatttaagtgaagtcagaggtcataagccatagactattgagactgtctatattattcagcattttatcacttctgcttttcacaaatacctagcacatacaggtatgcatgaaatatttacatgcataataaataattgatgttacctatttctgatttttaaaaatgtattattaatataattttaaatgtttgtttattatttctaagtatagagctgaacaattaataagagttcataaaatgcttattaaattgaaaatatttgcaaatttgaaagtggtgtaataatattaattgtaattactaaagaagctatggtaaatgttatttatgtcatctataaataacttattttataaacttataattcctctgagttatcataacttcttaatgaagtgataaaagagtttcaagaattaaactcagaaaaactgtatccaatggtttcgatatgcaaagactttgacagacaatgtaaaaaaattttaaaggcctgaagtcaattaccaacttcaaattataaaagttttaagaagaaattcaggagggacccagattgccaactagaagcagcatcagtcagtggctcccactgagaagaacgaaaacggcaagtgaatcctgcaccttcagctgagatatccaggttctctcatggggactgactaggcagtcggagtgacccacagagagcaaggaaaagcagggtagagcaacagcccaccttggagctgcacggggcaaagggagctgccacccccagccaagggaggtagtgagtgattgtgctaccccacctaggaaaccatactgttttcatggatctgtgcaactcgcccatcaggagatccatttgtgagctcatgccaccagggccttgggttccaagcacagagctgtgcagatgcttggtggctgctcaggttgcaaccagcggcagcaggctggacactgcttaagatgaacaagttggggggaaggggtgcctgcaaccactgtggctccagtctgccattttcccttgctggtgcccaggatatgcacagtacagtggctgtggcagatagtggccagcctgcttctttaggtgggaccctgatccatttctcctcagcaggtagggcttccctgtgggaatttcagaaactccagccaggggtttatggatagaactctgatctccctggaatgaagcacctgggtggaggggcagtggcagtctctgcagttcagccaaattagtctttcttgcatgctggctctgaaaagtccaggcagtccagatgagagggactacccccagcacagtgcatcctctctgccaatgggcagccagagtgcttcattaagtgagtccctgatcccttgcctcctgactgggtgagaccccccaccgacaggggtcactaggcaccctatacaggagcattcctgccagcatcaggtcggtgcccctctgggatggagctcccagaagaagtagcaggcagctatctttgctgtttttcagcattcactggtgatgcctccaggtgcaggaggaacccaggagaatggggtctggagtggaaccccagcaaaccacagcagcctggcaaagaagggccttactgttaaaagaaaaacaaaccaaaagcaacaacaacaacaacaacatcaacaaaaaataccccacaaaaacccacccaaaggtcagcagcctcaaagattgaaggtagataagtggtgaatatgagaaataattggccgggcgtggtggctcatgcctgtaatcccagcactttgggaggccgaggcgggtggatcatgaggtcaggagatctagaccatcctggctaacatggtgaaaccccgtctctactaaaaatacaaaaaaattagctgggcgtggtggcaggtgcctgtagtcccagctacttgggaggctgaggcaggagaatggcgtgaacccgggaggcggaacttgcagtgagctgagatcgggccactcactccagcctgggtgacagagcaaactccatctcaaaaaaagaaaagaaaagagaaataatcaacaaaaaaatgccaaaaactcaaaaagccagagtgcctcttctccaaatgatcgcaatacctgtccaccaagggcacaaaactggacagaagctgagatggatgaattgacagaagtaggcttcagaaggtgggtagtaacaaacttctttgagctacaggagtatgttctgacccaaagcaaagaagctaagaaccatgataaaacattacaggagctgttaaccagaataaccagtttagagaggaacataaatgacctgatggagctgaaaaacacgacatgagaacttcacagtgcaaccacaagtatcaatagctgaatagaccaaatgtaggaaagaatctcagagcttgaagactatcttgctgaaataagactagcagacaaaatcggtgagaaccatggattatataaaaagactgaaccaacaacaaattggagaacttgaaagagacgggtagaacagaaccaagttggaaaacaaacttcacgataccatccaggcgaattccctcacctagcataacaggacaacattcaaattcaggaagtccagagaagctcagtaggataatccataagaagatcaaccacaaggcacataaactccaaggttgaaatgaaggaaaaaaaatgttaagggtaaccagagagaaaggtgaggtcgcctataaagcgaagcccatcagactaacagtggacatctcagtaggaccctagaagccagaagagattggggaactaacattcaacattcttaaagaaaagattttccagcccagaatttcatatctggccaaactaagcttcataagtgaaacagaaataaaacccttttcagacaagcaaatgctgaaggaattagtcactgccaggcctgcctttcaagagctcctgaaggaagcactgaatatggaaaggaaaaactgttactagccactacaaaaagacactgaagtacacacaccaatgacactatgaagcaactacattaataagtctgcaaaatagccagctagtatcatgatgacaggatcaaatttatgcataataatattaaccttaaatgaaaatgcactaaataccccaattaaaaagacacagaatggcaagctggataaagagtcaagacccattggcatgctgtagttaagagacccatctcacgtgccaagacatacataagctcaaaattaaaggagggaggaaaatttaccaagcaaatggaaagccaaaaaagcatgggctgcaatcctaattactgacaaaacagccttaaattaacaaagatgaaaaaaagacaaaggcattacataatagtaaatggttcaattcaacaaaaagaactatactaaatatacatgcacccaatacaggagcacccagattcataaaacaaattcttagagacctacaaagagacttagactcccacaggataatagtgggatattttaacaccctactgtcaatattagatcactgagacagaatatcaacaaatatattcaggacttgaactcagctctggatcaaatagacctgatagatatctacagaactctccacccaaaaacagcagaatataaattcttcttggtaccacttggcatttattctaaaattggccacataactggaagtaaaacactcctccttagcaaatgcaaaagaactgaaagcatgacaagcagtcaagcagaacaaagcacaatcaaattaaaactcaagattaagaaactcactgagaaccacccaactacatggaaactgagcaacctgctcctgaatgactcttgggtgaataatgaaattaaggcagaaatcaagaagttatttgaaactaattagaacaaagaaacaacataccagaatctctgagatgcagctaaagcagtgttaagaggaaaatttatagcactaaatacccacatcaaaaatctagaaagatctcaaattgatattgtaacatgacaactgaaagagctagagaaccaagagcaaaccaaccccaaaactagcagaagacaagaaataactaagatcagagcagaactgaaggaaacagagacacaaaaaacctttcaaaaaaataaatgaatccaggagctgggtttttttttttttttttaaattaataaaatagaccactagctagactagtaaagaaaaaaaaaagagagaataactgaatagacacaataaaatgtgataaaggggatatcaccactgaccccacagaaatacaaacaacatacagagaatactataaacaccactatgcaaataaactacaaaatctggaagaaatggttaaattcctgaacacatacatcctcccaagactgaaatacgaagaaggtgaatccgtgaatagaccaataatgaattctgaaattgaggctgtaacaaatagccaccaaccaaaaaaatcccaggaccagatggatttacagctgaattctaccagaggtacaaagaagagctggtaccatttcttctgaagctattgcaaataattgattaggagggactcctccctaattcattttatggggccaaattcatcctgctaccaaaacctggcagagatacaacaaaaaaagaaaacttcaggccaatatccctgctgaacattgatgcaaaaatccttaataaagtactgtcaaactgaatccagtagcacattaaaaagcttatccaccacgatcaagtcagcttcatcctcaatgcaaggctggttcaacttatacaaatcaataaatgtaagttatcacacaaacagaacgaaagacaaaaccacatcattatctcaatagatgcagaaaaagccttcaataaaattcaccatctctttatattaaaaattctcaataaactaggtattgaaggaacatacctcaaaataataagagccatttatgacaaaaccacagccaatatactgaatgaacaaaagctggaagcattccctttgaaaactggcagatttcagaatgccctctctcaccactcctattcaacatagtattggaacttcccgccaggggaatcaggcaagagaaagaagtaaaaggcattcatataggaagactgtaagcaaattgtctttgtttgcatatgacatgattctatatctagaaaatcccatcatctcagcccaaaagcttcttaagctgataagcaacttcatcaaagtcttaggatacaaaatcaatgtgcaaaactcacaagcattcctatacacccagaaccaacaagcagagacccaaatcatgaatgaactttcatgtacaattgctacaaaaagaataaaatacctaagaatgcatctaacaagggaagtgaaatacctcttcaagaagaactacaaacgactgctcaaagaaatcagagaagacaaaaacaaatggaaaggtattccatgcttccatggataagaaggatcaataccatgaaaatgaccatactgcccaaagtaattcatagattcaatgctattcccattaaactaccattgacattcttcacagaattagaaaaacctattttaaaattcatatcaaaccaaaaaagaatccatatagccagaaaatcctaagcaaaaagaacaaaagtggaggcctcatgctacctaacttcaaactatactacaaagctagtaaccaaaacagcatggtactggtacaaaaatagacacatagaccagtggaacagaatagagcagtcagaaataagattgcacatctacacacatctaatcttctacaaacctgacaaaaacaagcaatgaggaaaagtttctctatttattaaatggttttgggagaactggttagccatatgtagaaaattgaaactgaaagccttccttacaccttataaaaaaattaactcaagatgaattaaagactcaaatataaaacccaaaactaggccggacgcggtggctcacacctgtaatcccagcactttggaaggccagagcgggcagatcacgaggttaagagatcgagaccatcctggctaacacggtgaaaccccgtctctactaaaaatacaaaaaaaattagctaggcatggttgtgggcgcctgtagtcccagctactcgggaggctgaggcaggagaatggcgtgaacccaggaggtggagcttgcagtgagccaagattgtgccactgcactccagcctgagcaacagagtgagactctgtcaaaaaaacaaacaaacaaaacccccaaaactataaaatccttagaaaatttaggcaacgccattcaggatataggcacaggtaaagattttgtcatgaaaatgtcaaaagcaattgcagcaaaagcaaaaattgacaaatgggatctaattaaactaaagatctgcacatcaaaaaaaaaaataaaacaaaaatcctatcatcagcgcaaacagaaaacctacataatgggagaaaattttgcaatctatttatctgacaaaggtctaatgtcctgaatcttcaaggaaattaaacaaatttacaagaaaaaaaaaagaccccattaaaaagtgggcaaaaggtatgaacagaaacttctcaaaagaagacatttatgtggccaacaaacatgaaaaaaagctcaagatccctgatgattaaagaaatgcaaatcaaaaccaaaatgagataccaccagtggtttccagtgccctcacaaaaaggtcaaacaacctaaacatatactttatcacttagcaggaaaattttgagagttaaaagtgttgccagtaagtaattatctggggacaagaggtgctatcaataattatgataggactgttctggtcaaccaagacaacatataatccttcttcttagagatgctttaaaatccagtgcctacttgcctctcccagcatcaaacccaaaccacaatgtgctaatttactaacgtagtgcatgtactagccagccataatgtactactataattcccaaaatgtatttttttttaaattttggctatttagtacttcacttctctctaatgatagccaactcctaatcatctttcagttccttagatatcacttcctccaggaaacccctgcttttactactgttggcattctaccctttagtacactgactacactgtgctgtaaccaaagtttgtttctatgcatgttaccacctgtgacccctgttggattccttgagagcagactgtggtagccaccgttttatcctccactcctgaaaaaagaggtcccatagagtaagcatttcatcagtgtttgttgagcaaataaacaaatctattttcttcttgtcacttctctttgtgttcttcattattaaatgggtaaaataagaattgtgcctatttaataggatttttgtggaatttttttagtacaatatacaaaaaatgcttagtgattatctgacaaaaagaccatctcagtaaattttagcagttattattcctcgtgcttagatcaaatatataacatgatatttttgcaaattattttcgtgatcattttcagtcagatctattttatctcacaaattttgtgcttctgttttagataattctctcaccatttgacttgtaattagtgtaaaataatctgtctttcccagtaagttttgagttctttgataacagactctcatctcattcactgtggatttccagtgacagacacaacacaggcattgaatcaaacatcagtggaatatcttatgtttaaagaaaattgaagactgaagacatagaattgtggggttcctcattgcaagataaagttgacaatgactttttttaaactcctggtaaatagatcatatttactttgaaagattttttgttgttgttgttgtttgtttgtttgcttgcttgcttgttttaaatagtgggaaagtcctaaggcattcaaaagtaaaatagtattttagattgttgacatactctagaaagacttttccttcaatttctaatgcaggcaactagccatatacctcatttgaattattatttccaaataattcagatgacagtagatttggaggaatctaagagcccttaaaaaacatcattccaaattctttaattttagaaatgaggaattacacatatagagaagctaagtaactttgaaattctaattggcaataaaaaatctggggaaatgcaatcactagctatttatcccaatagttaatgtcctcaaaatcatcagtaatttagatgaaactgtcagttcaatgtattctagatgcagtataggtttaatggaaagtctgcttgaattatatcccattttattgatgtttcactaataagtgttccaatggacataacaaattcaccctcaaacttgaaatttttcccttgttaaaatactccagtttaattatgtttaatttaaagttggagttttaggactgctgctcatggctagacattgattttacctgcattaaggaaattcgattaccttgaatcatttatatatatttgtaaatcacgaacggtgcttttctgatgtttgggactaattatttccatgaatacaaacgtcagcaatatgaaaagcaagttgtggaatgaaacaaacaagtggcaccagaaaatattgcctgcataatccattgtgttctttataaccaaatgccatttgaaaccgtgcactgatgcagatggcaagatagaatttagactttatgtagtagataatataattttattttgcttcattttatttctgaatactatatctgaataaacaagcacattagtaaatgtgtgacaacatctaccttatttatgtttttgtttagccagtgaaccataggcagtaagtgattgtccttaacttttgttttttggttagaggagaataacataagtagtaacacgtgaattgttacagggtgagttatgctttgcaaaatacattcttaatcagataatttggtaattataacacagactccaaagtgttgcaaaaataaactatcactttaaaaagagcttaatgcaatgctgggtacttactcatgaactgataatttaacaaaatttaccaatggaaagcaagctttattattgttagtaaatagtatgctctatgaaagagaagctgaaaagtgctcactttatctcaatacattatttcccttaaaaacgatacataaggaaaaaactctttgttaaacactgaaacaactggaaccaaaacaagttttatgaaattaagtggacagaattgttccctaatgctttagttgggagttgtttttttttttggtttgtttgttattgtttgttttgttttgttgttttgagacggggtcttgctctgtccccaggctggagttcagtggcacgatcttggctcactgcaacctccgcctctgggattcaagcaattcccctgcctcggcctcccaagttgctgggactacaggtgcacgccaccacgcctggctaattttttgtattttagtagagatggggtttcatcatgttggccaggatggtcttgatctcctgacctcatgatctgcccacctcagccttccaaagtgctgggattacaggcatgagccacggcaccgggactagttttttttttttgttttttgtttttgtttttaataagaatagttggttggcactcgtaaaggtctctattggtattgttgttattaaacgaaacacagataaactgtttaattttaagatttgttaaaatatttttgtagtacttccctagttgctataggagctgaaagatagaatatttgttgtggaatttgcaaactagttgaggcaataaaatagtgcacataaaatggcaattacagcaaaagaaaactatgacattaagtgccttaattgtgctggtaattatcaaaaggcaatgataatcagccacaatgtccaactggcattctgtcagccagcactctcctgcagaaacagaggggtatggtaggttctcacttgatgccaattcaacctaggctagaaatgacaccaagaaatgggcggggaaatagttgcagaagtgatgagactagctctgcttcttgatgccttgccaccctttccagaattcaaaagcacgttaaccatcatatggaagaacaccttaatttagttcaaaccatgagggaaaagagtgaggcattagtgaaaaatatcatctcatgtaaatgtagatatcttgcttacttacttaaagaggttgtgcttcctatactcacagttcctcaaagcataattgtaacgagactggtggtttaaaatttgccagtttctttgtaattgcatggactttgctgagtctctaggtatgatgagcacagtaatttgaaactgtaacctgagattaaggcaaatgatgctttctaatagaaaaagctgaaactagtgtgatgagcagtaatgtctttaaaattaaattttgtattgggtaagtaaataaataaataaaagaatgaaaaataggaatatctcaatatgtttattattccttaagtttttggatagtgtaatattagtgttgaaataattatttcatatacgatcaaatatgtgtgtatatagaaacacaaatattgacatacatacttacatataggtagatgagatggatatatagataattatattgggtagaaagattaaaaaatagcttcatgtggggcattatccccaaaataagtatctaggtaatgtacttgtgaaatcagtgtggtctgtgattaccatctagtggcagtgtccttgaattgcaaatactcagtgccagtaggaaacccaaaggggattatttggcccattcaacccattttcttgatgtaatgaattattatgaaacatcagcaaccacacacctactatacaatatataatagagttatatattgtaaacacattttcacaaaatggatgatttctacatgaaagttatttaaataaggctaattgaaaaacattttaattgagttttgatagcaaaatcaaaattaggcttgagaggaaaacaattgaaaaaaattgagaggaaaacaatatgtttaagttgaatttgattacagatagtatagtttacaaataatagagtttaggaactaaaagtcctgtgtatactttgacaatggagttggtcaatattaaaatgtgtacatttggctaaataaaaataggcagtgtttgtgttgagatttgaagttcagactaaacagcactgtaagggtaaaacattttttagcatgatagaatgaggacataaaaatgtgaccatatagctatattggttatgttgttatgggagaagataaattaggaattgtttgcaataatttataaggtatgagcactggtatttcagtaattgttgagaaaatgcaaagaaagggaagaatatgtaagctttgtcaagaaagaggtaaaaatacttgtcaaatttggcagcggaaacttaaaaactgaaggtgtctttaaggttttcagtatgaagatctcagaaacgatggcggtattttaaaaagtatttgaaaaattaaaattaaatattacagacctttgttatagggtatcaatctcataaaagatgtacccatttctaaggaatttttctatagtatgtcattcaatccttccaactcttcctccatttttaacctgggaggcaaggcaggaatcaggttcaaatatattacatcattttcccaagactttattgctaatatgtggcttcatttgacctccagacccatctactctaaaattcatgatattttccttctctatgaaactgattgtttgttgtttggcatcttgacagatttttttttataatttatttttttcgaggtggagttttgctcttgttgcccaggctggagtgcaatggcacagtcttggctcaccacaacctctgcctcctgggttaaagtgattctcctgcctcagtctcccgagtagctgggattacaggcatgtgtcaccatgcctggctaattttgtatttttagtagagacggtgtttctccatgttggtcaggcaggtctcgaactaacgacctcaggtgatctgcccacctcaacctcccaaagtgctaggattacaggcatgagccactgcacccggccaacagaatttttttaactaagttaatgtgaagattctacaatatatttatctatcaattaaaaattatgtgagaccttatattactagaattcagaaattgtgaagtttactaggttgtttgctatatataatgaaagatgtttgtactaaaaatatacctaaaaaaatcaaaataagagaataccaaaatacatttatatatgatagtcctttttttaaaactgcgtcaatgtaataactgaaaggtagtttgctcaagtttgcagtgcattgtgacagtgtaagtcttttctatcattaaagattcagtatgaacacattgatgcaacctgtctgatactgaaagaaggggcacatggcagtctgagtgcagagagaacacagtggtctccttcaatcctcacattatcactgtttctgattgtttatgtttattcataggtaataatgtcttttatctcaattataattttaatttggagctaagataggtaaactccaaaacatatttttaataatattgtgtattctataattattaagggtgtttcctttcattttcaaaagtgtcttagtttgcatgataaattatattgtcaccttagaccaggggttcttggacagagacatgacaatctggtaaaatttatgaacccttttgagaataatgttttgtgattacaaagagaagaaaacagaatagagttatcaaactattttaaaaagtcaatttgtgaagcagtagtcattgtgctcctttgccaactcattaaataacaagatctagggatagttaataactatcttaatttaaagaagacatgaactaaacaatgtttctatacagctgtatcaactgtaatgtgagatcacaatatttacaatttctattgatgaagaagtcccaggtactactaattctactgtagcttatggtctgcatttagtctaaataaaatgttaattttcagttctctaaaagttatgatttattcttttcttaatccaaatgtgcatattcagctaattaagaacccctagatacactacattggtgctttatatgttttctccaacactagaatttgagctttttaatcacacacattatattcatctttgcgcctttggtaacaaatgtaaaggataaaacatctgaaaagtttgataaatggataaatagataccacaaacaataaaatcagttaaaaagcaaggatctgcaaaatttttcaggaaaaattccataatagcaaatttagtatagaaaagtctccaaatgaaagcctgaactagtggtgtgagatgtaataacatggacacaaagatgaactttacatagactgggacttgtgctagagtccacttttttgggagagatatgaccttttagtgtcctgagcgacttaaaagctgacagaggccaatccggaccacacagtctttgaaatgacatcttggtaatctacagtattattagatccaggatattaaaagctaggtcaaaggacagttctgacaaagaaaagactctcatccttttgttccataatcccttcctatttccagtcccattcttacatgcagaagtacactctgaagagcataggcagtgttatcagagaagctactgcgatgtttgttctttgcctggaagtctttgttccataatctcttcctatttccagtcccattcttacatgcagaagttccctctgaagtgcacaggcaattttatcagaaaagttaccataatgtttgttctttacttggaaatctttgttccggagatctcatcacatagtttttcctttctgagctctcagcagtaagttctatgccttgttgttttggcatctccatcaagtctcccatcaatggattgaaaatataaactaggtgaaaaatgcattctttgttttcccactacctactcagaggtctacctggtgtttgtagagcagggaaagaatatgtacatatgccatgtatttcatatttatataaatatatatatgtttagctgtatgtatgtatgtgtatctggagatctaaacaaagagaataaaatgaactaatttctagtgagaaaacatttaaacatcctccgctcttccagctgggactcagtagaagtgcattctaattctgctggacaaatccttctaaatactctaatccccataagaatagttgtatttattcagctcatcaacaatgatgatctgagaaaaaaattttccaaattatgtggatacagggagatagtaggagatcatgaaacataaagaaaaagggacacaggaaaagacaagaacaggtgctccccagatgctcatggtgtttaatgagaaagcatattttgttataatgaatgttcttggcagtccttgatgagtgattgtatctttttaaaataactgcattagtaatttgtactgacactcttcatgccagtaagataagctgtttcagataatgataagtgatacaaagaaaataaaacagtgatgcaatagatagtgacagagggcacctactttggagaagattgttgtaggcatttttgagtaagtgccattgaagtgagacctgaatgatgagaaagagaccgtcatgtacgcagcaggggaaagaacattctagacagaggagagaacagatgcaaagtccctgagtctgggaacaaaattttagaacagaatgcatatcagagcagatgaaacgtgttttttgttttgttttgttttgtttttctgttttttttgtttgtttttttttttttttttgagacggagtctcactctgtcgcccaggctggagtgcagtggtgtgatctccactcactgcaagctccgcctctcgggttcaggctattctcgtgcctcagcctcccgagtagctgggactacaggcacccaccaccacgcccggctagttttttgtatttttagtagaggcggggtttcaccatgttagccaggatgatctcaatctcctgacctcgtgatccgccccccttggcctcccaaagtgctgggattacaggccgccgtgcctggccgaaacgtgttttaataaatgggagagtcttacaacgttaggtcatagagttcggcaaagccaaatcatacagggtctcctaagccttagtaagcaccttggattttattctaattataaatgaattaattcattaaatatgttcaagtaaaatgtgcacaatctgagttatgttttaaaaagcctactttggatctttgtggagagtggattataggaagacgagaaaatactggggaacaaaatggggatgcttttggaattgccaggagagagacagtaaaggagcaagagggatggtggtgctctttcctgagagaagaagaggaagttgattcaagcaagaagaggaagcatcaaaagttatgttttgacacgttaagtttcagtcactatttgggaagcctttcctgaagagtttaaataaatagataaactttttctaaataaaccctttgtcagagccaatacacgagccaatacaacacctctttctgggaagctgcatggtagtagctgttaaaactagatctggaaccagactactgacatataaacgcttggttctctctgttactagctatgtgaccttcagtacttgaattctctgtccctcaatttcctcaactacaagaacagtaattacaaattctctctaatggggtttttaaggactaaataagttaattaatgaaaagccttcataacttgcacgcagtaagtacatgatacacatcaagtttgttatgattattcctaaactacagcgtattttattaaaattgatttagaatatattttcattctgtatgacttgtagaatctttcctgtactccatgtttgttaagagtattcttcagttcttaaagggacaatcactgtttaagtcaatgaaagaagacggagtgaggaaccgagtattagtgggaggctatatttagacagtagaattgtgatattttagttctttgtggaatccttattgatgtcatttggaggccatgcagtgagcttcagagcattacaaagtgagacctgtgacctgtacatgctggaagttgagctgtcgtctgatctcaaaatgatactgtctcttttccccagcaagtttaaagttattgaaagcatacctttccattattttttgtcttttcattttaattcttttactaaatcaattattactgtaaatatgaagtcagacaattatatagcagaattagaattattggaatgcaaaaatagatgtacaaccaatgtattactaaaaatgttgagttcttaaaacataattaaataaaagaaaatcgtttaactatgaacctgaaaacattagaaaaatattactaaatcagacatatctgagtttcaacacagccaaatctgctgaaggccttctcacatttgtatgatttggtatttttctaaagagcatgaatgaggattttgatggcatgttgtaaatactccgcaaagctgggaggcgttgtgtattatttcactcataaggtcacaaaacagaattatatatttaaaaaaaagaatgcattttataaatgaaaacctagagtgtttttggtgactgttttaatagaagtattggttccaaaccaagaaagttaagattgcattttcctggtttggtcaaactctacctgaacattacaagtgaggatggttgttaacctgccgagcctaataagagtgatgaagtctcctttaatcatgtctgtgtgagaaaccgaagaaccattatcttcaaataattaaagagctattatgtagaaaaaagtattctttttatctttgggcaaaaattataggaaaacaaaaagattttcaagcataaataattgcacaaaatacatgagaaaggttaaactacaggagttctcaaattctttatagtttttaattctcaagtacattttttcctgattctactctctatattctagaagaaaagctaaattacaaggacgtctaattgcaaagaataatatttgctcaagatgttaaactgatgtcatattcttaattacttgtgtcaaaactcacaaataatttcatagtattacatgtctcaaaattatatggaaaacttctgatgtgaacaatttctcacagagattctatgagatattttagcattctggaaattatccatgacaagctcagtgtatataggtggtatatatggtcactgcgagattgatattatttaatagttccctccacaaaaggcaatctatgtattataacctaagactctatttgaagaattatgaattctgactatctttctaagaaaggaggacccagggtctctggtcaaaaaaaaaaaaaaatgatgtacctctaaaagaccagccatttaaaaaataatacatacttattcattttaatgctacattttattgaatcgtaacaagtacgtacaaacaagaaaaaacaaaggcaaatgaacattagcatccaatcttttaacagatgtccacaactgtcactgaattcaaataaacacatttcactttctcattttttgtaggtataataacagaggatcaaaataaggaattatattagtaagactgcctcatttatttactcacaggtttaataaactgaggctagagcttgctgttttaattttcattttattgaaatttatatttgcccttccacaaattcattttgctgaatagatttctatttcccagccaagctggcaaaaagacttcttggtgcattagaattttgagtagtaacaagacaagtcagtaaataaaaataattaaaatgaatagtttatcatcatctaaatgcaaactagtacagcatagagaaagcctctgccatctttcccctttatttacttaacagttattaattatgctaatgcatatcatagtaaagaatgaataatgttgacaataagctatgaattgcaaagataagtatacacttcagcttatgggtatatttaatcatacaaaaaagtgtaactattgttaaaactccaagataatttctgaaaagacttgtggtcatttttaagacaccttatttttatcagttttagatttagagaaatattgcccttctaaacccaaaacccagcatttcctattattaatatcttacattagcaggatacatttattacaaataatgaagcagtattgatatagtgttctcaactaaagtctgtagtatttatatatctttagtttttacctagtgtcctttttctattcctacatgactctgggataccacattatatttaacatcatatctccttaggcttctcttagctatgacagtttatcagattccttgttactgatgaccttgacatgttttaggaatactggttaggcattttgtaaaatgtccctctattgggatttgtttgctgtttttctgatgattagatgggattatgtgtttgggagagaaagactactgaggtaaagtgctattttcattacatcatatccagggtatataatatcactatgacttatcagtattgatgttgaccttgataatgtttgtccactataaagttattctcactgccagccccactcagtcttacagtacccattggagggcagccatgatgctaacacttaaggaataaagagttacgttccacctagttgagggtggaatatgtacataattaattggaattcttctgcaagaaatattttggtcttttcccactttatttatttattcaatcatttgtttatatcagtatagtctcacagacatgtttttagtactttgtattaccaaatattattttttaattttcttgttcaaattccagatttgtaatttgaatgttgttcaataagttgttgttccatatttagccatttgaaagctctttcagttggctcttgtgtttctctgaatcattcacatccttttaggtattggtgttgtttttcatttgtttatttaattgttggtggtcttatttattcgtttcttgagcacttccttgcattctaacattataagatgctccggtttcatcttgcacatttccagttcagtcatataatcaaccatttccccaaggagccctggtttcttggattagacaatagtattttgaaaaactgatgtgagatctagatgtgttcactagttctgggatgtccttgcccctaggccttctcaggagggttatttgtatactaatcatgtatttacacgtatgtctaaatatttctatatgtaattatctgttgctatattaagttaaacatgagttcatacttaggtctctaactctagttcataccagatggatcattctagcctccttcccttccttatttgtaaacttccacactaataatgacacacctggtttccaccatcacctatccatttacttatattaatattgttaaattccactatatatgtgcagaagcatcagaattgttaagccatattcctgggggccacacctttatcaactagagtacagtcctgtctttatccatgtgggctgttacaacaaaatgccttacattgggtaatttatgaacaacagaaatttgtttctcatattctatgggaccagaagtctgatatcaaggtgccagcagatttggtgtcagttaaaagggcattcctcatagacagtgtcttctctagtcctcacgtagcagaaagggcaagatagcttgcttaagcctctttcataagggtgctaataccattcatgagggtgaaaacttcatgacttaatcattccccaaaggccccacttctcaatataatcacattggtattaggtgccaacatatgaatttttggggaaagcaactttccgaccatagcaaggtgcttatttcaagtttgttttgtgttgtttgtctttagttttccccactcatttccaaagttacttaggttagcgccttcttcccccacccacttcagtgaggttgtttgatacattaatatggttagatttcttcatattccattctgaaattccctgacctccttaataattagcttttttttttcttttgaccaagactctctctgtcacccaggctggagtgcagtggtgtgatctgggctcactgcaaactctgcctctcaggttcaagcgattcccctgcctcagcctcctgagtaactgggatcacaggcacatgccaccacgcctggctaatttttatatttttagtaaagacggggtttcaccatgttgatcaggctggtcttgaactcctgactttgtgatccgccgcctcagcctcccaaagcgctcagattagaggcatgagttacctcgcccagccaatgattagctttctaattagcatacattaaggttccctgtttttcatgtaaaatataatggattttgagaaatgcagactgccaggtgtccatgataacagtataatatggaatagtttcatcaccctagataattacctgtgctttacatattcagctcttccctgccccttcatgaacccctggcaaccactgctcttatatttttattttattttatttttttagatggagtttcgctcttgttgcccaggctagagtgcaatggcaccatctcagctcaccacaacctctggcccccgggttcaagcgattctcctgcctcagcctcctgagtagctgggattataggcatgcaccaccacgcccggctaattttttttgtatttttagtagaaacagggtttctccatgttggtcaggctgttctcgaactcccgacctcaagtgatccgcctaccttggcctcccaaagtgctgggattacaggcgtgagccaccacgcccggccaaccactgatcttttatcattgccatagtcttgcatttcctaaagtatcacatagttggaatcatatagtatgcagccttttcaaattggcttctcacgccagaaaaaaaatgcatttaagtttcatcctttttttttgtggtttcatagttcgtttttattaatcactagataatattccattgtatagatgttccaattcatttatccacttgctattgaaggacatcttagttgcttgcagtttgtggggattgtaaataaagctgctataaacatttgcactgagtttttttgtggacataaattttcaaactagttaggtaaatagctaagactatggttactgaattgtatgaaactgccaaactgacttccaaagtggctatatcattttttcttgtctatcagcaataaaggagaattcctgttgctttacgtcctccctagcaattggtattgtcaattttggaaattttaaccatcctaatagatgtgtactagttttttattaaaattgaaacttgcaattttctaatgacaaatgaaattaaggatcgttgtatatgcttattttgcatttgtatatcttctttgatgagatgtctgttcagttgattagcctgtttataaattgacttatttgttttcttgttattaaactttaagagttatttgtatattttagagagcaatcccttatcagatatgtattttgtaaacattttatctcagtctgtagctttccattttttaaaatggaatttttacaatgtctttccatttttaaaaatattgtctttggcaaagcagaagtttttaatttaaataaagacttacatagcaatattttcttttatggactgcgcttttgtatctaaaaactcatcaccaaaactaaggtcacctagatagtaccctaagatttcgtgtaggggttttataatttttatattttacatttaggtgtttgatttattttggattaatttttgtgaaagatatgaaatttatgtctagatgttgatattgtttcatattgctgcatgtattaatgtaacagatatccatttgctgtacagactctcctttctccactgacttgtctttgtttcattgtcagagatcggtggactatgtttgtgcatgtttatttctggcatctatattctgttctgttgacctgtgtgtctattcttgtgacaataccatgtgtcttgataactgtaatattataagtctggaaattgggtagtttgagtcctctgactgtcccttttcttcagtattgtgttacttattctaggtctgttgtctttccatataaacattagaatcagtttgttaatatctataaaatagcttgtcaggattttaggtaggattccatagtcttctctatttttttttcttggataggctcactagagatttatcaatttcatcaacgctttttcaaagaactagcttttgacttaattggttcaatttcattacattaatttattttcaatttcattaatttctgttctgtttttatttcttttccttttttttttttttgagacagagtctcctctgtcacccaggctggagtgcagtggcgtgatctgggctcactgcaacctctgcctcctgggttcaagtgattctcctgcttcagcctcctaagtagctgggattacaggtacatgctcccatgcccagctaatttttgtatttttagtagagacagggtttcaccatgttggtcaggctggtcttgaactcctgacctcatgatcggcctgccttggcctctcaaagtgctggaataacagatgtgaggcaccgtgcccggccttttgatttctttatttctgcttgctttaggctttaactgctcttctctctctgtttcctgaggttgaaacttagattattggctttagagctttcttcttttctaatgtatgcattagttgctattaatttacctccagagcataccacaatttttgatgttttattttcatttagttcaaatttctctgaggtatttatggactcatgtacagtatagaaatgtgttatataatctccaagtatttggagatttttacctcagtctttccctgattaatttatagtttaattcctttataacccgagaaaattatttgtatgatttctattctttttaaatttggtgtgtttcgtggcttatgatgtagttactttggtgaatgtttttgaaaagaatgtatattctattgttttgggattgaatattctaaaaatatcaattaaatcatgttgattgacagtatggttcaggtcaactctatctttactagttttctgcctacttgatatatcaattaataaagagaggttttgaggtttccaactgtagcaatggatttgtctatgttttcttgcaattctatcagtttctgatattctgttattaggtgcatacatattaaggatactatgtcttcttggagaactaaccagtttatcattttaatcttcctctcttcttgtgaagtctgacttgtctgaaattaatttagctacttcatttttcttttgattagtgttaccatggagtacctttctccatcttttttacttctatcctatcctagtctttatatttaaagtagacttgtaaataaagtttagttgagaattatgtttttatatccactctaaaaatctctgtgatttaactgctctattaagaccattcatatttaaagtgctattaatatgttcactatgtctgtaactgttttatatctgttgcagtagttttttgcttctttaatctcctctttttctgccttgtgtagttttaactattttatataattcaatttgccccctttcataggcatcaattacacttccttttacatttttaatagttactcgagtttgcattatgcatttctaattaatctaagtccacagtaaataacagtaccttgctttctatgtaccagttctttcctccagtcccttggaacattgctgccattcattttatctgttcatatgttatatacacccaatatgttgttgctaatattactttaaacaaaccattatttcttaggttaattgagaataagaaaaatgaaatattccatattatcttcatttattcatgctctttatttacataaatctgagtttttgaaatatactatatcattttccttgtccctgaagattttcttttaacatttattgttgggaagctctcctggagataaattctcttagtttttgtttgtgaaaatctttacaacttcttcacttctgaaaaataatttcactgagtatagaattctattaacagtgtttttgttttttttttctttcaatatgttcaatatttcattccaaactctttttacttgcatagtttctaaaaatatgtcctttagaagtattactcctgtttatctactggtaaagcattattaaagcccttcccacccactctgacttctttcgagattttctccttgtcttctgttttctgcaatttgaatatgatatgcttaagtgtaatttttttttgtatttgttctgattggtattctctgtttttcttggatctttggttttgtgtcactcattaattttgaaaaattcatagtgattattcaaatattttatctctcagttttggatgttctttttttctccattgttttatcaacaaaaagagtcaaacactgtaaaatatttgaagagatttattttgagccaaatatgagtgaccatggcctgtgacacagccctcaggaggtcccgagaacatgtgtccaaggtggtcggggcgcagcttggttttatacagtttaaggaggcatgggacatcaatcaaggacatttaagaaatacattggtttggtccagaaagccaagacaactctaagaagggaatgggaagtgggggaggggggcttccaggctataggtaaatttaaacttgttctggttgataattggttgagtttgtctaaagatctggggtccatagaaaggaaatgttcaggttaagataaaagattgctgagaccaggaggccaaggttcttttgaaatcttattgtggctgcccttagacacaacagatgacaaatgtttcctaattagtcctttaaaaggtgttggactcttagttaatctcttcaggattgggagggcctggaagaaaaagatctagcaatgttaatagagactctctacagatgcaaattttcccccacaaaggacagctttgcaaggccgtttcaaaatgtagggtaaaatattttgacttctttgttacataatgttacgcaggagtcacattggaaagtaagtcgcaatatatagggttcaataaacccatctgatgagaatttatggtttgtagaacatgactgtccaaaccccttagataggaatttgggcaagataaaaaaatatcagagctagtcttcaatttcttctattttaattttagcttaaggaagttcctattgacaaatcttcaagcccagtgattcttttctcagccacgtttgttctactgataaagccatcaaaataattcttcatttctgttataaatattttagaatttctagcatttccttttaattcattcttaaacttcccactgctatatttacatgatccatcttttctagctatgtctacttccttcattcgagcccttaacatgttatagttactttaaattcactgcccactcattgcaaaattttgtcctatatgaatatagttgttatgcttgatttgtctcgtcagactgttaggatatatcaggtaacaggaactgactaactaataattagatctttgtataaggttttgtttttctggggaaattggcctgtattgaatgtttactgtaggtttaggtataggtgtcaaaaactgagttctaatgtcttggttttcatgtcccctttgtatttgggcttctctaaggactcctctttatatagaggctatgtctttcagctctttcagctctaacccaccgtttttatactgtaaccctattactatgatgggaagggatgggggaggggagcattatataattttaagattaaatcttagtcttttagtgggctttgttcctggaatgtagccttcataagttccccttcataagtttcctctctttgcccatcccagctcccttaggtgagacagataagctagagtagactaaagtccttaggaaaatgacctttccccaacttggataagactctagtaaagtctttttctcttgacagtaggccttaggcctttgttatggagaaccctctaggcatattttacaaaggttactttttctttccctatgccagaaccatgagagggtttttcttggattttcttcatgatgacctggtatgcttagtgtacaatgggggctccctaagactattgctccaggagtttctgactctcagcttccatcaattcattaacgttatcatttaagtgtttttacctgtttatgggtcctgcagtttctgctgtaagaaaagagaccttggttgggactctctagattttcatatctttctaaaattctgagcagtggtttgctgtgaaatctcagttttctaatgggtccaagaaaacttgcagattttcagtttgtttagctttattcttgtaaggacaagaagacaatcttcaaactttatataggatggagctgaaaccagaaattcctcatagtcattttttatactttatttctagagtagttatattaaataattttaaagatctgaatgttaataacaattggaaagacaagagtgttcaggatttttaatgaagtgatatatttaatgaagtgatacatttgtgatgtatattcatgtacattgacagtttgttaagtaataataaataagtaaataataatggatatttgacaagcaaatcaaattaatcttacaactacatgagataaagttttttatttccattctatagattaacaaattgagaccagaatttttgttcttaaccattaattattttaactcctgaaagaatatgaaatttctgtccatttcagacatttgggaaggcagataaatatatgttaaaaaaaagccaaattaaaatggatagattaattgatcactttgcaatcagaaaatataatatgtcagattaagcaagtgtatatatatatatatatatatataatccttctgttcttaaaaaatataggcaaaagaataaccgttattttaagtaattttttaaaaaaattattccttggcatctatgtttctcattattaatatgaattatcttacttgttaacacagaaatgataaatgctatctagacttttgttttgttttatgaccaaatgcccataaatctttctcaacatttattaatatgccattcaattcctatatttatgttctataaaacagtgttttaaatttaaaaactttttgatggcaagctataattataataatcgaagttgttttcccgtaagtaaattattttcagagtacagagtagataccaggaaaacacaatgatctattgtctctcatgtctacaatttgttgaacaagatactttaaattaaagcttgaaaaacatctctgctggtatttgaaataattagctgtgaaagtcacggtccaagacccttttaagatttagattttaagtgctttttcttctagttgtcaagtcttgacattttatcatttggtattcaaggaaatggagactatttcttcctccgaacactgtagacaaattatatttatgctagatagccaatataatggaaagcaacctggttttgatatttaaaagtattggcacttctgcctaaaaagatgcttgcttacccacgtaagaaccaatatctgtatttaagtaaaataacttgtgaaatacttttttagaatgaaattttctagtggaaaatattatattttacattcagccagtaaatccaattctctgttaggaatttctccttctaagtcttagaaatcttaaatttattgtctctcaaactcagcacatctctgtcctcctctgtcccttcaaaatgattaaataacataagaagatctcattgaaggtaacatcgtatagtttccttgtttgtgttttttttaatagtacacctgtagaatgtaagctcttcaagggtatgacactctgctttagtcactgataaatcccaagtacctaaacagtgccagacacatattaggtactcaattaatattggttatatgaatgagggcttccttctacttgaatataatgtccctcagaactgctatttcttttggcttaccactgtatctctagtgcaggagcaggcattcaataaatacatgttgagtgggcagccgaatggtggattgaataaaattacatcagcactaaaatactggtgctagaaggggaatatggtataaatatccccttccctatgtctctagacaacatatctgacttaccaatcatccattttacatgttaggttgtgatactcctgaagaaaaagaagtttgttcaattttttatgatttacaatggctttatattttcattaattttttccaaagattgaatgagcttaaaacaccaactcagctattaggacagacaggcaaaaaacatgtttgttttgagtctttcaaatacaaagtttggatatttcaattgtcttcaccatttaggacaattttcttcagataaaaatttaaaatcatcacttcagaagccatttaaaattccaacaaaactgaaagtagtaaagacctaattgaagacaatgttgaggtcttatctacatttgtgcacatgcggctgatgcaataatgatttggttattgtgaacatgatgataactatggtcaaattaaacatatttatataggcatattttaggaatatgaaacagataacttagccatgctattatccaatcatttcttaattgcatgctaattttatatactcagttgtgattctggttcttgtactatcaagctgtctattttggtagtagatatatgaaagcacctgggtaacatacaagttggagaaaactaacactctttcttggtttctttgtcactatcacccttgttgtgaaaaaagatcatagctttttctacctaatccccatttcatctttctgtgttatttgtttccctttagttgtaacacaatgaactcagattaataagaaaatagcatcacagtttaagataatattgattctggagaacaaccgagaatgctgtgtgttttccttgacgaattgataggatggaattctagaatatccttctgaagaaaaattcagcaggttataaaacccaggctcaatgaccccagaaaaccatgagtgtttgaataaccatcaacaaggggatggatgattctggaaggttaatataatatgtgccttttttgaaacaatctttatttgcttttatgtttctacagaaatgctatccacattcacactaatttgtggagtttgtgtgtgtgtgtgtgtttcttcacccttaggaatcacaaagagaatactttgagaaaaaaaagttctcagaaaatttgtcatttttgtaggatgctgatcttttcactatttctacaaggtatgcagctgcatagcaagcagggatacagaggactttcctgctgagctaacaggtttctgttgtgatggaaacaagtaaaaattatagtaattttgagggtcagtagcacaactatcctacatcatatgcttagatggaaattttgtatgtcagctggattataaccactgctgatttcttaaccctgcttaatatcagggaggattttacctggcactttcggttcatttcctttaacaaaattacttttaataatgttattcttttttctcatgagaatagtttactactcatctctctggtttcttactaacagaagcttctgtttactaacaattaattctggctatgttattgaaacttaagaagcaataatataggagaaaaggggatcaacacaaaatgttttttctttccttaacagctacccagacagtagtcctatctaaacagggcagcatcttcagaaatttctcagaagcacaccaaaaaaatcataaaatgagggtaatctgacctctgcctatgcaaagaggtgatgtttaatcttcccactgaccaaagaatgaaaatctcattaaaaagtagtttcaaggtgatggaagcaggaagcaagagatgtcagaactctcaaattgtgttctttattcacattaatatagttatttaaaacaagtgttagtgtgggtgtgaaagcaaccttttcttgcaaataaatcccataaggaaatatgtataataaaagtgaactttactatatgataaaatttcaccctgtaatttgtgtggttagcctaaaagatgtgtcatcaagataaaagatctcatctgggatgctgaggattaaggcattcagttttttttatcctcaaaataaaatcgaagcattatcaattaccatttgccagaactgactctgtctctgactttttgacttttgcaactctctctacgagcctgtgttgtcaatgtttgtctttagctataatgatctacacacccaccttggggaattactatgcaagtatcattaaaatggtacatgaaaaatcattttgtgctctcaggctattcagatactgatataaatacaaaggataaatttgcaagttccaggtcttggtaagcttcatcaagtttataccaataagagacaatgccatcaatttctgaggcagagtgaatgggagtcatgattaagactgacataagcttggcccgagtttttggactagtaactgaaggtttgatatgtcccaaagacataaaccagcacaatatgttttgcaaatattttaattagtttaaaatttttaagtcaagattttacataacaacacccatttccagattctattgaaaaattttaagatctaaatacaagaactacactgcttagtacatctttctgcctgcttcacacatctgagatcctgatcctgtttcagataatatgtttacgaagtcaagagtatggactgactagaagttttagcaacggataccagttcaaggtctattttattttgtcagtatcttaaaattgttaacaatgacacatttgagaatttattcagaatgtaaataacaagataattctttccaccaaaaaaatttatgttctgatactaatttatctgtgtttgtacatatatgaaaatgcagaaacttctgtgtagattatttgagacccattgcatgttctgtaattgagttcaaactgaggaaggaaagagatattagaagaataacagaaaaaccttaacttccacataacattttatgctattactcttcagttagagagtctttcttgacttccttttgctcagtgcatagagttcagagacctgtgtattaatttttttgtgtgtggcttcaccttatctttcttggttcatttcttaacatttttctaagggaatttatctaataaagtttgaataaatgaataatgggagaatcagaaaaagtctccacatttgtttggttttattaattcataagatttaaagacagacatacttggatcaaattctagcttgccacttaattagttacgtgatcttgaagaacttattaatgatatgatgtaaacctttctaaacactagtttatcacctggttcttagtattcatgtggataaaattacataagaatacaagtaagttttctcctttttcccatacagtcctcccattgtgttagttttttgatagtgttccatttgcttaaaacatttcctaggtgtcttcaacatataaaaagttaatcatgcctaatacaagaatcatacccatcacaatattttgttaacatctcctgtaacagagtttcaaccacataatttattatttgtttaatgatttaaggtttttctcagtgactatgttaagatttttcaagggcaatggaaataactcaactatctataaaaatagcagggatgatgaaaacaattggcatttatatatcaagttttgataaaccaagggctttcacatactttatcatatataagatttactactcaaaaagccttgtaaagtgggtaaggtaggtattgttcttattaccctaatttcatatgtgagctgagagacctagaagacctagaggacatgcagatttttgcctatagttagaaaccctaatttatatcgtctgcctttgaatccagagtttttctactacatcatattttcttccaaggaacaaatagaatcataggtatatggttgattgtgacaataaaagttcactgattgatttatgaaaactaagataggttttagaatacagataatcttttcttcacagtttcacaaatgtgtatttttattgtcatctgcatttgtagttatgataaataagtttgctctaacttagagataaagaaacaaagttttttgattcaccagggatttccagaccaacagcccttgggaggtgctttaagattgctaaaagtttgtaacagtagcaggcatcaccagagcccatcactccttagagtagtacactctggtttccatgtccctgtgaagactgtgtatcacatttctgtccccaaaaggtgcttgtgtcacatccctgactccaaaagtgttttaattttttacctctggtaaatacattgcccttgagtaatgttttatccttggaaatagtttcttatgacccatctgaaaggatgttagtttcaatgggctctgggatcccagccctcactactacatgtggtttctacttaatggattctgtctcgtctgtccctgatattttttcaagttaattatttgtagtgatatcacagtgaataaaaagtcctcaaggtgaaaaaccggaatagtgcttacaagtaaatggccaacctaatgatgggtctgaaatatatgcctcaagaaggtacaatactgtttatattaattttacaaggtcatagataatggatctgtactattgtaatcaaacagaggacgcatgatataatccaaaagagacgcaaatgggtctgggcgctggagattgctcatgttaaaggaaaggtcagaatacttatgcaccatctactggatggttaagctttcaaaaccaatgtaatcatatacaaatgcgctgagattgatttagattaggtatgcaagcatacctagtctttatattggtcatcagccctcaatatgaaaaagattcttcagtagattgtggtacattatatgttaatgaatttgacttttttttttttttacggtgaccattgtgtcacattccaattcatacggattagaggttcccaacccataataagcctcagaatcacctggtgaatttgttaatacacagacttctgtctctctgttaagtttctgatttactagacctgagctgggaaaaaggaattatttctaacaagttcccatgatggccgggtgcgatggctcacgcctgtagtcccagcttacttggatggctgaggcgtgagaattgcttgagcccaggaggcagaggttgcagtgagccaagattgccccactgcacttcagcttgggcaacagggtgagacccagtttcaaaaataaataaataaataaataagtaaataaatgaaaataaaaataattaaaaataactagttcccaggtaatgctgatgctgctggtctatgggtagcattgatacagattaaaaagttattagtgtagcaaatcccccagataccctttattaaagcagtttcagatggtctgatttagcctgattccactaccattataaagtgttttcttgatgctaacacaccttgctagagcactaatagtggctgagaatgcctaagaatttttatttgggatttattttttacataaaataatacttgcaaataatgttttaaatccaatcatactatgaagactatggtggtaaccagcaatcctcttacccacctcccctacttgcaatttctgataccaaggggcaactgtgtcaatcttttattttcattctgtcatatgactccatatttatagataacgtgtatatcactgttctctattttttcctattttggttttatctactgctttcccattatagaaaatatctatttaactgtcttattccagtctttccctcaacctccagtatacttatgttagttaagccaatattccggttagattattcatatctgaatcaaacaacctgctatgattaggatttcttttttatacattgtttttgtttcttatagccttatcaactggcccacttttcatttgcttagtttttaatatatatcattaatgcattctaatctctttggaagaactgtaattctcatttcaatattttttttaaaggaaagaagttctgtgtgtgtgtgtgtgtgtgtgtctgtgtgtctgtgtgtgtgtgtttctgtgtgtgtgtgtgttttcccacagagacatcctttctggagcttctctcctttcccttatacagttggactggaggatctctggacttgctaccattttgccacctctctgcaatgttgtatctttttccttctgtctctaattttgtttgtttttctgtttctcagtaggattcctttgaccttcattttccaaactgtgtcttaatttttctctccctgatatcacatttttacatttcaggaactctctctgattctctaaatgcttctttttaaaaatctgtatctccgaaggaacttttcttaaagttctttgagaaaattaaatttagagtttttgaagcttttatctgcagcttacattgcctctgttttcttcaagtttggtatgctttttgtttctttttggtctcttaattatacgttaaaggctccccaaaatccctggaaatcttttgctgcctattcatactcatgagtgaagtcgtgaaaatagtgatatgaagttctctgtgtagagaagggcttgctaattaggctatttcccacatggttactgggtgtgcacctaggagccagtacctgcatctcttccagttgatttcaattctccaggtaggaattcctccatctcttatgtaaggatgtaagctgtggactggcagctttctggaggtctagtaagggaagataacttcattaacaatgtttgatacataggctaacaacataggctaacatggaaccctgattttcactgcagtttgacaaccttatatttaactgtttctggtggcctgagaacataccattgacgctccagtcttctatgggtgggagtacagtggatggccctcagaaatcactcccttgtttgagtcgaagagagaacccagaagagtctaactgccccttattaaaaatggtcaatctttatcttttcacatttaacctgacagtcagatatataaagtgtccccagtttttacacattttgaaaattccgtgccataaaaaaatacttccttcccagcagttcccagctatttacaaaaactttatgtgagttctagtatcttctttcctgatgcatctgatgctttattgtcattttcatttggctgctggagagagtaaatgttaacttttgtgttcaattaacttttgttcaatctgcattatattactacttattaagaattcgctatattacatatatcaaaataaggaaaatagagtgtccctggtattcagagagagcttaaacgctggagtttacacaagaatacctccatgtttcatgtcaaaatttattttaaaattatctattttaatctgaaagttatgtttgtaaattagtgttatctaaatcagtgtaggagattttcattagtgttcagtacttatcactgtaagagcatggctgagacaaaacatgggttacatatttcatattcatttgattctttaatactttctttgtatagctgagttcaaaaatttctaattataagttgatcatcaattcaaaaaaatgtttgatttttttaaatgtttgctatatatccccaaaactgtacttttccattttcttttacttttaccatgtcattttctatttacttttccataacttttgtttcatcttccttttaaaaattatcagtattcctgatattttacataaactcaccataatctgtatatttgtccctctttttttctgagctcaccaatattatgagcaacaaattctttgaaatgtgtagattatagtcacctgattgggaaaatcttttcttttattttcaactaccttttttaagaaaagaatattatgccccatttttatcctttcaaaacaagtatatcttttataagctatgaagatgggctaaaggtagataatttttcaaaagcataatggctgtattatctaaaactaagaaataagacattttatgtcttgaaaaggctgttagaataaaattacctcactgaaattattcatcttttggctaaattgacttttttttgctttctagaattttattttcttcattcagtggatgtattacttatttctgaaaaagaacaaaagaaaaaatagcatgtgaatttgaaaacacttattttacattatcttgactacaagattgtgaagataagctttattcaaaatgattattgtttcttattaccagaaataaacatcataaaaaagaagtagcttcagcaatgtacacagaaataattttcaagttgacattataacatatcggactttggaaaagcataaactatattttgtgactacagtggatgaatgggtgataatttcaactataagtgtaaacatgcactatgtttccagaaatctagatgagagacagtatttaatagtttttaagagcacagttttggtcttaacagaactggtccaagtcctggctctgccactgtggtttacctcaagccattttagttatttgatcctcagtttactcggcagaaaaatggggatttacaactcgaggctatcataaagattaaacaaacttctatacacagagtatttaacgtagaacctggcacatagtgagcattcaatgaatggttgctaatgttactacaaagccgttcagatatgtttgatcaaaataaataaaactgtaccaatcaaaacaaaattaattaaatgcaacaccaaaattggtagcattaccaatatttacactttgggcaaataaaaacagctaggcatttatgcttacaggtgacacgctaaatattagcgtctctggatgaaataaaatagggaatgatagttgttgcaggagaggtgtgctctcattttaaaggttaaaaaaaagatttaaaatgtgtataaatctggtcaccagcgatagctttcttttcattatactcagaagattcacttatttaacagatattctttgattgcctattatgtgcccggctgtgtttacctaccatgcaaaaggaaatacctcctttttatgcttgaatactttccttttccacagacatttccactgggcctgggagatgggcaattctattcatggacagatggtttgagaagaaaggactggcatgactatgaaagcattcagaaagaggctatgcgctcaggtatgaagctcagtgtacgccaaagtgctatttcactcgcagcagtgtctcatttgtcacgtaaaggatctctaattagcatttcttctgcacactgtaaagtatgtttcatggggatattggaggtgatactggacagaacctaaatgacttcaaatttcagagagaaaacaaataatgaatagtctttctaatattagctgtggtaaaagtcattaaaatttaagaaatatatagtactatatattcccaactgcttgttcataatttctaggggtatcctgggatttatcaatgagacttgacctggtagatatgtatcttgagcaagattgactccttagagctgaagtgtatctaactggcaatgcaaagtatttaatttgtaccaatgtttctagacactggcgggacgtacagcaagccagcaggtcaagcagctggggttctaaggttggcaatagttggaaaagcaatcaggcagttaaacggaatcaagtaggtctgtgtgtagcagagttctagacttggtgctagagttaaaggacaaagtagcaagaaagaataggtctttccactttgggagaccgaggcaggcggatcacaaggtcaggagatcgagaccatcctggctaacgcgttgaaaccccatctctactaaaaatacaaaaaattagctgggtgtggtggcgggcacctgtagtcccagctactcaggaggctgaggcaggagaatggcccggggggtggagcttgcagtgagccgagatcgcaccactgcactccagccgggcgatagagtgagactccgtttcaaaaaaaaaaaagacaaaaaagaataagtctttctagaaggactgaaaaattaggttgttaggctgttgtgaacagaaattcagaagggtatatcagtagaaatccagtgaaagtgagtaactcatgataggaagcccatattctcttattcagccaaataagttattttcacaataaggatgtcacagaaatggagcagctacagtttggtaaagacatctcagcagccctgagacactgcattcaaggtaaaatcagcagcagaattataacttagccagggtgtgaggtcctcttgttcaactagagttagtaacaaaattgttctgggctgtgaaatgttcgtagctctgtatcaggtatggctgactgaattacagtcttttttattttcttgcattccttttcttccaaaaaaggcctgccccacgccccacccccagctttttaaagcagcttattccaaagatgttccctgttttcagagcgtcaacttcttctaggttttatcatctttccaccttggcagtgaccccatgaatggtcgtgaaaatgagttccttaccagcatcctcacttttctagtacttttatttttttcctctatttgcttgatcaaccctatattaatccaaccacttgtttctccttatgaccccaggatgctgaagttttttggaaatgttttcataatcttaccaactgaatcttccacaagttaataataaaatagcccaaatttactgaatggatgttttatactaagtgctttgcatatgtattttatttaaacctcagaataactctgataggtataattatcccaaattaagtaaaattgagttcctacaaatttattaaattttatccaagttcaagtagctaataatttgcagctctggattaagaaccaggtcttatcatggtccattatactccactgtcaaataataataattggaaaatatggagtaatagcaaggacacaacaggagaaagacacacctaggttcaaatcctagcatttccatacatgcactgtggcaaatcaatttctgtttctgatattctactttgtagaatttatttaaggattaaagaaaatatacccacagtaattgtccaattatttggacatattggaaactcaactaatgataactgtaattattaatccatgtaagttacttttacatgaattggtatgcctatcctttgcttgtacaaatgagttttgaatacaaaatccagtgcttcacatttatatctgctccataccaccctttccacctcctgaataaacttgtcttttctatcttcatctttgctatgaccaagggaaaattgatcacaaaagaaattggtaatatcacaagtttttaagtacaaattctttgtgtaattgaaaagcttttacatggtagaattttttttattcactggaggatatatgataaatttatatactagaatattatttttatacagtgaaatatatcataaataaaagtgtattaagacatacgtgtgtgtacacacacactcaggtacagagtcaaaatcaaataaacatctttgtacttcatatacaggccaaggaaaaggatcatttgtgccattgtgtcccctctaagactttaattttgtgtttactctcttatttttctctgtagtttttactgccagtgtatttatcctgaatcaaatactggtaagttttgccagtgtttgaactttatctaaaaatttaattttactgtatgactttcttctttcactcaaaaatatttttgagatttatctaggtcaatgtgtgaaatgttagttggttcatttttactattctttaattttctgtaacattgtcctcttggtgggcctttgaatagttttagttgttgtatataatgctgctataagtattcttgtgcatggttctggggtagggacaatattaaggtacatatttaatagtagatttgtatgtctagagaatgcacagttgaactttattaggtcatgacaagctgccaaaattgatacaccaatttcatttcaatcaataatggatagaattctcactgctgtacatccttgtgaatatttgaaattgacttttcccccaatttggtgatatgaaatagtctctcactgtcacttagatttgcattttattaatgcaagcaaattaaaatgtagttgatatcttttttatgctatggggacatttgttcttcctttttggtaaaagtcctattcatttctgtttccatcttttgaattatttgctccacacagtgttcttaatttattttaaatgatatcctttggtggttttatttagtgacaagcacgtatcctacattttgtagattattttaaaacatctctttatgtatggtttaatgaatagttttcaattttgaggtagccaaatccagcaatcatttttaaaagataggtcatactgatgttctacattgtcttttaaaaacttgataattttggctgggcccagtggctcacatctgcaatcccagcacaccgggtggcagcagagggaggatcgcttgagcccaggaatttgaaagcagcctgggaaacatagcgagacctcatctctccaaaaaaaaaaaaaaaaaaattcatccgggcatggtgacatgtgcctgtggtctcaactacatggagctgaggcaggaagatcacttgagcctggaattcgaggctgcagtgagctatccagcctgggctggagactctgtctctaaataaataaataaataaataaataaataaataagcaagcttgataattttacattttacatttgggtcttagatccacctagtcttcatttttacataatgtgaggtagggatccaatatttatttagtttttattcacttaaccaattattattaacatttattaagaaatttgtctttccctccattgctctgaactattgactctattataaattaagtttccatatttatgtgttctttttctgggttctctatcctgttctgtgagtaaaaatccctgtgctaataccataatagctaatgtactatatctttattacaactattactatctggtatagctcaccaaaaaagagctacattcttgctcttctttttgttgtcattcttacattgtactcttccttaaaattttgtattcggttttaaatttcacattaacatacacagatatgcacaaaaaaatgggaatttttgaattgtatttagcctatggataaattaggagataactgatattttccaatatagaataatctattctatggtacattattatatttatttgctacttatttattatatttaaggatggctttgtaattttgttctcagattatgtttagtattaatcttagtaaactaatattatattgattttgttcacataatgattatactgaaattcctcgttgtttgtagttgtaatatagaaatgttaataactcttaacactgatatgaatttagaaaatgttctaaggttttccattaattcaaaacatttaccaatagtttattttggattttaaaaatgtagacactcatatttgctagtaatgacagtgattttaaaaatgtttttttctattctagaccctataattttagttttagttttctcctattattataattgctaagaactgcagtgtaacattgaatagttggtaataatggctacttttggcattttatgattctcacaaaagcaatttaaatgctcattttgagattttatctgcctgtctattgttagatcaatttgtctaatgtaaatacattttatcatgtttattaacacaataccaatacactatgcactttaacaaatacacttatgttacttctgaatctgttttgctgagagtttgtgactttcttttaacctgaaggagtgctgattttattaaaagttttttgttcatttgcatttattaacatagataaatgttctcctttaatctgttattgggtaaattatatctattgcttttctaatggaaaccaaatttgttattctagactaaatcttcctttttttaatagctacatttgatttgttaatattttgtttggcattttcaaatctttatctatgaattaatattggccccaaattttctattcttatcaagtctttgtcaagttttggtaacagtataatgagctcataaaatgactgtttaatacttgctgttttttatacttcataattgtttgttgtaaactaaaattatttctttagtgatcattatggatttttttgtggatgaagctctgttgacctgaacttttcttggagcatagatttttaactgcttggctaacgttttatgtagttacagtagtagttgattatctatttcttctggaattaatggtattcttctagtaatttgtccattatatctaaatgtttatatttattaatacaaatttattcacatattcttatgtcctcataagattttcgtaatgcctgcaatgcttaaatttatattacttttttcagatattgttagttttttttttctttttgctttcttaatctatttctacaaaaatttgtcacttttttgtttgtttgtttgagatagaatttcactctgttgcccaggctggagtgcagtggtgtgatctcggctcactgcaaccttcacctgccgggttcaggcgattctcctgcctcagcctcccgaggagcttggactacagatatgcaccaccatgcccggctaatttttgtatttttagtggaacagggtttcactatgttggccagaatggtctagaccttctgacctctggtgatccgcccaccttggcctcccaaagtgctggaattacaggcatgagccattgtgccaggacaaaaatttgtcacttttatgagttatttcaaaagccagtttttgactctgttcatctattttatttttctctaatttttttctaactttttaaaaattttgtttgcagtaacttttttattttttacttttaaaatttcaacatttatttttgtttcaggggatatgtgtgcaggtttgttatgagggtatattgcatgatgctgaggcctggggtgtgattgaacctgttactccagttctcagcatagtgcccagtaggtagtttttcaacacttgcccacttcactccccctgccctgtagtccccagtgtctactattcccatctttttgtccaggtatgcccagtgttaacccacaaatgggttaactcccacttataagtaagaatatgtaatatttcattttccgtttctgggttaatttgcttaggataatgacatctaagtgtatccatgttgcagcaaaggacattatttcattcatttttatggccgcatagtattccatggtatacttaaaaataaatttatacctcctaatttcagtcatttttctattgtagaataagcattttggaaactaaattcccgtctgaatattactttaactacattgcactgctgtgtgatccagtgtttcacattgtatttgcttttctttcagtatgttttgaaatgtctagcccacttaaaaagcactgaaattattttaaaataagaaaattcagaaactccttcccaatgaaatctcactaatctttataaaagtatattagctgccaggcgtggtggctcatcccagcactttggaatgccgaggcaggcggatcacgaggtgaggagatcgagaccatgctggctaacatggtgaaaccccgtctctactaaaaatgtaaaaaaattagccaggcatggtggcaggcacctgtagtcccagctacttgggaggctgaggcaggagaatggcatgaacccgggaggcagggcttgcagtgagccaagatgcgccactgcactccagcctgggcgacagagtaagactccgtctcaaataaaaaaaaaaagtatattagcatgataggcagcatgcatttcattacatactttgttagtgttttcattaatgttgttacattacatttctgtttcgttctggtaattacacctctgtggaatatttggtgattttttagatatcagttattttattttattttgttttacttttaattttaggtatacatttgcaggttgattctatagattgcaagttgtgggggtttggtgtacatgttgtttcatcacctagataataagcatagtattcaataggtatttttttgatcctcaacctcctcctacccttcatcctcatgtaggtcttagtgtctgttgttcccttctttgtctatgtgtactcaacgtttagttctcacttataataagaacatgtgatgtttagtttcctgttcctgctttagtttacttgggacaatggtctccagctccatccatgttgctgcaaaaaacatgatttcattcttttttatggctacatagtattccatggtgtatatttaccacattttacttatccagtctaccattgattggcacctaagttgattccatgtctttgttatggtgaatagtgctgcagtgaacatacacattcatgtgtctttatggtagaatgacttatattcctttgggtgtatacccaataatgcattactgggttgaatggcagttcagttttaggttctttgggtaatctccaaaattccacaatggctgaactaatttacatccccattagcagtgattagtgatcactaatgatgagtgatgttgaacatttttttcatttgcttgttgcctatttgaaaagtgttcatatcctttgcccacgttctaatgggtttgtttactttttgcttgttaaagtgtgtaagttccttatagattctggatattagatctttgtcagatgcatagtttacaaatattttctcccatcgcatgtgttgtccatttactgtgttaatagttttctttgctgtgcagaagctcttttgcttgattcagtcgcatttgtcaatttttggttttgttgcagttttttttgatgtcttcatcatgaaatatttgccagagcttaagtctaaaatggtatttcctaggttttcttcaaggattttataattttaggttttacatttgagtctttaatccatcttgagctgatttttttatattatgtaaggaagtggtctagtttcaatcttctgtatatgactagccagttaccatagcaccatttattaaatagggagtcctttccccatgcttgtttttgtcagctttgtcaaagatcaggtggtttcaggtgtatggctttaaatctggggtctctagtctgttccattggtctatgtgtctattttgtactactaccatgctgtttttattactgtaggcttgtaacattgtttgaagtcagatactgtgatgccttcagctttgttctttttgcttagattgctttggctattcaggctcttttttggtttcatgtgaattttaaaatagctttttttagttgtgtgtttagtttagttagtgaagaacgtcattggtagttcaatagaaatagcattgaatctgtaaactgatttgggcagtatggcattttaacaatattctttctgcctattcatgagcatggagtgttttcccatttgtttatttcatctctgatttctttgagcaatgttttgtaatcctcattttagagatctttcacctctctggttagctttattcctaggtattttatcttttctgtggctattgtggataggactgcattcttaatttgcctctcagcttggatgttgctggtgtatagaaatgctactaatgtttctacattgattttgtatcctgaaacattgctgaagttgtttatacaatctaggagccattggcagagaatatggggttttctagttatgaaattatattgactgcaaagaggaatagtttgacttcctctctttctatttagatgctttttatttctttctcttgcccaattgctctgactaggactttcagtactatattgaatagggagtgatgagagagggtatacttatcttgtgccagttttcaagggtgatgcttccagcttttgtctgttctgtatgatattggttatgggcttgtcacagatggctcttgttattttgaggtatgtcctttagatgcctagtttgttgagggtttttaatataaagggatgctgaattttattgaaagcattttctgaatctattcatatggttatatagtttttatttatagttctctttatgtgatgaatcacatttattgatttgcatatgttgaaccaaccttgtagcccaaggataaagcttacttgatcatgatggattagcattttgatgtgctgctgggttcaatttgctagtattttattaaggatttttgcatctatgttcatcaaagatattagcctataattttcttttttgttgtgtctctctgtcggtttggtatcaggatgatgctggtcttatagaatgagttagggaggaatctctcctactcaactttttggaatagttttagtaagaatggtaccaattctttgtatgtctggtcgaatttggctgtgaatccatctggacatggacttttcctggttggtagccttttttcttattccatttcagaatcaattattggtctattcatgatttgaatttattcctggttcagttttaataggttgtatgttccagaaatttatccgtttcttctaggttttctaacttgtgtgcatagaggtctttgtagtagtctctgaagattttttgtatttctgtgagattgtttgtaatgtcagctttgtcatttctgaatgtttatttggatattctctttttttctttattgatcttgctagtggtctatcttatttattctttcaaataaccaacttctgctttcattgatgttttgtattttttttatgtctcaatttcattcggttctgctccgattttggttatttcttgtcttttgctagctttggggttggtttgcttttgtttttctatttcctcaaggtgtgatgttagattgttaatttgagatctttctaacttttttatgtgggtgtttagtgttataaactttcctcttaatgctgcgttgtgtggttaattttaggatatgtgccatgtgctgataagaatgtgtatttttctgattttgagaggtgagttctataaatatctgttaagtccatttgatcaagtgttgagttcagaatgctgaaaacaggcgaccaatctcttctgtcttataaggtttctgctgaaaggtctgcttttagcctgctagagctccacttgtaggtgacctgctccttctctttagctgcatttaatatttttgctttcatgttgaccttggagaatctaatgagtatgtgtcttggggttctctgcatttcctgaatttgaatgttggactcttgtgtgaggttggggaaattttcctggatgacatcctcaaatatgtttttcaagttgcatgctttctctccctttttttctgggacaccagtgagttacagatttcatctcttgacataattccatgttttttgaagtttttgtttgtttgtttgtttgtttttgagatgggatctcactctgtcgcccaagctggagtgcagtggcacgatctcggctcactgcaagctccgcctcctgggttcatgccattctcctgcctcagcctcctaagtagcagggactacaggcactcaccatcatgcccggctaatttttttttttttgtattttttagtagagatggggtttcaccatgttagccagggtggtctccatctcctgacctcgtgatccacccacctcaacatcccaaagtgctgggattacaggcgtgagccactgcgcccaggctttgtttgttattttttattcattttttaatttacttttgtctgactaaattagttcagaggaccagtcttacagctctgagagtctttccacagtttggtctattctgctatttgcaattgtattataaaattcttgtagtgtgtctttcagctctatcagatcagtttgattctttccttaaatggcagttttgtctttcagttcttgatccattttattgtcatccttagattccttggattgagttttgagttcctccttaatttccataaccttcattcctatccatattctgaattctatgtctgtcatttcagctggttaagaatccttgctgggaaacttactgtggtcatttggaggaaaaaagaaaaagacacactggctttttgagttgccagagttcttgtgctggttctttttcacctgtgtgggctgatgttcctttaactgtggtgtaatttgattataatcagtttactttatttcagaacattttcagagggtcaaggttttgttctgggtctttattcgtagctgaattcttgtccttggttttacagggtgtaagttagcaaaatatttttgctattgaagtttggtctgtgatccagtagatggtgcttaagtgtaatggccagtaggctggtaggtaggctcttgctcagccctgaggctcttctatgatttctcacatttgtagccatcttagttcccttcatttactttaaataattgtttttaataaataggtggtatacgcagtggaaggcatgttgttaaatactagaggtgagtaataagaaaaatatattatttccacctttgaggaaatggagatttcttgaattaagaaaaaaaatgtaaaaggagcaattgaaagaccttaggacctcatgaatagcatcaggattctcttttggcacatctgtgcccttagagttaaacctaactgtaaagattattcacatttgttaatgttcaaagaaatccagagtttttattatttcataatcttacacttcattattttggtgttagcattggccaaaccaatgtattggtagaagaagggtatgaaacccaacattgcaggaccaggaaggcttccaaagagaggtaaaccaaatgttaaggcattaaggcatatgctaacatcagttaagagttatgcttttatccaattaactctgatttctccttcttatgagtagccactaacgtagtcatatttaaacattattgtttttcttatattttctatgtgtaataccattatagttcatttaactagttttatattttgtgagaatttattgacactgtattttatcttttaacagtttggctgcacctctcagctgtacattatcacaaaatagattagcatttttaaaatcttcattcagattattaataaaagttgaatgaaaagaatttcaatacaaattcctttaatacagtataaaagagaatgtacattttgatattgattcattattcaatatacattgagtataattatagtagctgaagagctatctagtcgacatttctccacgtataatttttttttaagtaatacatttctgaaataaaagtaaactctgcctatgacattttatggaactatagatctaacaaattgggctgggagttgaaggggaaaatgcaattgcttggataactgttttctaaatatatgatctttcctatttatcataacttccttttataagtggtaaaaacatacatgttaagtaatccattcagagatgtgtgtgtgtgtttgtatgtgtgtgtgtgagatgtgtatgtgttttgtgaaatcattatatcactgatatgttttctagaaagcatttgtttttagttttgaactttaaaattttttctttttattttaactcaaaatattgtcactgcatttgccacttgtttttggattaaaatatgagtgaactcaacgtttttaaaaagctggtttcaactgttctatatgatctattttgttgaaacagattatactctcatctaatcaatgtatgtattccactataagcctcaggaattctatgaaattatgtctttttgctacttcaatttgtcttaaatagtcataatggtaggtttgaatatccaaggttttattgagtcttctgtcattttattcatttactaattcaagaaatacttttaaatgccaaatactatagctctggaaggaaattttagaaaaaaaataactatagtggttcttgaaaagcataaggcattgtaggaggtgccctcgctgtttattggcactgcggccattctgatgcaaaccaccaatgtctcctgcctaaactatttcaataagtctcttaactgatcttgctccagagctcttcaaataaaagccagaaggatcatctgaacatatataatcagatcatttcactcctctgctcaaatgccttcaaaggctgttaatcatattcaaaaataaatccaactttattccactacccataaggcccaacatgatctacacctgacccatgtctctgacctcaactcttactgattggtgttcagtttctccactggccacaatagcctccttgttcttccacaaatatactaaacatgttccagcaatttttcacttgctgctcttgctactttgagcacttctcatacatatcttcacaaacctactctccccttccttaaggtcaccagatcatatgtccccagtttagaaaggcctgccaatcaccatattatcatatgtggatgtaattacttttattcactctctgtccttttactctgcttaagttttctttctagcaatatcttcctatctatatttacacacatgtatttacgttcaatgagttaaaatatatgatttcatgaaatataaccaattgtccaagggctctaagtcacaagatggtcttgaatcatttgaactgggcttttggaataacggcactcctacattaggaaagtatcctgagaacctgccacaacatgcttgctggtttcctcttttggagattgcttctcatttcttctttaatctcatgattaaagtcactaagcggttttactaattactgcaaattgccgtagatgaacatttaaaggatatgcattgaaaccccattcgagaagtgggaatttaccatgctttaaatgattaacggtaggctttcctaagttcctttaaacaacatctcactttagtgctgatcagggacctgttttgctcctaaatgtctttattctccctaattgaacaagattgtgaactaaacagaatgagaagcagaaatgtgcaccatttgggtgagactgactatattgccttcagaaagtaaaaatagcaaccattgctatggctacaatgggtttctggtcatcttttattgaagcctcatgtctcttaaaaatattatctggcaccctttttattactatccacaatgtcacattatttattgttaatagttcactataatttaaacatctagcatgtgctctcaatagatatcataatgagatttgttgggaagtggtcagctttgggaggtattaccaaaacaatattcattattattcataaggttaaaattaacttttaatgaaatatttcctttgtcactcattgcataataatgaaaatgtaaaatggaaatgaaaagagattgtgagcattctgttgagatgtatcatttagctgtctaaaattagaacacaacttaggctgagactaaattgaatgacaattatctagaggaaaaatcccttcaatcttaaaataaaaacagcagtgtagaaatatctcaggagatttattaaactgcaatcagtttatattaaaagatataaataatgccagcttttaaacagaattcaatttaactatttgttgcaaaactcataatatctctctttagaaatatcaacttcctatgggcaagtatgcataagattatttttcccagtagttaaaatgtggttgaataatagcaactatcacagatttatttgttaattaaacttcctgggctttagtgtttgtcttgcatatagaatatgaaggatatttatatcatcacataaccctgattgctgtgcctatatgactataacttgaagcaactagcatatgttttctcatgccatcaaatctattcaatggatacacaatctcaaaaatttttcacaagggggtctatataaacatatttcaagtagagctatttcgctttgcttctggatttatattacaagagaaacattttgggagcttctcccccaaatcttttttcctcttagtattgtatttatgcttttgcaaaaatccctttcatgtgttagtagttgtgattactatcaaattgtttctagctgtaaatgccccacatttgtgaggagtcatatgtgtagattataagccttgatcatgaagaaacaagaaaattttctgctgaaggaacacggtatctggcaagaatcaagacgaaaaagatcagaagcatctagtagagcaagggattggaatacaaattattgagtacactaagattaaattgattttatgtctaccattcattttcctcaggtcttttgcccaattttatttttcctagtttaactcgttcctgcatagctgctaaatgaggccaaaatgtaaatttgtattttctaccaatttgccacacagaaaactctaatacctaccgtacctaatgtttttacctcagctcaaatgctaatctttctgctaatagtagctctgctcttgaaattccatgaagttagatttgccactgttgccatagacttgatgggaggagttaaagtcatccttacatttagagttacagtttacatactaatgtagcatgtatatcaacacgttctcagaagaagagtaagaactaaaattagagaacaaatttttgatgacagggactatgatgtcaccattatgacattaacaaagttttgcaacatgttaatgctgtatttacagagagtctcccatgatttgagggactgtgattcattcaagcccagattatcattaaagcaaagcattgcagtttagacataactttatagagatccaagtgagtacttgaacatcctccaaaattcatatccaagatctggcacaaatttgtcagtgatgagttatgggccttcttggctccattacctaatgagtgctgtagaggaaatgtgtgtgtttacccactagagaaggaaaagtgccagctctggagcctgatggcaacactttccagagactgacttcagaaccacaatgccagtttgacttgatgctctttgcctgagtagcagtgggttttgagcagctttcatgccagacaaaaaacaactgttccttctgagactctgcaatcacaaaaatataacatagagcatcctctggaaagctagaaactcagaactgagatcatactaatttaaaggaaaatttatctgccaaaaagtatgaataatagacttgcattgtttatgaaacatagatactataataagatgagaaaataagatttaatggataaagaatttaatacaatggtgtactgatgtgaaatgaccaggagagcacaatagaattagcgttactaggcgtttcgttcgataatgatttacatttccaggatgaccaactgagccttagggatccaattttattattggactagaatgactagattaatttaatagacatttacctagatagcaatctaatagtatttggtcatagataatcattgggataccaatattatgagtaggatccatttatgcatagaatttttttgtttaaagaaatagtaatcattaaagaataacttttgaaattgtggcaaaagtttacaaacaaagacattattggattgatatttaattttagtgattgttttataatagaaataaatgtatgcagcttaataaaatactttataaaccttctgacaaatacatcacaaatatttttataatctaaccagaggcattcaatgcattatccaaacttgggatatcagcgtcacacttacaacaaaaatttagtatggattacagcaaatcttttactttctttacatactgctttcatgtttctcacaaaaactctatgaggcgtaaatggtcaaatattaatcctattttaacatgagaacaaattcagaaaagtcgtgttttaagttacatatatatgaagccaggcgatttatatatatatatatgtatatatatataaatataaaatttatcatttacatacacacacagtcaaattaatgccagtactgtaactttaatgagttctggggtaaccctgtttttatatactgctttcttcttatcttcttattgacttttcccactttcagtattttcactaattcaggttaacatttataacacatgtgatccgaatttccctgtgcctcacccatctatggatgtaatgagaccatatcaacagtgatgattcaattaatgtgacttctgctctccaccacatacaggccctctagtctcttctctataaagtcttaccatacttctgagccccttggaagtcacatacaagttctctaaatactaatgtcagtattattttactctggctgctgcactgacaattgatgtttgacagccacccaaattcagcatctctctaccacaagctctgggaccctaggggctcctgaagccacatatcatcatgtccctaaagcattatcccctatttttcacagccttctgaaatacttgatggtttcttagagacgtgggagaatgcctctctcctctaccttgtgttgtacttcatcattaaggcactaatacaactgatacaaagcttgcagttctttctcacacagagagcctcatacaaaacagctccttccaacagtcattctcttaaaagaactcaactgtaagattcttaaatcagactggaaaccaatgtccaatagacacaaatgggcttctacatcttgctttctctaatccactagttgcctgggaacaatacaaagctgtgaaactctcaggaatataaatttaaaccagcagatgcctttaggctggttcattagatgagttaagtctcaccagtagggataaacagactcaagctaggaccctccaccccaccccagtagatacagatgattcttctttttctccctttttcaacatacacttaggttaaaataagtagtcatgcataaattcctctttagtaatttaaattgtatttagttttatttttaatcaaaatcatgatattgtaaaagtattattaaagtaataaatgcttattgaaatttttttcaagttcatacatgactgtgtgaaaaataccacttttaactactgaaaaagaaatgctatttctttttatgaaagaaatttgtagtctttttttacaaagaacaaaatatatttgacaaagaaaaatgtagtacttttaaaatgaaatagacagtcctcataaggttttcaaactgtttaaagatgccttcaaattttttaaacagtaacaatgtgttacttgctgaatattgaaaggaatgaatacacagtcagattacctcagttagctaatgaaaatttattttaacatgatcatgaaagtaccgaaaagcagaaaatactttcattagcaacttttcaatactttaggaattgaaagttgcattagtaacctcatagcagctttgtagatgcacagcaagggaccaccccttagcagagctctgtctagtatgaagctagcttttttctgtcttagaatgtttctactgcttctgttctcccttttcctaatgactaacactcattgtgtccctaggcaaaaaagaccctagatgtgagcatatgactgtctagaacagtcaccagtaggtttcatttatcacagggaggtaaagtcctcatgccaggctccctggaaagcagcagaacagattgctattagtcaatcccatttggttctaatagtaagccactgatatggtttggctgtgtccccacccaaagctcatcttgaattgtagttcccataattcccaagggtcctgagagggatccggtgggaggtaattgaatcatgggggtggttcccccatgctattcttgtgataatgagtaagttttcacgagatctgatggttttataaggtgcttcccccttcacttggttctcattcttctctttcctgccactatgtgaagaaggatgtgtttgcttgccttccaaaatgattataagttttctgaggcctccctacccctgtggaactgtgagtcaattaaacctatttcctttgtaaattacccagtctcaggtatttcttcatagcaacatgagaacaaactaatacagtaaattgggtactgcagagagtggggagctgctgtaaagatacctgaaaatgtgaaagtgactttggaactgggtaataggcagaggttggaacagtttggagggctcagaagaggacaggagaatgtgggaaagtttggaacttcctagaagcttgttgaatggctttgaccaaaatgttatagtgatatgaacaatgaagtccaggctgagatggtctcatatggagatgaggaacttgtcaggaactggagtaaggtcactcttgctatgcaaagatactggcagcatttggcccttgccctagagatctatgaaactttgaacttgagagagatgatttagggtatctggcagaagaaatttataagtggccaagcattcaagaggaagcagagcattcaagtttgaaaatttgcagcctgatgatgtgatagaaaagaaaaacccattttctggagagatattcaagcctgctgcagaaaattgcataagtaacaaggagctgaatgttaatcaccaagacaatggggaaaatatctctagggcatgtcagagaccttcacggcaacccctcccatcacaaacctggaggcctaggaggaaaaagtgcttccctggaccaggctcagggcccccctgctctgtgcagtctcaggatatggtgccctatgtcccagctgtcttagctccagccatagctaaaaggggccaagatacaatgggggccattgcttcagagggtgcaagccccaagccttgccagcttccaggtcgtgtaggtcctgtggattctcagaagacaagaattgaggtttggaaaccttcacctagatttcataggatgtatggaaacacctggacatccaggcagaagtttgcagcatgggtggacccctcagggagatcctatgctagggctgtgcagaagggaaatgtagggttggagcccccacacagagtccccactagggcactgcctagtggagctgtgagaagagggccaccatcctccagaccctagaatggcagatccactgacagctttgcaccatgcacctggaaaacccacaggtactcaacaccaacctgtgaaagcactgaggaggggagctgtaccctgcaaagccgtagggtacagcccaaggctgtgggagctgctaaaggctgtgggagcccactcctgcatcagtatgaccttacatcagtgtgactccatgtgagtcatggaggcctgtggcccctctgttttggccaatttctcccatttggagtgggggtatttccccaatggctgtatccccattgtatctaggaagtaattaacttgcttttcattttgtaggctcataggcagaagggacttgccttgactcagatgaaaccttggacttggacttttgggataatgctagaatgagttgactttgggggactgttgaaaaggcacgattgtgttttaaaatgtgaggacatgagatttggttggggccaggagcataatgatatggttttgctgtgctcccacccaaatctcatcttgaattttaattcctataatccccacatgttgtgggagggaccccataagatctgatggtttgtaagaggcttcccccttcactcagttgtcattcttctctctccttgccaccacgtgcagaaggacatgtttgcttccccttccaccatgattgtaagtttcctgaagtctccccagcactgcagaattatgagtcaattaaacttccttcctttataaattacccagtctcaggtatttcctcatagtagcatgagaacagactgatacagccatggttaaaaaactttggccagaggaaaatgggaccttgataaaaaacagagcaagttttattttatgaatcactgttggtcattattcagaagggatcaataaacatatcagacacctggagcacactgcacaacttagtcaatttttattgccttctgattattctgaatacctagtacctctttttaaatacagacacattgggcccaggatgatgtgactaaagcttgtattagtcagggttgtccaaaaaaaataaaatcaacaggatgtgtatatatgtatatggagagatttattgtaagaaattggcttacatgattgtgagggtttggttaagtccaaaatctgatggtggaggttggcaggcaggagacccagggaagagttacagcttgagtttacaggtagtttggtggcagaattcctttttgcatagggaggttagtctttgtcttattaaagccttcgactgcttaaataaagcccacccacattaaagcaggtggggagtaatttgctttacccaaagtccaccaatttaaatgtcaatctcatcgaaaggaactctttcacaaaaacatccataataatgtttgagcatacattttagcactcgggttcagccaagttgacccataaaattaaccatcacaagtcttgaccaaacctgaacagattcagaagttaattctctgtgggccagggaaagcctgcatatcaggctggcacatcctgaataagtcagctaactcttccctacatctggtcctgagagatcactagcctttaaaatgatcaattctagggacagaggggcttcctactgatatccaataagtgacaaatgacttaatgacttctcaccaattcaggtattgctaccaagaaagaacaggtgaacctggattccaagagaaagcaaaactaagagcaaaaagcaacagaatattcacctcctgtagccaacagccagagagaggaatactagacgggcactcagaagagtttaaacctggtgaaacagaacttcaggagcatcgtgaagacacccctaacagagaccctaaccacaacagccaaaaagcatcctaaaagtatcaatgaaactataaaaaaagactctctggaactaaaaacgtggctttcgatttatagaatttatagcaagtatagaagcagatgatcactctggaaaaacaaattagtgtacaggaagattaagggtagaaatatgtcaaatcaatgcagaaatttagagacagaaattgtagacaggaaggttaaaactgaatagatgcatgaatctaaaataaaatgaaaaagagacaataattaagcaaatataaaaagaaagtataatggatatcaagaaagatttcagtccaaaggttgaaagcatgacaggaaatactgatttttaaaaagacacagcttagcagatgctagttaaatttttgagtttaggataaagtcatctttttcaaggctcttggcagaaataaattatgtgtaaaggaaagataatctggcattaaaatcttcatctacaactctgggaattaggagagaatgcatataccgttcaacatatccaaggttgagagacagaatatattacccacttacctcttctgaataaaatattctgcaaagaattctaaccaatgaaaaaataagtgagaataaaaatctgcaggatagggaaatttttttgaattgtgggctgtatatagctaaagataaagaaatttagataaagagaggatgggaaaagctttatattttctatagatatgcagtttttaagtaaaaatgatatattaaaggaaaagatgataatattaagagtttaaaatagcatgtcatcttatcatggatggagagcttttcagagtaagaatgttctaatggtcttttgtgaaacaaggctgaagtatgggaaagaggaagatttctcaatgtaacatcttcttagaagcagtgaagcagtgccacagtgggaggaagtccttggtaccttacgttcatgtaaaagtagagaaatgggcatatggttatgagtgccagaaataggatagcaatgaaagattaaggaaaaaaaaacactaaataatataaggaggggcatcatgtgctaataaaggaaaacacaacatttcctatgattttgaaaccacatcaagttggtaaaatccaacaatttttgatctacaaaagctgcacttttctgaaattcaagctaatatttatgctttgtatgatcataaaagtctaaaaagcgggatgataaaaagacagtttggtaataaaataataagcattattttattttttattacatgtaatcagaataaagatgttgtattttaaattttaaattaaaaatggcagtaaacaatgtaaacccgtcggatatgtcatagaatttggaaaaatgaagaaatcaatgtggggtagtgtgttcagagaaagcattccagtgaggaattaaattaagcctaaaaagatgactggaagaagagacattcctggattgggggtgagaaagatctaagcaaaaagaaggagaaacctgttttaaatgttgagatggattgtcgtaagaatgtcatgactgatgtaaagccaggggaatctcatagactagtaagatatttgactcccatattaaagtctgctttagattgagatagtccatttcacaatgacaatcatttagacaatctaaaaaggagaaatgacaatagtgtgtaagccctgctattcttttacacatagctaatactgaatagcaaccagtataatgggtggcatttctgaagtgagacatctcatgtcattctgcaagcttgtatgtgaccagaaggtcacattgtgatggtaatagacgttcacatcagttccttttctctgggactccaagagtataatataatcagcacatcaaatatatttcaaatatgtcattttcatgaagcatagttatcaatgaaatacatgtcactaaagaagattattttctggctttctttaaattgtttgttcatttgttttagaagctagcagagataattcctataggcattgaaatgaagatgtgtattattggtgaagagccctttaattatttgaatgagtttctgtttaatgaactcaggagtaaaacactaatgggcactaaaatatggttacacctgcagatcacctaactgaaaattttaaatggtctgtcacccaaagaaggtcagcaagtgcaattacaaaatacaggttaatcgaagaatcttactactactgatagtgtagagtttttgataagaaatcaacattctgctaaaaacggctactgttaatttacataggatcatagctgcattcacacagaaaggaattctacctcataatgaggaacctttcatttgtgctgaaaaatttcaagaatgagaagtgccaaaattagaacaactcacactaaaggaaaatgaatatgtatccctcaatataagtgaaacaaaaaagtagtgtatatgataaattagatattaataaagagggaggccatcttttaactcagttctgcctttgaaattctaatgatacaagtcgttttgctttgttttctgcacttgctttttgtcttgctacagaaaaccattttcctctcagcttttagaagtttaaacacacacacactccactcccacatatcacacacccatgcccacagactcatacacaggacctggaaatctttgcttttcattatccacttaacattgtcccctctttcataaagtgtaacattatgttttatgtatagaacaggagaataataagtcagaagaggagtaatgatcgtgtaaagagcttacagccaatttgttctacaagcttgcttttaaacagacatacattttagagtgtactggtttttagttccacaagagaagacataaatattatcaactccatgtaagtctggcacctgttaaattattcaaatggcttagtaattattaattaagatattgtctaatcttcaacttccattttaaactttccccctgtttcagatgggataatagggtatttgtatattcatttatgtgtttgttttcttgatcagctttggaagttattcggtcatttacaaaatttattaaattaaattataactaaaatggatggcagaaattcaaacacaatagaaatgaatttgttcatataagacatccccaaacagctgtgctgtaggggtttatgtccttaagggataattttttattttaaacaattgtttaatgtcacaagggactataatattcatttttcccagacagttggtatttgaattgcaaaaattctgcaaatacacaattatgctatctctgacaaaaatgcttagaatactgcttaatttagtcctcacttaattgatagccctccagtgcttcaaatcattagttaccgcaatgtggtttgtaggtttcattgacatttattttttaaatcactgtgctgagaagtagacagaaaaatcattggtagagcctgttcaattagttgaagaagctaaatgtaataatggtttcccaaaatatcaagtatagaaggtaaatatttttcaagtatgctgtttttgactatgggaaatcagtgcccctgacttgcaaatataccacaagttgggcctttactccaattaataactagtaacctctaaatgcttttaataagtattatctcttttctttctcttcttctttacttttctcttttggtgcatattatgatcttatttctactctcaataaatgtgtgcatatgtatattcatatacatagatatatacatgcatatagtgactacgttgaaaatatatacaccaaaccttagcagtgagtcaatctgaataatcatgggactacggattgtttttacttaattctgtgagctttgatattttttcagatgttctctaataactatattttattttcatactagaaatcataaatatactatatatgtattttaaattaaaaagagaatgtagctattaggaaatcagagtaggcaattaaaaagaaggaagaggggagaatgaacaatatccatttttaaactaatatttcagcatctgctattttcaggcattgtgttagtccagataattgtagtgcatatcttccagttctatgcatatcgcatatttgtgaaatatttttacaacatggaaatcataaggtatatgttgatttaaaaagtgcttttattttataatatgttatgcgcatttaaatatatgtttcacatctttctaaatcctcaatcttcatgaaaatcaccatcatcttcctgacttttcaagccaaaggtttgcccttaatttcattttttcttcttctgtttcgcctgtaaatccaatccagctgcaacaaccattgtctctacctgcaactacatagtaaatgtatacatttttcatctccattgataacactccagactccgtcattgttcacttgaaattctagaatagcctcctgtctcattttaaacctgcctctgtagtccattattttcaccatgaccagaaagatatattcaaaccatagctcaaactatgttagttcccccagttaaatcatttcaactgaacatgtaattggcgcaaatgtgtataaaatccaaacttcttaacctggctttaaaccttacaaaatctgaccttgcaatttctctgatctcctgttttacaattctccctttcccactcagaatgctaaattctagctgcatagacctgtgtcaattcctcaaactctgttctttcccaatttttgtctttccactgactcttttctctacccagaatattttccccagtcttcctatctgtcctatcttgttatccagcttctagccaaactgtcactatcatgttatttctcttcagagcacttgttgccacctgacacttttctaatagatgttaattaatagattgattagatagagtattgctttcttcacactagaacatactctctgtgaaggcagtgacccatttgcttcattcacctctatattcccagaggaaaaaaacttatgttctcatggtaaggttcagaaaaccttccaaagcacactctgttctgctatgttgcagaattagagttctgttccccttagccctgccagctcatgtacaattggtaagtagggaaatgacgtcagcataatgcaaaagtcatgtctgtctgttcacatttttttcctagaaaattaatattttaagtgaatagggcaagtttttcaaaattaaagataaagtctggacatatatgaagttcttacttaaatataatcctaaagcaatatctttattttgaaaaatggcttgtgtagtggcatcaaagattgctacactttgcactcattggctatctgaaagaatatagatgacacagctgtaaatatagtgctatctccctccaaacttaaaaatgattgattgaaaaatctacggtcctactcaatttttacctttcatgaaattggtctttattttagtgaatatctccaagcctgtacattttgaagaaggaagcatgagctgcaagactttagtcggccaggaattgattgttgctgcttgcaaatggttgcagcaatttaactgtggcaggaattttattaagaatattattctttgatttgtgctctagctacaaaattccataggttttgagtggtctttcacagtcctactttttcctatttattgagtaggtttgtagaaagcagaggtgtttagtaatggcatttcagcagaaatacttgaacttaatagtgctcatttgtgcaagattgactatgtttgaagttcagtacagggatatgaaaaagtaaaataataaaaaaggaaattaggtctttcatctgtctcattcagcctaaaatatataacctagctggaagctttcccttttagaatattgctacatattaatttacacaaaaggtatgcagagaagcctatctgatcatttagtaatatatgtactgttgatttcctaataagatcatgcctaacgtaaggtatcttcatatagtttatgctgtatccattcatatattcatttactcaacaaatatttactgatcaccaccactaccctaaccccagatccaggccgtgtgtaacattctcagtatttagtcaagaatgagagagtttctacctttaaggagctttaaagttgatattctataatcattttagctctgaatcaatgcactttccttgcctcgggaatatactggacaaaaagcatttcttaaatgtcttattgacttaatatatagctacttagtacatcttcattgggaagacttattttacactaagcctacaattatttgtgatgccaaatgcaaaatgtgtcttccctttatattgttgctttggggagtactgccttcactcctatgatttttcattagtatgttatttttataggttatttgttgtctttgcattctgaagttgcacacaaacacgtttaggtctagatatggttttatctgatcttcttcagattagcttgtgttcatatgtgagacaatgtttttcattagttgatgtgagaattatgtttttcattaattctgggaagccctcctacatcatcacttcaattactattgtcctccattcttttccttctgaaattccagtttatatatatcaggtctcatatagagaattataagttatttgaaatctgcttttaaattttcttctattttatttcagtagttttcagggaacaggtggtttttgtttacacagataagttctttagtagtgatttctgagattttggtgcacgcatcacctgaccagtgattgaacccaatgtgtagccttttatctctcacctccatcccatcattcctgttgtgtccccaatgtccattatatcattcttatgcctctgagtcctaataacttagctctcacttataagtgagaacatacaacatttgattttccatttctgagttacttcacttagaataatggtctccagctccatccaggatactgtgaatgccattatttcattcctttttatgactgaatagtattccatcatatatatatgccacatattctttatctacttgttggttgatgggcatttaaactggttccatatttttgcagttgtgaagtgagctactataaagatgattgtttatgtggcatatgtaagtcttttacatataacaacttcttttcttctgggtgggtacccaggagtcaatgactggatcaaatggtagttctacttttagtattttaaggaatctccgtactgttttccatagtgcttgtactagtttatattcccaccaacagtgtaaaagtgttctcttttcaccacatccatgccaatatctattattttaaattttttaaattatggccattcttgcaggagtaaagtgttatgtcattgtagttttaatttgcattaccctaatagttaatgatgttgagctttttttatgtttgtcggccattcgtatatcttctttagataattttctattcatgtcttttacccactttttgatgggattatttgttttttttttttcttgctgatttgttggagtgttttgtagattctggatattagtcctttgtcggatgcacagttcgtgaatattttctcccactctgtgggttatctgtttactctgctgattatttcttttgctatacagaagcttttgagtttaattaagttccatctatttatttttgtttttgttgtttgctgttggattcttggtcatgaactctttgcctaacccaatgtctagaagagtttttccaatgttatcatttagaatgtttatggtttcaggccttagatttaagtctttgatccatcttgagtagatttttgtataaggtgagagaggaggattgagtttcattcttctacatgtgctttgccaattatcacagcaccatttgttgactatggtatcctttccctaatttatgtttttgtttgctgtgtcaaaaatcagttggctgtaagtgtttgggtttatttctgggttctttattatgttccattagtccacttgcctatttttataccagtaccatgctattttggtaactataaccaaagtgatgtgaagcctccagatgtgttctttttgcttagtcttactttggctatgtgggcttttgccgttttttggttccatatgaattttaggattgttttttctagttctgtgaagaatgatgatggtactttgacgagaattgcattgaatctgtagattgcttttggcagtatggtcattttcacaatattgattctatccatccatgagcatggaatgtgttaccatttgtttgtgtcatctgtgatttctttcagcagtgttttgtagttttctgtgtagagatctttcacttccttggttaggtatattcctaagtattttaattatgtatttatttttgcagttattataaaagggattgagttcttgatttgattctcagcttggtagctgttggtgtatagcagtgctactgatttgtgtacattgattttgtatcctgaaattttactgaatttatttgtcagttctaggagctttttgaatgactctttatggacttctaggtatacaatcatatctttggcaaacagctacagtttgacttccattttattgatgtggatggctttgtttctttctcttgtctgattgctgtggctaggactttcagtactatgttgaatagaagtggtgaaagtgggaatccttgtcttgttccagttctcagggagaatgctttcaacttttccccattcagtataatgttggccatgggtttgtcttagatggcttttattaccttgaggtatgtcctttctatgctaattttgccaaaggttttaatcataaaggaaaactggagatttcaaatgttttctctgtgtttattaagataattatacaatttctgtttttaattctgtttatgtgatgtatcacaattattgacttgtgaatattaagccatccctgcatccctggtgtgaaatccacttgatcgtggtgtattatctttttgatatgctattggatttggttagctaatagctggttgaggatttttgcatctgtgttcatcaaggatattagtctgtagttttctttttttggtatgttctttcctgattgtggtattatattagattgacttgcttcatataatgaattagactggattccctttctctgtcttttagaatagcttcagtaagattggtaccagttcttctttgaatatctgatagaattcatttgtgaatcaatctggtcctggttttttttgttgttgacaatttttaaattacagttccaacctcactacttgttataggtctgttcatagtttctatttcttcctgatttaatctaggagggttgtatatttccaggaatttatccatctcctctagattttctagtttgtgcatgtaaaggcgttcacagtagccttgaatgatcttttgtatttctgtggtattggttgtaatagctcccattttgtttctcattgagactatttggatcttctccctttttttcttggttaatctcactaatgttcgatcacttttgattattttttcaaataaacagttttatgtttcatttgtcttgtatttttttgtttcaatttcatttagttctgctctgatctttattatttcttttctgctgggtttgtttttggtttattcttgtttctctaattccatgggatatgaccttagattgtctaattatgctctttcagactttttgatgtaggcaattaatgctatgaactttcctctgagcactccttttgctgtatttcaaaggttttgataatttgtgtcactgttatcattcagttcaaataatttttaaatttccatcttgatttcagtgttgacccaaagatcattcgagagcagattatttatgtataatctgctgttatgttaccataacctgctgttatgtatttcttgttttggggttccttttggagctgatttccaattttgttctactgtagtctgagagagtacttgatataattgtttttatcaaaaacaattttgtttttaatggcttgtttgtggcttatcatatggtcaatcttggagaatgttccatgtgcttaaaaagaaaatgtatatcttgcagttgttggatagaatgttctgtaaatatctgttaagtccatttgttctagggtatagtttaaatccagtgtgtcttcattgactttctgttttgattacctgtctgtgctatcagtgaagtcccccactataattgggttgccatctatctcatttcttaggtctagcagtaattgttttataaatttgggagctccagtgttaggtgcatatatatttaggattgtgatattttccatttgaattacttttttttatcattatataatttccttctttgtcttttctgtcattgctttaaagtctgtctgtctcatataagaatagctactcctactcacttttggtttctatttgtgtggaatatctttttccacccctttaccttaaatttatgtgagtcctgatgtgttaggtaagtttcttgaagacagcagataattgtttggtggatttttagccattctgccattctgtatcttttaaatggagcatttaggccatttaccttcagtgttagtattgagatgtgaagtactgttctattatcatgccaaatgctgcctaaatatcttggtttttgtgtgtattgttttatagaccctgtgagatttatgttttaaggaggttctattttgatctattttgatgttttgtttcaggatttagagctccttttagcatttcttgtagtgctggcttagtagtggcaaattttctcagcatttgtttgtctgaaaaaagttttatctctccttcatttattaagtttagtttgctagatacaaaattcttggctgacaattttttttgtttcaggaggctaaagataggaccccaatcccttctggctcgtaagatttctgctgagaaatctgctgttaatctaaaggttttcttgtataagttacctgaatcttttgtctcacagctcctaagattgtttccttcatcttgattttagataacctgatgaccatatgtctagatgatgatctattagcaatgaatttcccagccgttctttgagcttcttttatttggatgtctaaatctctagcaaggccagggaagttttcctcaattattccctcaaataagttttacaaacttttagatttctcttcttcctcagagcaccatttattcttagttttagtgatttaacataatcccagttttcttggatggtttgtttactttttaaaatttattttctttgtctttgtcttattgggttgatttgaaagccttgtttctgaactctgaagttgtttttcctacttgttctggtctattttttaaactttccagtgcagtttgcatttttctaagtgtgtctttcatttccagaggttgtgagtgatttttctttatatctatcgcttttgagaactttcatccatatcctgtatttttttaaatttaagttggctttcacctttttatgatatctccttgagtagctactttttaaattgatttacttaaatttaaattttgatgagaatttctaattctagaagttctatttttccccaatatttctgatttatatctatatatagtctttctttctcacatttaaatttcttagtcaaaataatgctaataattttttattttcttattttaaagtttctgttgaataattatgttaattgaatttcctttgagtttaatcctggtggggtggggtgaggaaatgtatgtacataagtatgtgtacatgcaggtaccctgactcttctcatggtggaatggttcttcatgtattttgtagttttgggttgtgagttgttgattggttgggctttgtctatgggaatcttatgaaatgtatattaaaatatatatgtctccagatgtatcttagctttgtttctatagagatctccaggagtattactaatatcactacattttttatgttattttttggcagctgggggggtgtggatttctcagtctatgcaggaaatataaacaggaatccaactaagacagagataaagaaggcctgggaatgtgaatatcaaggaagacaacttttgtcccaacaatatccaagaataagaccaacaaatacgtaggaagatattttattcaccttctccttttctcagaaatgttcactctatatgggtcttaacttcatgcagtaatctcatttctacttccattttcttgagcctgatgtctcatatgctgtttaaaacttatctacacattacccaaccaccctaacaataactacagaagcttctcagtttcctcatatttgtcccttagggttttggcaacattaaaactaacattttggtaacattttaaataaggttggcataatatattccaaatatatatatatatatatttatacttatatttatatatttatatattatatttatatttaaataaggttggcataatatatgccaaatatatatatatatatatatatatatatatatatatatttggcatatatatacacatataatatatttggcatatattatatgtgtatatacgtataagtgtgtatgtatgtatgtgtatatatatatataattggaacagttttcatattatctagtctgatatatggcttcacatcatttatacagaatgatgtttatctatcccagtaattataataatagaaataatttacctgtattcatgagctttatcctaactatctactggatatactagctatctcacttttctttttcttcttttttttttcttgaaaagctgcatagttttcttggctttgtcaaatttatacagtgcaaccacaaaagagatggaggctacaactctgattatcacctaaaatttagttgcagtgtccaaacagaagaataatgccaaaaagctggtattgttgttagtgataattcttacttattgtttcttgagaataagaaaatgctacttttaggggttttcaaaaaataaataaataaaaacaatttcttaagcaccttgctggtcctgaaaggtgcttcaatttgctacaattttaatagttgagaaggggatggtaatctaagctggatttcaaggcgcaaccgtgagtctggaattggttatcaacagagatgagggcaaaccagagacgtattacaaagtaaggttacaaaatagtcatggaatttgacaagcaattaaccctccatgttatgttgcttattgagtcaataactattccaaaagagaagggagccttgtaataacaactccaagttagcttccagctttcaaatttgcctgagagcctaaggtaaaaaatgaaagactagacaaagcatttcattgggttgtcagtctacgacatcaatcaaaatattaaagattcatcatgtacaaaatattgagtacagtttgcaggtaggttaggaattcatcttcaggttctcttggttcactcaattgatctaagacctaagaaagaaagctcttattgtcaccaatcagaaatctttatgatatattatctaagattcataatctgtagaagctcttccaaagaaagagatctcctttttcccaaaccgtgaacaaagatacaaatacttagtgttcttatgcataatagcatacaaaagcagatattttagaataaaatgggaaattttccttcttttgtttataaagaacaactattatatagattaatcaaacatagtatattaatctcttgttctccgataagaggatattagagtatattggagactgttgtgatttacagctcaaaactggaaaaaaaaagtttgatatataaagaaacctaaagcttatatattcttgcatattattctccacattaaaatttattttctgctgtttctcattcatggctacactttatgatcattttcaagaacttaacaaatagtgaaaaactgcgtactgctccacttcagaatgttaagtcagaacttctgagagtggagcccaagaattggaatgattataaaagttccatcagataattttactatgtaactagattaagaactagggagaacttactgtggttgtgagctggacaccacagccctgaagcctgagcaggagcagtgaaaggagggggtttaccatatcatcgcaagctgagaggaaggctgttgggggatacatgcagctggaggaagaatgcttagggcatacgtgtagcttgtttgttctttacaaagcatttgggagatttgccctgaggtaattaatgcttcaagttacagttacattggttttgaattccctcaggtttacctcttagaagcagctgaaggtgcagtttatacagtaagttgattctacttatatttcagcaacttaaaaattggttacaaagtagacaatatttataactaggttaaataattcttattatgttttaacttatgtaaaataactataaaacattgtagctataaaacatttattaaaatacacgaaagtacattaagtactagtttacctacaatcaagtattgcctgctttctaataccagtaaaaacattatcaccctaaacaataaaaatgatttttttcatccctttccctacagatatttttaaaggttaattagctatttccatttttatggcattttgagacttttaaatgctttccatttctgaggttattccattaatctaaacccaaatagtgaacactgtgatcttggtctctctttctgtgtctctttctgtctctatgtctctcttctcatcaactgagtcagcaatccccaaattataaactatgttgtctgagatatttgttaacatgcacatccctgaagcttggttccaggaattttgattgagtatatagaagatggggtccggggaatttttattttaacagtactccagttaatttcaattcagttgtcccttggatgacagtgaaaaatagaaaacagtgatagaaaacaatgatattcattgcttcaggtaataagcctttttatgttctgtattgtgtaatatggctaaaaatacaaacatggatgagaaattgaccctgccttcaaatagacttgtttgtttaatatgattgatggttacaaatgctataacagagctacatatacatttctaagggaatgtaatgagagcaggaaaggattcttctaggaagtaccatttgtgtacagtcatgaaaagtgaagtagatttaaggagaatcttctaggtaaataaaacagtaaaagcacaggctcaggcacaagactgtccagagtttgtagaggaaatagtgcataggttttattgaacaacaagtgttaccagtgtaagggcccaattttcagtaatttttattggttcttttaggactctggaataacttaaaagtttacatctaattttttctcagagaatcatggaagcgtctattgatgtaattggtgtctctagcaccaagggagctagaatctatttctttcctacctgccaaagagacactgtgaataaggttaacaaatgaaaaaaaatttctaatactacctcagcctggttcctctcatgtgttccttgaaagactctacatcttgagacatttaaatcaaccaacctagctctcctatttctcccctttgttcaaaaagaaattaagacagtggggcatatttttttctcctatgtgtagccttgttcttggaagtatatgaattccaagcaaaactacatctaaacattagtggatgaacaaaatgagctactgaaaggcatttggaaaaaatggcactctaacacaaagtaataaagaatacagtagagcaagatgttacttttctgtttctgtaattatgctgacaccaacatatgcagttgttgagactttaagggtcatattaccttctggtaatttattaatgaccttttcttagggattagaaaaactagcagaatccaaatatctggatatgcaattctaaagatttatgccccaatgaattccatgtgagaaaacaatttgaattaaaagagtttactcttaaatcttcaaattatactacacaataagtctgctatgttattgccaaatatatcaaatcctacattctgtttaatcttttggaacctatcacaagttggtttatctgggaagctgactgagagaaagattggcatgcaggaggtttattatggaatgctcttgggatcaccacatgtgaataagaaggaaaagaaacaggattgggaagagcagaaagttgggctgctgtgtaatctcagcaaaaggttcacacaggccaactgtagctgagataatccttcagtgtcgtcacttgctaaagcaagggaattgggcttttatgccacaggtggaccagtagttggatgcaggtggcctccgcctagactcttgacctgggcaaagcacttctcttcagcaaaggcaattcccaactagggctgagagctgagtgctctctgtagctaatacctttcgcagttggggaaacaaatctgaactcttgtgtcccaccaaaactcacatgtggaagccctaacacccagtgtgaagtctctggaggagaggcccttgggaagtaattaggtttagatgaaatcgtaagggtggggcctcataatggaattagaacctttagaagaaaaggaagaaacaggagctcatgctctccctcttccatgtgagaacacagcaaaaaggcgacttctacaacccaggaaaatggcactcaccaagaaaccaaattggctagcagttcaatcttaatcttcacagtctttagaactgtgagaaataaattcctgtttgtaaagccaaccagtctatggtattttgttatagcagcccaagttgactaagaggaagccctttagtcagaaagggagatgagcgtggcccatcacatctctgtggtagccacatattttctcctccaagcaacaactggtgggtgctccgccatggccagacttgttactaaatctggagcctgaccagtaaaaataaattgcctgctcacctacaccaagccactgctttggattatacattacaacagagcaagtctaggcagagagacgtcttgagattcatgtccactccactatccttccttgaatcctgtggaatatggagagaataaaaaaaattctcctacacaataaggcacggaggttaggtaaaaatcaagatatggcatccttaaaggataaggaataaggagtgaggggacccacagcacagaatgagcttgccagaaaaagcactgcacttctgcactttgctgatgctgaaagaatagatggcaagttattccagcagtgaccacggcaaatagggtcccagaccctaccccttccctccaatgtcaggaagatatggaagcagttgagagcctagatcatactgggaaagagacacaggagagaagccttgaaattaacagagtttatccagaagatacagctttaaactggaagttaccttgatttagaaagactcttttccattatagaggaagtcaatctttggaatacataagtttgtttaaacaggaataacaaatgttacatttttacaaatctgagtcctgtttttatgcattctctctctctctctctctttaatttttttatttttttttattttttgagacagagtttcactttgtcgcccaggctggagtgaggtggcacaatttcggctcactgcaacctctgcctcctgggttcaagagattctcctgcctcagcctcctgagtagctgagattatgggtgcctgccaccatggccagctaattttttgtattatttttagtagagacggtttcgccatgttggccagagctcaagtaatccgcccacctcggcctcccaaagtgctgggattacaggtatgagccaccatgcctagcctacatatttctcttgtatcagattttaaatacttataaaagtgaataaaaagaataaattgccagattatctcaccattatttttctatccatattagcttctgctgatttccactccttttacttctctgtccactgtgtgtgtgtgtgtgtatgtgtgtgtgtgtatatgtgtgtgtgttacaggttctaatgcatccatattctttaagcactcccattttatttctaccaattgtatgtttttttcattcagtaatatattcaaaatgtgtaagtccaattcttttcttagaaaatttaattgaccattctggaaactaagattcaagaagtgatacagtcctcttttagcctagtcttatattcataaagcagattggtttttcaacataggctagtgtgtatgtattctggggacctaagccaggtacacctcatctatcttggcttgttcaatacacatgatggctacagactgtaccatacagtgcatgcaggcatgcacacagccctcatttatcacctacggcttctctgccctgacagaacctgggacaagcactttcgtagactcagagctgtgggaataggagaaggttcaattactcatatggtgcttggaatcctgccaaagacagttaaactagctatgccactatgaggcttatactttcttgataggtaggtagatgatagatagatagatagatagatgatagatagtagatagataatctctagatatagagctgtctatagatatataaaggtattgttattttaaaagtaaaaactcaaaacattagaattaaaacaggataatcagattatttcctccaagaaaatcaaacaaaacaaaacatgtaactagtatattcaaagaattgtttgccatttattcagattttattgaaataaaatatattcttttaaaatatttctctacactactaatatagatgtcccatagataaagacccagacagtctgaagtagtttttaaaggatttctcatgtttcagggaagatttgactaggagacaaatgaagtgcttttcaattctaactctataatcccatgaaatgcagacatcaaatataagaaattgtcataatggaatttcagttgttaaaatatctttacatgttataaaaatgctattttgacatatatacgttgcctcaccagaaattattctgatgcttaagggattagaaatataaaatgtcattgtgattaaatgtattaactgctatagaagaatatatgtaaattcaagaaatgtccattctttatgtatgtatatatgtttacatatagacacacacatagagatgcatttcatacatacacacatacatatggatatgtacacacatatatacaaacatgcatacatatacatacatatatatatagtttgatctttgcctacgtgcatacttatatatacaaacatacatgtgatgtgcatatgtgtgtataaacttctgagtacatatatatgcacagatatgtgcacacctatgcatatatgtgcatttataggtttatatatacacacctatatataggtctatatgtgtatatttattcatttatgtaatgcatatattgaagtatgtatgcattaaatatacattatgcatacacatgaaatacaaatgtgtaattatataaatatgcatatatacatatatgcacatgcataaacatatatagccatacacacatacagagataacaaacagatatgcatgatgaaagaaactaagcatcctctaaagggaaaatgtaataaagaaagtgcattaattatttatgatccgtttcataatttaatacttgtaaattttgtgtttgcttttttgaaatattatattagagaagatagggccatcataaatatatatatatatatttttttttatgagatggagtctcactctattgcccatgctggagtgcagtggcatgaccttggctcactgcaacctccgcctcccaggttcaagtgattctcctgcttcagcctcccgagtagttgggactacaggtatgcgccaccacgcccagataatttttttgtatttttggtagagatgaggttttgccatgttggccatgctgctttcaaactcctgacctcaggtggtctgctcacctcagcctcccaaattgctgggattacaggtgtgagccactgcacccggccccatggccatcatagtttaatgaggataatatatattagtacagtcatgctttgcttaactgtggagctatgttctgaaaaatgtgtcattaggctattttgttgttgtgagaacatcatagagcatattcacaagtctagatggtatagcgcactacacacctaggccatacaatatacctattgctcctaggttacaaacctatacagaaagttactgtactgaatactgtaggcaactataacatgatgatgtttgtggatataaacatgtctaaacacagaaaagctacagtaaaagacgacactataatctgatgggaccactgttgtctgtgcagtaggtagtccaaaatggtttgtggtgtatgactgcatttctttcagtatgcttcctttcttgatactgtctcatttgtaaataaatgtgtagaaaattatacctataaactttatgttctagaagaaaatttcttccaaaagatatatttcgaatggaaaaatgtgcttcacaaattagagaaaaaccaatatatgtaagaaatatcataagagcatgtgaaaataatactatttttatgttcctcctgaggtaaatttgcatatattcttctataatgtaagaaagaagggaggaggtgagagaaaaggaaggaaaagagaagggaagaagagagatttgtcaatacaaataagttggagaagaagtatttgctgcatattcttattaagaactaaaacactttttaggaacacagaatatctaaggacttttttgcttttattctttatttaaaaaatgaataacatagatccctctaagaaactgtttaaactaatgttccttatcctcaaacacatataattatctaaggcaatagcctatggataggaaaggaaaatacatattataaatcccatttgcaccttagaataaacaggcaaagtccatgcatttcaacaaatatttttaaaaaatataatatatgtttgaagctgtactaagtagctatgcaaaccacagatacaatagtgtgtgcatcgtgcattttcagtgggggccataccacccccaagtaggcaaaaatcggttggcaaagtgagtcaaagctctgactcatttttttgtgtaaatatgtatgcaatgccatgactagatatacagaacttctgtagcactaagatttcattggtggaggggcagtcggaaaaagaaaattttaaagtctcttctagggcatgacaatagaaataataattaatgctgagaaacactggtgcacataatacaatggaaacagaaaagagaagcagggtaggaaagtcagacagacttcctcaaggagctgaatgagagttctttcaacagataggtagagttagctaggaggagttgcagcagggaggataaagtaaatcaattataaggaaagaacagcaatgcagtcattggagatatgaaacgagagtgacctgtgcagagagctgtaaggcaaactagtgggaccgaagggtggattagcaggacaacaagatattgaagatgtgtatggtttaagcagcttgagcttctcccgtgggcaaagaaaagaaggcattggtgacctttcagctgatggcacccaatttgcattttaagcagacttgctacagaagcaagagaagcagtcaggagactgtacacatggtgatgacatgcaggtctacttcttttatccataattccaaaatcaaaaatggtctgaaaaccaaaaaatttttgtaactgacctgaacgtatatgaacctatttatacttttggtttttctcattatgtagaaaatcgtttcattataaacatattaatgtatcctattatggatttgattatgccctggaacaatctgacagtgttacttaattcacagtatcatgcactaaaatttctaaaatgtaaaaaaagagacaaagagacaaaacttaactgtgaaactttaagtgcttgcaatattggataagaccttgtaaacctagaacaacctgtcttgagagtttatgcctagactatttaaatgatttacacattttatatttcatactttacaacaagtttctaaggtagttatagttacctctatctggtatctttaaaaaaattaaaacttgaagaatttaagtaaattgcccacagcaaacatatagaatcagacaatccgtagagcatcggtttgacttcaaagttcatgttcattatctgagtatacgttaggacaaagataattaatgggtggttgttcatatctttctctctactcatcccagagcatcagagtgtttgatctatctcctccaagccctcatggagaataaaatgattgaaagaggctcaaatataaatatgtggccgagatggccttgcttggaagattaaaggaaagaatacaggagtagctacagattcatggacttttgtttactgtcaattgcaacagattgtttcttaagaattttcagaattcatagccattattctttactcaagaataaaagtgaattactttttctaggcagaaaccttcttaatgccttacattttcatgtcagatcaaaggtttcaaaatgaggcctaacagtcttttcaatcctggtgtcatttttcagtaaaagaagctagaagtaacaatgttgaatcttttacatttgtgtaaaaaccgtagtaaaattgagattacctgggtgtcctgtggtatttttccacaagctaattaaagtattgattgaattatttcttcctggaaggtgtgcgaaaggtctggtcatgacattttcccagaacagatctattaaactgaggaatatagttagactggcaggctatattttctgcattccttttttctctgccttttgagagttacaaataagtgctgacctataaacctaaggacaaaagaaatgttgatgttttgacaattagaaacatcaaatgatgtttgacaagtatatcaaatgaaatcaggtaacagattaataaatcatttcttcgttatttactgaaatcttagatctgtggtatcatgtaggtaaataatttattcttaccatgtagaatcacattgcagagtatttgttaagaatatgtctttgtagctggactacccagcttgaattctggttcattcacttattaactgggtgaacttgagaaagtcacttaacacctgtacttcagtttctaagaatgaaaaatagaaataatgatagtacctaccttaggggtttttatggaatccaatcaattaatacatgtaaagcattaaagctgccatctaataagtgctcaaagttagcttttaacaattatgattacttattaaaaggctttctatattagtagacaacagagaagaataaaaagaagagactatagttaagatcattagctgggtgcagtggctcacgcctgtaatcccagcactttgggaggctgaggcatgagatcacttgaggtcaaaagttggacaccagcctggccaacatggtgaaaccccgtctctattataaatacaaaaattagccaggtgtggtggtgcatacctgtaattccagctactcgtgtggctgaggcaggagaatctcttgaacccaggaggcagaggttgcagtgagccaagtttgtgccgctgcactccagccaggacaacacagtgagactctgtcccccaccaaaaaatagatcatagttctgcttcacatggtttccactttggtagagatgttaattgcttaatgcaatagttataatatttttaaacttctttatcttctttcacatcacactatggagcctaaaaaagtaagacaataatttccaagattgtcttgcagctaggcatggccatgggaagttatggccattgaactgaaaagtcaaggctggtgggtcttcacagaaaagatttttatctccgaagaagaaacatgtacttgttttatatcttccttacatgaatgtggacatgtttcctggagccacggcagtcattctgttaccatgaggtgaccagcataaagacaagaagataatagatcaataagacactgaataatcccagcatgactgaggtcttggtagcattgtaaggacctgaatcaatgccaaggattatctaactattgcttttttagtatttgaagaaagtgaactattttaaaattcattctactgcccagcacttaacattcatcaatgatatgatgccatgtttctaaccctgtaatcttaaaaattgctcaacctgcatgaactgaagttttcttgtagtggaggggtgtaatgccaccagcaccacaatttggtgataaagaggaaacgaaaagttaccactgtaattgttgctgcaatgatcactttaacttttttttttcaatcacacaaccaactaggttgtgtttgtatttgcctgtgttacactatatgctgattttaaaacaaaattaattgtggggttttttttagagacactataaagtccttttattcaggtagtaagatattatcatgcagtatatttcaagtggtcccaatcacctagatgattaatttagatagtaaaatgtatttaaaatatagattatttttaaaaacatgccattttattaatttaatggactattttattaatttaatggactatttatagcctcatcttaattgagttcagctgggtttgatagttttgaccattatatcttgaaacgctccttttccttatattgacatacttggattttttctttcttctgttcactctgaatctctgtttttgacacctctttgtctatctcttaaatgttgatactacttagtcatctttcctttaaactttattttctttacctgatggctgttgctcaccattcttcctcagggcatttacacaaactaaaaagagcaatatttatactcagtgaggagtggaagaagaacgtggattcatagttcctaaggcttgaaaataaaaaatgcaaaaaaaaaaatacttcgcaacagtgggagtttctatgacatcctgcctgcaggatcccatttaatgggttgacgctgttgttacctgtgcccggagctgtcttaacactgggtctgttgttatggaagcaggttcaatcttagcaacagttggcagcccccaaaagtgttttacttaattttttcctgaatattagagaaaaaataataaccaataaatgaaaaacaaaccgtggaataatctagagtcaataggtaagcaccctttgtttcacgtaattcaaccttggaggggaaatggaaagtcaaaaattgataactatttttgttccataataacattacgaacaattaattcagccaagtctctttgcataattttccacactgacatatgttaatgtttgctctgtatggctgcacctgcctagagcaaagtcagtgtgatatttggtttgtttctttggtaatttcttactttctgaaagtgaaaaaatggaattctacccttgaatgtagtggttttgttaaaccctacttatacatgctgcttttatcagccttcattaatttttaacatatttcattctagaaatgcaaatccagaatatgttaagcttttctaattgtaaatgggatatatgtacataattaaaacacaaagaagagtagtagatttataacacattaaaacatataactcaatatgactttctccctttctcagtttgccagaggtaacactcttacctctttactgctgctgcaatttctctctatattttaaaaataattagtgagtacttctatctcattcattgatttatattatcatctattaacttcctattattgcagatgagaattttatctcttatgtcctttcttcccatttctccacatttctactttatttttaatcacactttcccattattgtacttatttaagttttttaagttgagccaaaatgtttaataagatatttctttgtttatgaacctttgtgttggacctgggcttaaaaagcacgccttttgtttttcatttgtgtagttttctttgcatctctggctaagtcttcacatattcattccaataactataaattgcccataaaaacagctttaaaatatctatcctgtctgataatctatttgttcctgccattttccttactgggacctcccattccaatttgatctgattatcctgtaaacctactgtttcatcctgggtcccctcctggtcatcatcctgggcttccctttccctgtatcatctgtagatcagttgtttctggatcctgtgttatccttttggatttactcctaaatttctgttagagaaattttccagtaacttcctgagaaggagcatagaaaaaatacattttaaagttttgcctgaaaaaatgtatatttcaatattcatattgatcgataactattctagatatagaattccatgtttcaaaaaaattaagaactccaaatagccagaacaattttgaaactgaaaaagaattgaaggttttatctttcctaatttcaaaacttatgacaaatctgctgtaatcaaacagcgtggtattggcataaaaacagacacaggccaatggactgcaatagagtccagaaatacactatcacatatatggccaaatgattttcaacaagggtgccaagagtattcagtggggaaaaggacagtctttttaacaaatggttttgggaaaattggatatccactgcaaaagaatgaagttggacccatactttgcaccatatataaaaattaactcaaaatatatcaaagacttaaatgtaagacctaaagctataaaactcttagaaaacaacataggagaaaagtttcatgacactggattttgcagcaatttcttgaatatgacaccaaaagcacaggcaacaaaagaaaaaaataggtaaattggactacatcaaaattataaacttctgtggatcaaaggacaccatcaaagtgaaaaggtaaccattgaaatgggagaaaatatttctcaatcaaatatctgataaggcattattacctagaacatataaagatttgctacaactcaacaacaacaaaataacctagttaaaaatgaataaatgacttcaatagacattttttccaaagcagatatacaaaatatcaataagcatacaaaaatatgttctacatcactaatcatcagggaaatacaaaccaaaactacaataaaatatcatctcacaccccttaggatgtttactattaaaaagtaaaacagaaagtaacaggtgttggtgaagatgaagatatattggatttttgtgcactgccctgttgctgggaatgtaaaatggtgcaatcactaggcaaaacagtatggcagtacctaaaataaattaaaaatagaatgcaattgctatataacctaacaattccacttctgaatataaacaagagaattgaaagcagggtcttgaaaagatatttgtatacccatgttcatggtagcattattcacaatagccaagagttgtggaagcaataaaaatatccatgaaaggataaatgtattaaaaaattgtagactatccacacaatagaatactattcagccttatgaggaacccacgtcctgtcacatgctacattatggatataatttgagtatattttgctaagtgaaacaagccgatcacaaagacaaataacgtatgaacctgctccacctatattacatatctggagtagttaaattcacaaaaacagaaagcagaatagtaattgtcaggtactaggggagaaagaaatgcagagttgttatttaacaggtacagagtttttgttttgcaagaagaaaaagcttttgagctctgttgtgcaacaacccaaacatatttatcactaattagctatatccttaaaaatgcttaagatggtaaattttacagtatatgtattttaccacaagtaatttttttaatgaaaacaaaattctgaagacaatacttagggagttgagacagaaaccaatggaagaactttccccagccccaggagggaacattcacaaggtgggccttatgttgtttccaaatcactgtagacataggactctttaggatctccttttcttttatttttcaaatgtacatgtacattgaatcttgccttttttattatacagttggtatagagaaatttttttaaaattttattatttctttaatccttgagcagtcacatctagacctttgaaccatccagagttcaagactgtaaataattatttaattatatatatacttttaaaagttaccattcaacacagtttcctagattttaaatgtaagtttttgcatcattagatcaaaatactttataatcaatatctgtcgattaaagtaacaattaatataaggactttattgcaagagttctacatggatacaagtacacatatacaccaaccataaactgaaaacaaaactatgtaataatattcaaataaattccatgtaaattatatttctgtattagttttctattgctactgtaacaacttatcacaaacttagtgccttaaagcaatgcaaattctggcccgcacggtggctcacgcctgtaatcccagcactttgggaggccaaggtgggtggatcacgaggtcaggagatcaagaccatcctggctaacgtggtgaaaccccatctctactaaaaaatacaaaaaaaaaaaaaattagccgggcgtggtggcgagtgcctgtagtccctgctacttaggaggctgaggcaggagaatggcatgaacctgggaggcggagcttgcaatgaaccgagatcgcaccactgcacactccagtctggaccacagagtgagactccgtctcaaaaaaaacaaaaaagcaatgcaaattcattaccttacagttccggaagtgagaagtccaaaatggatcagcagcgctgcatttcatctgaaggctctagaggaaaatgtatgttgcttttcctagctcctagagactgcctccattctttgccttatggctctacattactcccacctctgctttagttgtcacatcctctgagtttcttgacttcctatttctcttataaaagaccctgttgaccaggcgtgatgttcacgcctgtaatccgagcactttgggaggccaaggcagtcggatcacttgaggtcaggagttcaagaccagcctggcaaacatggtgaaaccctgtctctactaaaaaaaaatacaaaaaaaagaaaaaaaattagccaggcattgtggtgcacgcctgtaatcccagctacttgggagactgaggcaggagaatcgtttgaacccaggaggaggaggttgcagtgagccaagatcgctccactgcactccagcctgggcgtcagagtgagaccttgtcaaaacaaacaaacaaacaaacaaacctgtgattgtcttgctctcacctgaataattcagaataatctcatctcaaaattcttaatttaatcacatctgcgaatttctttttgccatgtaaggtaacatattcacagattcctggcattggggcatggacatctttgggggccattattagattgtttctaaacaactaaatcttgtgttgcttttttttttaatgtagcattattgtggccttaattgactgatagaatacctttttaactttaattaaaattgtcataaaattgaattttaaaatgacacaaaaagtactggctacaaagaaaaatattgataaactgaattacaatataattaaagcttctgttcatcaaaatgtattgagtgaaaatacatcatactaactaaatacaactgacacggggacttattcacagtatattttaggaactcctacaaatcagtatgaaaacaatagataatcccagagaaaatagtctagagatttaagcaagactttccctaaggagatattcagatatccacgtacgtatgaacattgctatgcttcatcagccatcagggcaaagcaaagtaaaaccccaacaagatacaaccatccacccacccaaaggactaaaatagactgaaaatttacatgctacccagattatcatagcgtactagtggcaagaaattgctacaagcactttggaaaacagtttagcaatatgttataaattgggggaaagactgtctacttgagaaacagagcagaggccggtataggtaaacatcctgaggtaaggagagactagtatgagaagaatttgagtacagacaccatgctaagcaaaaccttttaggatgtggtaaataaaatgcagttttcattgtaagtgcaatggaaagacacattgttatgtgtggagaatgagttgaaatggggcaaaaaaaaaaaaaagcaaaatgactagttagtaggattatgttagaaatcagtaactaaaaggattagggtgatggcgatggaactgcaaagaagcaagtggattcaaaatgtattttggaggcgtaatcaaatgaataaaaggttatgtggaagccagggtttgtaagacaaagaaacaaaaacaaacaggagaaaggaagatgtttcctaatttctctggctgagcgatttggtgcatgatacggtttattcatttcttaagacaaggaagaaattaagtgaacttctaggaggttttgcctttctactttgacagattgaattttgtttctctttgctctacatttcttaccctgccatgcatcattgggatctggtttaatgaggggcatgttaaggagaaaatagcatggaccataagtagataatccaacatctctgcgatcaacacttctaagagttcagaatacagataggaatttcatttcttcacacttctctgtaaacacatgagtgagacaaagaatttgtctccattactaatcacctcacgaggaagtgtgttatagaagaatagtaaagatgttaaaagaaatcaaactgtataatacgggtaataaagattttgctttggatttttatttaatttgtgctttaactgaattgttcaggaaaaaattagatgtactaataataggtttaatgtaaaatgtactaatttcttagaaaataagtaatatgtcatatgagaaaatagcagttaattattacagtgacttttattttactttgttgagacaataattgtcttcatagtctatctgggaaatgtacactgttaattattatctcattttcctaaacagaaggatgctaaattagtgattttaacagaagtagaaactagcacaaagcaatgtattatttaatatttcttgaattttatttgctatgctcaaaagtatttggtcaggataatttggcagatcaatttaatgctaataataattaatattaaaaagaggacagactgaatataatgccatatttctaatggaaatgtattaaaaattcaggcaaaatattgaatgtaaataatttggattacaacttccaagttaattatcacaaaagaaatgttagcttttcacctattacacattttattacaatattttagaccattcatcaccttcaagagaatgtctgcacttcatttttataatttatagtgactaaaatgtgagaaaatactgattttcagatcagtgaataatttaaataaattaacgtataaactaaaatctaattttagttcttaccagcccctttttcttgactctttcatggtctaaatcaatctttggaaaatatgagtgaaggtggaatttgaaatgctaaatttgctataaaaatgtcattcacctatcctccaggattcttcattaaaaagaagcagtctaggcactttgctttatttctaactattattgaggtaaaaatagaaaaaaaataggctaagaattcatatcagtgcaattaatcttttacaactaccttaccctatttttgcaatagttaaggcagaaactagagattttaatgatttcttactttttttcacatacatttaaggagtacaagctcaattttgtcacatgggcatattgcatagtggtgaagtcttagttttagtgtatccatcacctgaattatttaccatccaccccccacacacaccatgtgcaccccaccacaccatgtgcacccccctgcacctaccttctgagtctccaatgcttattacttcacattctatggccaaatcccatttacccactgttgtttttgttgcttgtgctcttatggtcttagtcatgaatctttgcctggactattgagtcttcattaaatttctctagggtttcttctagtatttttgtatttttaggtcttacacttaagtctttcatccattttgtgttgatttttgtgtatggtgagagatttgggtctgttttcagtcttttgcatgtggctatctaattttcacagtaccacttattgaaaaggatttcctttccccagtgtatgtccttgctgactctgccaaagatcagctggctgtggatatgtggctttacttctgggttctctattctgttccattggtctatatatctgtttttatgccagtaccacacaatatgatgcctctagctttgtgcttttggcttaggattactttggttatttggtctctttctggttccatatgaattttaggattgcttattctaattctttgaaaaatgatattggtattttaatagggattgcagtagatctgaaattgctttgcatagtatggtcattgtaataatattaattcttctgatctatgagcatgtgatatttttctaattgtgtcatctgcatttctttcatgagtgttttgtagttctctttagatctttcacttccttgattagagaactattaccttgcatttgttgaagggatttctcactgcaaaattctgttctacacactagtaaattctcacaagtctgtgaggaaatttatagaagcttttcatactctgaatttatggctgataaaatttaaaaatatatacataatttgactattagatcagattctgatatgcaggagatgtatatcctggcctaaaataaattacattgatacctaatccccatcctgccaggtaggaaagtcagttatagttaatgctttctcctttcaaagcataaccaggaatctagcaaaagtctaatgtctcatgaaaagtaataaattctagaaagcccctttgttctattatccatactcctggtaattgtgccctgggttccaactgacagagtcttttaagtctgtcaagcgcattggcttagaagacttcctgctttgctaaatgacaggactattggtaagatgaggagcccctacccacctcagggagtctccctgaatcacccagcctccgcagtttctacacctttgccatttccctgacacataatggacaagccaagctctttcctgtctctgtacaaatctattccttttccttccatctgtgattgtagacactctctcctctctcccttattcccaaatggagtttactttcttgcctgtcctaaaactttagcaacaggtacaaagacatccggcagacattgcctttaacatttgtcaaagtccctgaggcaagacattaaaagagactgagtacttggatgaaaaatacaaaagactgatacaaaattaacatctcagaaattattttgctgagaataaaaactacaggaactacatgtgatgccatgagtcgaaagcattggaaccttggcttcctaaatccaaattcaatacttttttactatatcattttgtggattttgtatcctcaattagtgcctgttctgagattattgtacgtagtattattctaactagttttcattttcttgctagtttgtctgataaaatatctgatatctggctgttcaccccagattatcaagattgtctacataatagttcctcatgtcttctattaattttttttaaataagcatcagccgggtgctacacaggtagtgtgatgaacgaggtctttatccatgtgtgatgatgttgtgggaggaaacagtggctgcttgaagaaaataatctaaactgagaactgaagaaattttaggagtcatgcagataaataggatgaggagggaggatggagagatagtgtttggcagaagaaggcataaattcaacgtccaagacagtgcatgggccttcccaagaattaaaagaagttcaatacagcaaatcttcaaaagccttatagatcaagttaaggaattcaggttatgggctaatgattttggagaaatgtcactaaaggactcaggaattatataaagagtttgatgaaaccagagcagtatttgataaagataacggaatggagcatacaggacggaggaaggcagcgatggtggttgggggaggacggtgcacaatattaggttctggaaggccactgaagagactctgacagtggttcaactatgaaaatattcataactgggactaggaaaatggcgagccaaagagccaaagaaggaaaattttaaaaataaattccagtggtatgttcagtaaggttttttatgaaaatacattacagtgactcatgcagtatgcccttctcgcttaaattcctatggtacagaagcagacaactctagatgctcaatctttcacccctgccctcccatgtagccatagtgaccatgtgccagggctctgctcatgagttaaaacaccagaatcatcgttgagggtatctcttcccaaatcaaaaaggcaaagccttgcagggtggaaatccttttgccatttactatcatccatcctaacccagaccattcttaaaagatgatgatgcttggaaaacaatttttctttcagttatttaaattaagagcttacattctccaagtgcagaatggaagaggaatgtatccatgtgtctctttagataataagctgacaatccaacactctgcctcagccctccctgctccctagcccatgcaactagggctaccaaccacagctaataggcctcatgctgtgtgcatgcccacagtgcatggacttcaaaacttctcatttgatccttaattaaaaccactttgctgagcaaaaagctgactgattgccttaggagatctacaaaatagacactgttttatttatcagtacctgaatttatacattacacacattataatttacaacaaattatgtcatttctatgaggatgtcttattacctagaaataactactacattaatagaggaaaaaatgtacttgccaagtctttcagaccagggagggctgaggcagagtgctggattctgtcagcttattatccaaaaagacaggtagataaattcccctttcattctgcacttgaacacctagttattatcctccttgtgcttacattgttaagcctttctcctggaagtggcagatagtaactgctttgaaataatgcttaaaggatctctatgtgtctggatggagttaaggcacactctacatgtggaacttccttagagtgggaatgagcgctgagcttgaaacatttctggaaacttcaggaaccttggggaatgaaaaactataaataaatgaaatgagagcattcctgaaacctgtaagcagggtagaactccctggtataaccttgaaagtgaatatggattttgctttcaggccatagaaatgagctcacaactgaattagaaaaaccaagcagatcctgaattattctgctgtttcccagtgtacctgtaataatgtggcttgatagaattgattttttttttttttgagatgggttttcactctctctcccaggctggagtgcagtggcttgatctcagctcactgcaagctctgtctcctgggttcaagccattcttccgcctcagcctcctgagtagctgggactacaggcgccaaccaccacgcccagctaatttttttgtatttttagtagagacggggtttcactgtgttagccaggacggtctcgatctcctgacctcgtgatccgcctgcctcggcctcccaaagtgctgggattacaggcatgagccacagcgcctggccgaattgattttttttgtaagaaataaatgacttcctggctaaaagtgaataaagaattagtaaactaattggtgtgttttctaaaatagaagtggtaaattacctagataaaagataagagatccaattttaaaaatatggaataattatttaattagaaccttcttactatgtaaacaccttaccttaattcgtttccctagttataaagcagtttccatatgaactggaagcatatatgttttcatgtgtgttttctaaagactgctacagctcctggcacataataagtatgtaataaatatttgttgaataaatgaattttcacttgatttattaatacttttggtcagcaaattttctgagatgatgtttttttaactgtaaattgtaactcgactattggctgaattggacatagagtttgcctaaaaatttatggtcattcaaacatgaattgaccatgttataaaaatacagggattacattagcaataactaaaatgccaatttcaaatactatttgaatttccttttctttcctctattctgttcaccacctgagaggaatatagctttgcatgtgacatttaaaaatataggatagcagtggctacagctatcctatagtgacttcattattgtctttcataaatatttgaatcgtcttatttgtggaaaaatattgctttgtgtaacatgctctgaaaaaaaaaatccttctgtatgtgtttcatttcattgtttttgatgtgttttcttccaaccactagttaaaattcaaaaatcaaaattaattgtaaagaagtaaagtttgttactggagaaaaattaagacattttcccactatgttttgttgcgttcttttgaatgctcattctctcattatgcagttgtattatgatcaactcctcatcattgtttaattgtgtcctaactacagtccaagtgaccttctataatgagcttctctttcagggatcagctcctcctcacatttgaaaatatcgtagtgttttgactattattttcctacttcatgttatctggtaattatggcaatttacctttctacctggcattataaaatggtatttttctcatattacatttattttcttaatgacaacaattattttggaaagaacatatgtgagaattacagaactgagatcttttcaaaacctactcttttgacattctcaaaactaattgtcatttaaaatgacctgagaagctagagctcctatgagctggcacaatcctggcaagggtcactctcaaaatatccactgcaacaaagcccatctatttgatgctggcatgagttattaaccaaaataaaactgagaccatgaactcaggttccctcaagctctgcacagctaaaagctcagtaagtgagtagtatatggttcagcaaccctcctagaagagaatgactcctttcacaggtgcttgttgtacttttggaaagagacttaagctattctctagacttcttggttattactcatgtagttagcagagcaccatctgattatttattactttaggagcttgctttccttatctaaatcatactgtaaaacattgagttattttcctaggattcagttatttcatcaaaattttctttttcctatttggccctttagagtgaattatccttaattattttatctgctttatttgggaaagaaaaccattgcaactgtaggtatagggactttctctttcatctctgctgtgggattagtctgctttaactgaagagagtaattttaatgagttcctctgagacaaattttaattgaaacaccatgaattgtaacttttatgaggaaactttcagtttgtatttggttcctactagtagtattttctttagctcagtatgagaccgaaccatatttgctctatctgcatagatttcaataacaacaacaaaaaaagagtatcaacatttttgtggctagttctgtaaagaaccctttgtacttaaatctagtttatgtctgttttcttagctttacttatattttttatcttaagtagcaagcagcaagtatgaattgaatctcacctagcccttaggtttgcccttaatgatcttatagcttagctcctcagtgaacctccatttcttctaatacattggctctccaagttatatagtctttcctttgaaaatattgataattgcaatgaagtaattactattttaaagtactagagcttcagataatatttttaaagtttagcttttaaatgtgtataaaatgtctaatagagtgtagcatttggtgggatataatatacaatatcatgtaacatgatataaaatatttatcatatcatataataatttatatatgtattcactaatttggaaagtggatgctacataaaaaaagcttatgttatttttgacaaatactattaattaatttttaacacaaagaccttaaacccaaattaagaaaacccacataaaaaataaagacctaaaacacacataaaaaacaagcaagaataagaagaaagagaaggagaaaaagagaaagagaagaatgaaaaggagagccacactgcttatgtatacatgataaatctgaaattgcaacatcatccatttccaatacccccacaaaaaaaggaataatagaagcttattattcaaaacattattcaaagcattcaaaaaacaaacctgtgacagcgtgaaaaccattccaggattttcagttgcttctaatataatacataaagctgacagccattaatatcacatgtcctttgttttgagagactattattactttcagatttttatatagttttattgtaaaagtctaacaataatcccaaaacataaattttccccttaaagattaagaaactgacattttggggattaaaataagtggcaagataatatacattacaaataaaagaatgggagacaaaaaccaagtcttttgatactttataaattacacatggattcctgctccatttcacatcaatattttgtttataatacttaaagatttttaaaggctaattcttcacattataattgttagtatgatactaaaaaatcatatctgaatgcaccagattattatatactagttagctcagtttctctcaatatgtagatttagtttttcaaattcttaaattcaataggaattttatgcctagaaatatgttatctataagattgatgtagtgtttttccatggagtctaaaggcaaaggcaattgatgagggctaaataattgggtatgcataagttttcaggccatatcacgcttatcccgccacccccctccccctgccccagtattaattttatgtacatttctcttctggcagccacattccaaagctgtaatatacaagaggctaaaaaaaattctgccaaaattatattttaataaaagcaatggctattttaggagaggaagttgaagtaaaacaattcaagtcatgtatttaaaagataattatattaaaaataaccatagttagggatgatttctaaacctgtcattgcatataaagacaactattttagaacaaaattttagaacagtagttcaccaaattatctgttcaagttcaacactcactcatacattcattgtataaattaaaaccctgtttaatataatggtgatcagttctctaactttcataaacatgtattgtgtatcaagtgtagagtttctaatgggcacagtgttcatcacaatcattacacctctcaggtactttcatgtaaactatatttttaaaaatatgattttgaagagatctgacaatgttatttttcagagaaagaacaaccaatataatgataaattatagcataaaaaaaaaacttcctgacatctgcaaacaagtctgttctttaagcagaaaaaaagaaaattattgaaggcaaatttagtggcagttcactgacacttttaaaaaagaatgacttccaaggtttccaagagaataggataatattgcatgaatatggtttattaatattcatactgatacaatccataatttctgtaaaattgatcttcagttgtagttatagaaagattcagacaaggagaattccatgagtggagcatgaaactgggactaagcctgatcagattacataccaggaagtgtactgacatcatggttgtttatttcctttctaagtcatacagctgataacctatagttattagataccgaaaggaatgaagaaaattttataaaacatagctgaaagtagaaaatgttggtataaagacagaaaagctatttgattaatgtaaaatatagatatttctaatactggtgaatttggatttattaatagttatcctttaagaaattactctaattgaaggcctttctacatcccaggaggatctcttcattcaaaaattttaccagaataatagtttgcatatttcagttgtctgtactctctgtatgccacatttgttggaacaattgaaagtttgtgagacatagatcactagtaatttttcattccatttctatcgaaatgagggagaaagaatgtttatacttcagtgggcaggttgaaagtcttttctggttccatagaaatgtaaatccaattatatttaaaaggaaaattacatatcacttatacttcttattataaaactttcatgagttgtcttcttttatttatttgatattctaagtcatcctactcttcactccaccccatctccaaccacattggccttgatgaagaatatgtttatgtttttatccttggatgacaatagcaagtgacttattttctatcctctcatttttcctcatgcccccaccctttttttgtggtacttagtgaataagaattcacctttcttttagcatcatgtgcaattacataataaatggcatatgttcttataaggcatttgtggtcactcatgatgaaattaagatggcaattgttatagaaacttttaaatatgattatatatgcattaatgactcaatacaatgaaaaacctcaagtttgagagaaggatattattattattaagtttatgtatatttcttttcaagcaaacaccaataattatgtcattaaagatctaactagaactaatgagaatgagctagttaaatcacaggaaacaccagcactgacctctgttctgcgtagtcactgtggctgagctggtcatattgcctatgtggggaagaggtccagatggctacttattctcattctcacttgcacaggatataaaatattagcaatacatctgtataaattaaaaatatattataaatatattactatacaaaacattttgcataaattaaactgaaatagattaaacacaagaatgcacatagtaatcacagcataatacatttccttaaactttttttttaaattgaaaatattttttatttatttatttatttgtttttattatactttaagttttagggtgcatgtgcaaacttaccttcaacatttgtgatatctaaaagccatgaccatttcagggtctctgttaatacttacctacggtcatttttttttcttgaactcatttaggatcacagcctctatattttccttattatatagtaaaatgcaatttcattcgtcttcttacaatgctacaaataagagattataaaattatttattttattagtcttttacttctttattgaaagaaatcaatcaaaaggcgtatatctccaaattttgtcttctctcttgtagttttctaatcttttttattttgatgcatttaatctattttgcccctttaccaatggcttctttattttctttatagtttttcttactttctttgatagtttttagcatcaacttctcatgcttcaaatgacatttaaaatacttcactcattattgtattgcccattttcttagatgtagttaaaaatgttcagtccatgacattctgacagtttgcgatttttactcaaaggaagatgctagcagaccaagtgagacacatttggcagttgtgttccatttagtttgagttaataaaacaagggtgggggcaggggtatcactttgtgaggaatgcaatgcatgggaactaaatcaagcacttcttgggaataaatgaggataggagggggagagagaaaacagaaattctgtagtacataaattacagatattttaacagacaaaaaaaaaacactttatcattagtccttagtgactgtaaaaactttgtaattttatctgtgtaagcagaacccatatttgctaatggtgaatgaaactaaataagattcaacatgattaaaatgttaacgtgtaatatttaacaggatttctcctgcattgtctcagacaagaaatatttttcatgataatttggtaactacaaaattaggaaataaaagcttttcagaagcccacatagaaagctgaaaaaagatagaatactaaaatttctatacaacatgtatattttaaacacagctaattattgatttcattcatagcaaattcttaacatccatgtgtacatatagatttatgttatctttttaaaatatatagattcagcatgaatataaaaattttaactcttattctaaataaatattacatagtgctttcgtttaatgtaaaaatgtgagctatctccaggtactaggcatattagcaaactatatctaaaaatgaagagctgggcgtggtggctcacgtctgtaatgccagcactttgggaggccgaggtgggtggatcacctgaggtcaggagttcaagaccagcctggccaatatggcaaaactctttctactaaaaatacaaaaaaattagccaggcatggtagctgatgcctgtaatcacagctactggggaggctgaggcaggagaatcacttgaacccaggaggtggaggttgcagtgagccaagatcgcaccactgcactcgagcctgggcaacagagtgagactccatttaagaaaaaaaaaaagtgccacaatcagaaaattgagactgagtattattaacaatgactagttattatccccgcatggttgcactgttttttcttcttttctttttttaggtttttttttttttttttttttttttggtaactagctagttctggtttactctataaccaaatatgtgtagttttaattttcttcagctatgttcttattcattaatactgccttggatttgtaggtactgtgcatttttcaaatacatttttaattcagatcctcaatctcactatatacaacactccccctctacccctcccacacacacacaggtctacccaccaccattaacactaccactaacggcaacaataacaaaaataaacagaaatatatagatcatcattagtaacaaccttgccaaattaactagtaagttaatttttatactttaaaattttgtaggaagttttgtatacactcgttatcaaaaataaagttttattttttctttactatatacatatatatagcttttattttttcttgccttatatcacttgatagtatcaatagatagtatcgatagggtccagttgaatagaagtattgatgcttgacattattatgtttctaacctcagggggaaagtgttcactaactcatcaatgatatatgacatttgctgtattttcattgtggataccctttgtcagattcatgaaaattcccttctattcctagctttctgaaaattttcattaagaatgtgtatcggcttttactccaatgaatattttgcctatattgagataacattaagacctattctgttactgtggtgaactatgtatttattatattgaatgttaagccaacattgtatttttggaataaatctctattggtcatgatatattatattttaaaatattggtagattcaatttgctgatttttttattatactttaagttttagggtacatgtgcacaacgtgcaggtcagttacatatatatacatgtgggagttggtgtgctgcacccgttaactcatcatttaacattaggtatatctcctaatgatatccctccccacttcccccaccccacaacaggccccagtgtgtgatgttccccttcctgtgtccatgtgttctcattgttcagttcccacctatgagtgagaacatgtggtgtttggttttttgtccttgcgatagtttgctgagaatgatggcttccagcttcatccatgtccctacaaaggacatgaactcatcattttttatggctgcatagtattccatggtgtatatgtgccacattttcttaatccagtctatcattgttggacatttgtcttggttccaagtctttgctattgtgaatagtgccgcaataaacaaacgagtgcatgtgtctttacagcagcatgatttataatcctttgggtatatacccagtaatgggattgctgggtcaaatggtatttctagttctagatccctgaggaatcaccacactgacttccacagtggttgatctagtttacagtcccaccaacagcgtaaaagtgttcctgtttctccacatcctctccagcacctgttgtttcctgactttttaatgatcgccattctgactggtgtgagatggtatctcgtggttttgatttgcatttctctgatggccagtgatgatgagcattttttcatgtctctgttggctgcataaatgtcttcttttgagaagagtctgttcatatccttcacccattgttgatggggttgtttttttcttgtaaatttgtttgagttctttgtagattctggatattagccgtttgtcagatgagtagattgcaaaaattttctcccattctgtaggttgcctgttcactctgatggtagattcttttgctgtgcagaagctctttagtttaattagatcccatttgtcatttctggcttttgttgccattgcttttggtgttttagacatgaagtccttgcccatgcctatgtcctgaatggtattgcctaggttttcttctagggtttttatggttttaggtctaacatataagtctttaatccatcttgaattaatttttatataaggtgtaaggaagggatccagtttcagctttctacctatggctaaccagttttcccagcaccattaaatagggaatcctttccccatttcttgtttttatcaggtttgtcaaaaatcagataattgtagatatgtggcattatttctgagggctctgttctgttccattgatctatatctctgttttggtaccagtaccatgatgttttggttactgttgccttgtagtatagtttgaagtcaggtggcatgatgcctccagctttgttcttttggcttaggattgacttggcaatgtgggctcttttttggttccatatgaattttaaagtagttttttccaattctgtgaagaaagtcattggtagcttgatggggatgacattgaatctgtaaattaccttgggcagtatggccatttttatgatattggttcttcctacccatgagcatggaatgttcttccatttgtttatatcctcttttatttcattgagcagtgggtttgtagttctccttgaagaggtccttcacatcccttgtaagttggattcctaggtattttattccctttgaagcaattgtgaatgggagttcactcatgatttggctctctgtttgtctgttattggtgtataagaatgcttgtgatttttgcacattgattttgtatcctgagactttgctgatgttgctcatcagcttaaggagcttttgggctgagatgatggggttttctagatatacaatcatgtcatctacaaacagggacaattcgacttcctcttttcctaattgaatacccttcatttccttctcctgcctgattgccctggccagaacttccaacactatggtgaataggagtggtgagagagggcatccctgtcttgtgccggtattcaaaaggaatgcttccagtttttgcccattcagtatgatattggctctgggtttgtcacaaatagctcttattattttgagatacgtaccatcaatacctaatttcaatacctaatttattgagagtttttagcatgaagggctgttgaattttgtcaaagaccttttctgcatctattgagataatcatatggtttttgtcattggttctgtttatatgctggattgcatttattgatttgcatatgttgaaccaggcttgcatcccagggatgaagcccacttgatcatggtggataagctttttgatgtgctgctgaattcggtttgccactattttattgaggatttttgcatcgatgttcatgagggatattggtctaaaattctctttttttgttgtgtctctgccaggctttggtatcaggatgatgctggcctcatgaaatgagttagggaggattccctctttttctattgattgaaatagtttcagaaggaatggtaccagctcctccttgtatctctggtagaatttggctgtgaatccatctggtcctggactttttttggttggtaagctattaattattgcctcaatttcaaagcctgttattggtctattcagagattcaacttcttcctggtttagtcttgggagagtgtatgtgtcgaggaatttatccatttcttctagactttctagtttatttgtgtagaggtgtttatagtattctctgatggtagtttgtatttctgtggaattggtggtgatatcccctttatcattttttattgcatctatttgattcttctctcttttcttctttattagtcttgctagtggtctatcaatgttgttgatcttttcaaaaaaccagctcctggattcattgactttttgaagggttttttgtgtctctatttccttcagttctgctctgatcttagttatttcttgccttctactagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttttgtctttattctcattggtttcaaagaacatctttatttctgccttcatttcgttatgtacccagtggtcattcaggagcaggtggttcagtttccatgtagttgagcagttttgagtgcgtttcttaatcctgagttctagtttgattgcactgtggtctgacagacagtttgttataatttctgttcttttacgtttgctgaggagtgctttacttccaactatgtggtcaattttggaataggtatggtgtggtgctgagaagaatgtatattctgttgatttggggtggagagttctgtagatgtctattaggtccgcttggtgcagagctgaattgaattcctggatatccttgtgaactttctgtcttgttgatctgtctaatgttgacagtggggtgttaaagtctcccattattattgtgtgggagtctaagtctctttgtaggtctctaaggacttgctttatgaatctgggtgctcctgtattgggtgcatatatatatttaggatagttagctcttcttgttgaattgatccgtttaccattatgtaatggccttctttgtctcttttgatctttgttggtttaaagtcttttttatcagagactaggattgcaaaccctgcctttttttgttttccatttgcttggtagatcttccttcatccctttattttgagcccatgtgtgtctctgcatgtgagatgggtttcctgaatacagcacactgatgagtcttgactctttatcaaatttaccagtctgtgtcttttaattggaggatttagcccatttacatttaaggttaatattgttatgtgtgaatttgatcctgtcattatgatgttagctggttattttgctcgttagttgatgcagtttcttcctaccattgatggtctttacaatttggcatgtttttgcagtggctggtaccggttgttcctttccatgtttagtgcttccttcaggagctcttttcgggcaggcctggtggtgtcaaaatctgtcagcatttgcttgtctataaaggattttatttctccttcacttatgaagcttagtttggcaggatttgaaattctgggttgaaaattctttctttaagaatgttgaatattggcccccactctcttctggcttgtagagtttctgccgagatatcagctgttagtctgatgggcttcccttgtggtaacccgacctttctctgtggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatttcctgcagagtgttttccacttggttccattctccccgtcattttcaggttcaccaatcagacgtagatttggtcttttcacatagtcccatatttcttggaggctttgttcgtttctttttattcttttttctctaaacttctcttctctcttcatttcattcatttgatcttccatcactgataccctttcttccagttgatcgaattggctactgaggcttgtgcattcgtcacgtagttcttgtggcatggttttcagctccatcaggtcctttaaggacttctctgcattggttattctagttagctatttgtctaatcttttttcaaggcttttaaacttctttgccatgggttcgaacttccacctttagcttggagtagtttgatcgtctgaagccttcttctctcaactcgtcaaagtcatttgccgtccagctttgttccattgctcgtgaggagctatgttcctttggaggaggagaggcactctgatttttagaattttcagtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgttttcctgggtatcagctgcggaggctgcagaacagcagatattggtgaacagcaaatgttgctgcctgattgtgcctcttgaagttttgtctcagaggagtatccggccatgtgaggtgtcagtctgcccctactggggggtgcctcccagttaggctattcagggttcagggacccacttgaggaggcagtctgtccgttctcagatctccagctgcgttgctgggagaaccactactctcttcaaagctgtcagacagggacatttaagtctgcagaggtttgtgctgccttttgtttggctatgccctgctcccagaggtggagtctactgaggcaggcaggcctccttgagctgcggtgggctccacccagttcaagattcccagccgctttgtttacctactcaaggctcagcaatggcgggcaccccttccccagcctcgctgctgccttgcagtttgatctcagactgctgtgctagcaatgagtgaggctctgtgggcgtaggaccctccgagccaggcatgggatgtaatctcctggtgtgctgtttgctaagactgtcggaaaagtgcagtattagggtgggagtgacccaattttccaggtgctgtctgtcacccctttccttggctaggaaagggaattccctgaccccttgaatttcctgggtgaggcaatgcctcaccctgctttggcttaggcccagtgcactgcacccactgttcttcccccactgtccgacaatccccagtgagatgcacccagtacctcagttggaaatgcagaaatcattcgtcttctgcttcgctcatgctgggagctgtagactggagctgttcctattaggccatcttggctccacctgtccttgctaatattttttaaggatttctccacctatcctcatgagaggcataaatctgtggcattcctttctcacaatgctcttacctggctttgatatcagatccatgctggcaagaaaataaaaataagttcctctgttttctaaaaaatttgtataagaatattactatttcttactttattgtcagaaaaattcaccagagtgttcacctgtgcctggagttttcaacttttaaaaatagatataggactattttgatattgaatttcttcttgttaatcttggtaacttttttttttaagaaggaatctattcatttaagtttggctgtttgttttctatatgtctcatttgttatataatccttgattcatcctttttctgctttgttgttacacagacaggatttttattacttcatttctctttattgttaggttttatattagacattcttgtgctacatttaaatttttatttatttatttttatttttttgaaatggagtctcactctgtcacccaggctggagtgcagtggtgcgattttggctcactacaacctctgccgcccaggttcaagcgattctcctgcctcagcctcccgagtaactggaattacaggcatctgccactgtgcccagctaatttttgtagttttagtagagatggggtttcaccatcttggccaggctggtcttgaactcctgaccttgtgatccacctgtctcagcctcccaaagtgctgggattacagacgtgagccacagcgcctggcattaccctagagatgtcagtatggattattaacttactacacttcactctgattaagatgtactacttccagaataaggcatccccaacaatttactacctttctggttatgtctgttactactccaccttatgaaaaccacactcttgccataccaaaccttagttgcgattcctaatctccctgtatgcactcatctctcagtatcatgtctgtgacacttgttttctgcctgcctacctgttgcctttaaaaaaataaattgtattgtgtatatttaaggctcacaatataatgttatgggatacacatagattgtaaaattattactatagtgaagcagattaacatatgtattatctcagttacttttgtttgtgtgacaacagcagataaaatctacttatttaacaaaactccctaatacaataccattttattaccttaatccttatgtacattagagctctaagcttgtttatcttacatatatgctgttttatatcttttgacttacatctccccatttccaaactgccctcactcccctgcccctgcccaagaatgaaacagtagttactgtctgtttatgtgtcccatctcattgtgataaatcctttgtctgcctcataatacaaagtgcattaattcatttctccattcatttcagaggggaacaaatcactttgctaatgatttctcacccaaagacataaagacacattcccagctctcaatgctcctagattattaaaatatgttttaaatcacaatattctgggttttttttctctcaaacttgatatcagagttaataactgtggtgttcatatttcatccccagaccttgtcacagagtaggtgcttaatatgtgcttttgaataagtacatgaataactttcttcatttcccctgagtaataagcccaaattcttagcacctcattttcatatggcactcataaaatatgtgtggcgtacctgttatgtggcagtcactcttgttgctgctggagacattacgatgaagatcaaaaagttcctgcttctgcggagcatacatcccaatgggaacattagtcggttaataggtgaaaacataagtgtagaatagtaagtagtatatgggaaaaaaaaaagcaaatttgggaaataggtcctgatgtcctgggtatgctggtttaattgtgttaattatgaaaactctctccaaaaaatcatatttgagcagaggtctggctataaaaattcttgagtgtttcagctgcttattgctcaaaattcctcagaagaagtgtaaaaacactgatttatgtttctcttgtattctagttacttgtaagaaatacttaaaatactttaaagtgtcactagcagggttttttttcccccggacataaacctactttatctctcagtattccatcttaagagatctctatttagatagacttattatgttccaaacaggattttcaaaagtcttgtctgtacaaattcattcacccccatttcttcttatgtaaagtctccctagccccgtacttaacacaaaaactattttaattctctactcttcttccaatgtgagctgaaatctcactttttctagttgcagtttccaggttatacaaagttcattagttttccacaattttgaaactcttctaggtcttattgtttagttcattcaattccacaaatatgttaccatatcacaattgctggtttataagttttccctatatcttttcaattatagaatatttctagctgtttggataggggttatactatccatattttcagtttccctacccagtggtgcatatagtagacaatcaataaacatatcaaaaattggtaggtgtgccaatgtacaagactgccatactaaataaaatgtcatttagccagggggaaaaatgccaggtagacaatgagaaaattaacataaattacatgttaagtatctactatctgccttaagtatacatagtatcaaagacatatttgtaagacagcaatttttctgcttaatacttatatatttaaatataatatttaatttgtatattttgattatttaaaacatctcacatacctttcatactaatttgaacatagcagatggtacactaattctcatatttaaagaaagatgctgtattgattttacatttgataatagtaaattatattataaattttagtgttgaaatagatgtagcaatagagaaataatcactgttaaatcctctgagtattatcataaatattcaaacatacaattttttttttgtttagagtcttctgctttattttgttttgttgtttgcaaaagcaatgtaagactgtatgagacaatataaaccttgaggctctacctattagaacttaagatgagttgatagaatttgcagtaaaaactgctggctttgtgtataaaaacataccattttaaatcctattctcacaactgcaaagaaggaatgtctagtatgccataattggtgactcaccagttttgttttatacctttagagaatcattcattcatttaaaaagctttatctcatgagattcatcactctgaacaccaaattgatgtacaaataaaataaatttccctttaattgacagatggtctaatgaatgtgtagcttcaaatttttattttgtagtcttagaagtgacagaatctaaaggctcagcactaaaaatatgcgtacaaacattttttaaaagaagctttgggtggatgtatacattttacttagggcatatgaatttgaaaataaaaatatgttggccgggcgtggtggctcatgcctgtaatctcagcactttgagaggccaagctgggaaagtaacctgaggccagaagttcgagaccaacctggctaacatggtgaaaccctgtctctactaaaaatacaaaaattagctgggcatggtggcaggtgcctgtaatcccagctactcgggaggctgaggcaggagaattgcttgaacttgggaggtgcagcttgcagtgagccgagatcgcgccactgcactccagtctgggtgacagagcaagattccatctccaataaatgaataaataaataaataaatgaaaacaaaaatatgttgaagaaaggaaaggctactttacagtacaattttcttttttaattatttccattgtttgggaaaacaggtggtgtttgtttacatggataaattttttagtggtgacttctgagatttgggtgtacccatcacctaagcagtgcacactgaacccaatgtgtagtctttcaccctttaccctggtagctttacccctgagtgcccagagtccataatattattattatgcctttgtgtcctcatatcatagctcccacttacaagtgagaacatacgatgtttgattttccattcctgagttatttcacttaaaatgatggtctacagctccatacaggttgctacaaatgccattatttcattcctttttttggctgagtagtattccatggtatgtatatgctacattttctttacacactcattggttaatgagcatttaggctggttccatatttttgcaattgcgaattgtgctgttataaacatgcatatgtaagtgtctttttcttatgatgacttctttccttctgagtggatacccagtagagggcttgtgaatcaaatggtagttctacttttagttctttaaaaaatttccatactgttttccatagtggttgtactagtttacattcccaccagcagtgtaaaagtgttcctctttaatcacatgcacaccaacatccactattttttgatttttaaattgtggccattctcacaggagtaagatggtatcatattatggttttaatttggatttccttcataattagtgatgttgagcactttttcatatgtttgattctgtatgttagtcctttgtcagacacatagtttgtgaagatgttttcccactctgttggttttctgtttactctgctgattatatctttcactgcacagaaacttttgagtttaattaagtcccatctatttatctttgtttttcttgcatttgctttggggttcttggtcatgaagtctttgcctaagccaatgtctagaaggggttttctgattttatcttctagaatttttatgattttaggtctaagatttaagtttttgatccatcttgagttgatttttgtataaattgagagatgaggatccagttttgttcttctatatgtggcttgccaattattccagcaagatttgttgaataggatgtcctttctccactttgtgtttttgttcgctttgtcaaaaatcagttggctgtaagtatttgcctttatttctgggctctcaattctgttccagtggtgtacatgcctgtttttataccagtaccatgctgttttgataactatagccttgtagtataatttgaagtcaggtaatgtgatgcctccagatttgttcctttttctttgtcttgctttggttatgtgggatcttttttagttccatatgaattttaggattgctttttctagttctgtgaagaattatagtattttgattggaattgcattaaatgtatagattgcttttggtagtatggtcattttcacaatattgattctacccatccatgagcatgggatgtgttttaacttttttttttttttttttttttttttttttacggctcttgtaacagtggttaagttgttgatttgattctcagcttagtcaccattggtacatagcagtgttactgatttgtattcatcgattttgtataccgaaactttactgaattcatttaccagtaaatgaatttttactgtttactggtaaatgaattcagtaaagtagtaaactaagagttttttggatgagtctttagggttttcatggtacatgattatatcattggtgaaccatgacagtttcacttcctttttaccaacttggatgccccttatttctttctgttgtctgattgtcctggctaggacttccaggactatgttgaaaagaagtggtgaaagtgggcatccttgtttttttccagttctcaggcaaatgctgtgaactccctcctgtcccattcaatataatgttgcttgtgggtttgtcataaatggcttttattaccttgaggtatgtcccttctatgccaattttactgagggttttcatcataaagggatgctggattttgtcagatgctttttctgcatctattgagataatcatatgatttttgtttttagttctgtgtatgtggtgtatcacatttattgacttgcacctggcataaaattttctttttaaataggatgtatggaatgacatagatctagttaaaaccagagactatataagtccaagagaccttacagcaaattttgtcattaatggaagaaagatttatgtcgtttaaacatttccgcacgttatatggctaatttctaactatggaagtgctagtgaacattagtctctcttttatttacttacatgtaacttaggtagcagaatgtttatttcaaggcgtaactgtgttgggttaaaaatttatatgaagtaatttaacacaatactttgtatatcatggatgctcaataactagctgttatatacatgaaatttctcactgatttgttttccatttacgttgaaaagtaataaatgacattttctcctaagaaatcaaacagggaagcaaagaagatgaaatttgtttttttttgtttttatttttggttttttggggccaaatgtcatttaaagatttttgtttcttttcctttgattggagaggtttccagtctgctttttgagaatataatttcttatcaatccccagccgtatgatcttggctgtcagggctattgaatttaagggcagtagtagtaagaaactaagaaaagaaagatactttttttttgaggaatcactgatatggaaaccaaattttctaacaaaatcttgaattctagtaatacaaaatgaataacatgtttgtaaatcaaggttactaaagtgaaaaatataaaaatctctaaagatttttaaaaagtgtttttaaaatcatattaatgaataaagaccttgttttaaagggtactagaaatattatttcttaaatgatgagttatagatgcatattattagacactcaagcacatacacacacaaatacatattaattactcagcttaattctgtaatacttaacagcaattgtattaaagtcaataccagagtaaatgcctgttaataattatttattgttaactatataattagataagaaatcatgagttatgaagaaagaggaggcaaaaatattattatttgaagtaaacattgtgtatctgtaaaacactagtttttaaaaattatttaaaaatagttcagtttggtagctgaataagaagtataaaaataaataactttagtgtgtgctatttagaaaaatgtaatgaaggaaaggatactacaaacaatacaatgaaggtaaaacacatctacaaaaatttaccaaaaattgcataggactaaaagaatgaaaattgtataaaacgccactgaggtccaaaagcagaacacttgaaaaatagctgatatatataaaaatatcaattatataaggatgaacctgaaaatctaatgtaatctaaaaaacaaaatccagaaaggccagtttattaaaccgttcatacagaaaaataaacatgttatcagttggaaaaagaatacagtaagaaatggctttgcatatattaaaaggggttactaatgatgtttccaatgcaagcattggcatagcagtgaatgccatgataatgtttaaatatgcatgagcaagtgtacaaaattttgtacatagcattttaaagcagggaagaaaaaagcaaattactcgataattttttttttttttaatatgacagggtcttgttctgtcacccatgctggaatgcagtggcccaatcttggcttattgcaacctctgccttctgggttcaagcgattttcattcctcagcctccccagtagctgagattgcaggtgtgtgccaccacgcctgcctaatttttgtatttttagtagagacggcatttcgccaggttggccaggctggtctcaaactcctggcctcaggtgatcagcctgccttgacctcccaaagtgctgggattatagacctgagccactatgaccagcctcaataaatagtatttctataactgcctgaacatttgctttgaaaaaaataaaaattatatttatcgcacttctcacaccaaaacatattccagatgtttcaaaaattttgatagataaaataaaaacagaatggtagtaaaactctgagtttttaaatagatactaaaagtgatactagactagggaaggccttctttgtaaatatataaaatataaaacgagaaattataaaagaaaaaagtaaaatcatctggatggaaaaattaatctgatttaataaaataaaatatttgcaacatatgtaattaacaaaaatataataaatatagtatgtaaaaaacaaaaactgtttttaaaaatgcttgaacaatcatttcacaatgaaggaaatacaaatgataaagatataagaaattattaattcatagtaatcaagaaatgtcaaattaaaatatgaggaatatatattttactgatgaagctgaaaatttacagtgtgtctcaggatgtgtcaaaactgttatatgtactttaaagatatctcagtaattccatttctggggatttatgcttccccttcaaaaatgcataactgtgaaaagcaaagatgttcattgtaatggaaaaattagaaataatagtatattttcagtggaatggtgtaaattggaatacaatcaaataacatcaactattggaagtaaataaaaagtatacaattattctggaaaaatcaagttacaaatcagtgtgtgtattaaaatctgcatacaagtattaataaacgtacactaaaaatcttggcagtggttctctctgcaatgtgagattacactttctacttctgtgtggtttgctttttatattgagtatatttcatttacttaaaggcaattaaaataatataataaaatcttagtactagctccttctgcagagcacagcaataggcgataatacacattccagtcttcctatctgttctagaagataaaatggcttttatagagatgataatctcattttgttttctcctgctagggaaaggtgaacatgggaaaccttacccccttactgaagaggaccatgatgactcagcttacagggaaaatggttttaatattttcgtcagcaacaatattgctctagagaggtctctgccagatattcgtcatgctaagtgagtatcagcatatcagtgatcagggtgggtttttttggttttttttgtcctttgatttttttttaaatgtgtatcactgcgagatatgtaaccaaatattttatcctaataattttgataaaaactcatattgcatcatcttaaatatacttgacctaaattggagtaaccattaaaattttaaaacaatactgaatttctaaaaatccaatacacatttttgttgactgtgttaactcattaacataaaatattttaaggcaatatccatacttttaacttttgatcatgtaaattacaaagcaaatgttttttgctggttattagagctaccagaactgtctacatgtgcatgtcttctatgaacttcattctcaccccagacagatttagtgccatggttgttgcattttcataaagaataccctaaatgaatgcatccataatccaaaagtgataagtagtgattgctggttcaatttcttgtcactttatgaactgcttgtggcttgtctgttgacagtgagttgagtttctattgaactgtaactgcatattatagttgaaatgatactactatatatacttaccccaaatccatcttttctctatccacccccatctacatctaacatcacttattgtacttttcattttaatgtgttattgttttcctaatagcataaacaccaccaaaggatactaactgagaacatggaatgtgataagaatttgtaatgtagtgttggcacatgtatctgataaatctatctaactgtactaatatagctatcctttcacccacaacaacccaaaaacttccctatggaaaccctggtgtgagagagagaaaatcaaggaaaaaaaatcagggcaactaattaaaataagaatcagaaatctaaattaaaccagtaatttaaagcgaataaaactccttaactttgtgcaaagataattgaccctttagaaaaaaatatcagtacattatggtttgaaggactattttctagttgccattttgtatctttagaaatttatttaaaattatgaaataattactgtttttctcctcatgttttatatgaagttgcatttcccaatatagctaaacagaggactaatgtgaagaacaatctttttttcctaaattgagtgctttatatattgacccaggccttttaaccagccaaattatccccacgttacctgaaattatctacagtaattctcactgaccaagaacatttctagttacgagaaattttaatacctaattgcacatcatcaaagatgcattaagttgcattgttggcataataaatatgctaagagagtaatttttatctatccagttcccccccccacccccacacttcttttttttttaggtggagtctcccactgtcgcccaggctggagtgcagtggcttgatctcggctcactgcaagctccgcctcctgggttcacgccattctcctgcctcagcctcccgagtagctgggactacaggcgcctgccaccatgccggctaattttttgtatttttaatagagacgggatttcacctgttagccaggatagtctcgatctcctgacctcgtgatccgcccacctcagcctcccaaagtgctgggattacaggctgagccaccgtgcccggtccccaccccaacacttctaatctcaatctcttaatgtgtattcaagtggaaataatgacaagtttagaaacagtgcagaaaatcactgaagtcaaaagaagacagttattcccattcttctcaaaaactatttttagtgtgaacaccatcttttaagaaaagatcttatgtaataatgggaaaaaaatggaaagatgtaaaaaaaattctgaaatttttattagggttactcaatttacaatatgaagaaagcattattataaatgttacggaagaaaaatatggccaaaatataatctgggataatattccaacttagttactaaggctggatatttaataggacaagtggtcatgtagtaagaaaaaaagaaaaaatacgaaaacaaacaacaacagcaacaaaaaccttgagagggtttgagatggataaaaagaaagtgttaagtatactaccaggaataaggttcaccttggtgaggtcagtatttgactcttagcaatgctggaagagaagcctgatgtcacctctgattttgccatgctccacctgcaggaaacggagagccaaataatgtcttacaggctcccactgtttaaagtactatgcttttgacttcatctgtgcttcaccaaaggcagggcaggtacatttaaccacaagagtatgcagctctgtgtaagtgatctttgaaattataagatcaacttgtgacatatttcagtattatctatttaactaggctgaaagtgatggaccatagcttttttatattgacacaatctatagaatagaatgcaaactttgtgtgacttttaaaataaaacatcacttctaagaaacttttccttttcagtaagccaattgaaactagtctcagagtgctaggagggaagagtttatttttctttattctaggattttgcaatggaagatatggggactcctatcttgagatttaactgaacttgatcttattctaaagcatactagccggacttatgccatgtgataaactattggtcactccctgtatatttaagtgctctgtactctttcatattctcacatttagttaaaaaaaatcatggttttatatgttttgatatgtagtgcacattctagtacacaatgaagaatatttaagacaatgtatttcagaaatcctaatgcgtaggctttttttttttttttttttttttttgaggcagagtctccctctgtagcccaggctggatggcaatgatgcgatcttggctcactgcaacctccgcctcctgggttcaagcgattctcctgcctcagcctcccgagtagctgagattacaggcacctgccaccaagcctggctaaattttttgtatttttagtagagacagggtttcaccacgttggccaggctggtctcaaactcctgaactcaggtgatccgcctgcctcggcctcccaaagtgctgggattataggcgtgagccactgtgccaggcctgcatagggattttttaaagaaattttctgattcatttcttcactagtataaaaataaactgctttttttggctttattatttcagaatcagcatagatttccttaagtaggagccatagacgaaggacagtatattggcatgtgtgcaataatttgatcagtcttacttttatccaaaaaataaatttcaagcttttcacttttgtttttaatttttaaaatagtttttccaaatgctcttaacatctctctatcttacaaattgtttcagcttcttacactatctgtgctttggtatgtcaaatttttaatctttttttatattctcctagccctacactttgggttgattttatttatttatttttttgagatggagtttcactcttgttgcccacgctggaatgcaatggtgcaatctcagctcactgcaacctctgcctcccgggttcaagcaattctcctgcctcagcctcccaagtagctgggattacaggcatgcgccaccacacctggctaattttgtatttttagtagagacagagtttctccatgttggccaggctagtcctgacctcagtctgcctgccttggcctcccaaagtgctagggttataggcatgagccactgtgcctggccctggttgatttttatatattttttgagcatatacttgatgtattttaaatactcactcccttcttctgttagtgccaagtcatgtctgtatccatagtgcctgtgatcagcctgaatctctccttagaacatcttatctttatattttatttaatgcaatgttgaaaagaattttacaatgagcacttctgtatgacaaatgtccagtcaatggatatctcggtggcctggttttattttgccacactttaaggttttctccacttgtgtattgattttgccatgtctttgtatttagtcatctacctgagatgtcacatatattcttagcatgctatggaacaccttatttaacttatagttcaggatgggagacataagacatctatttgaaatatacatataaaatagggaaatagaaaactatgtaaaaatggcctatatagaaaagaagctctgataaatttgtgcatgaatatgttgttgctaagataaaattgaagaatttttaagcaagtattattccctgcatatggaagaattaatcaaaagttatcacaaataccccgtaaacatgatataattagtgtaattaatgtgggtaagaaaaattcatatctatgaaaaaaggaataattgagataaagagctagaagaaccattctaataggagagttgaggtaggcttcacagcagttttgggtaaatgcatctttgatatgagtttcatttttttggccgttataaaagtatatgtgtttatacagataaatatttatgcacctacatgttacctgagatagacttctaaggtggctgagtagctgggatattttaaaattaatatagtctcactttgtattgtgactttttatcatttcttttttatatcactaatattacccaggtagaaatagttttagcttcatgactttgacaataaatggagtatgaggtatcacagagtgttctctcaacactcaatattccattgcttgtcaaagccatgaagctaaaactatttctgtctaagagaatctttacaaccttttggattatatgattgttttcagtagggttgcagttataccagactaatgtagtcctgtttcctgtagtttcagaaccatttgagagatagccccagaaacgatttgctatgaaaacattcgctttattattgttgcaattctattggtgagcatggtttagatgcaggccaagtattatactcaagactgaagtccagaatgaggcacattcagtcttcaagtcacagacattgctggatagcataatcaaaattgtcaaacttaagtcatggatggcagaataagatgactgatctccgcaggcaagcaggttccaaagcagaaaaaaatgaagaaggagctggccaactacagtaagctttgtaacccaaacccacgaatctctttctccgggaaagaaactctgaaaaggtggagaaaggccaggtgcgtttgtctaatgactgtcctgccacatgggaacatctgtagagaaaagaagtctcctcctgtgataagtagtacatacttacaagtacttacatgaagtacttacaaagtcagcactatatgctatttcttgatatatacagacttttgagcaaactcttgatttttcagtgccttatattctaaatactcctgccttcctggaagtatattgaataatgattctaaatatattgacttgcatgacttgcattgtgatgctgaacaagtccaattgcgttttgaatgtttatgtgcccatttccgtaagcggggatgcaagtttcttcagcttcctcaccatgtatgaagattattaaaattggggcaaggtttaccaaatcagcgatcgcgtgatctattcagttatttctttgtcttctgataatgatcttgttgattcccttttttattttccagttatatcatggagatgtaaaatataaggagacctagtgtattctaatttcacaattttaattgtaaatacataattagatttttattagaaagaatagttatgtattcaatttctttcagataagattttgtaaatatactataaatagtttttattttatttttatgcatagtagaaaaatgtgatccgttttgactcttgtctttgtaatcctagaactcattggcaaacatatttgagtttaaccgtccaaaaatttgcaaggataattttttatatttctcaatttcaaaagccacataaaaagtgaatagcactagttgattgccttttccatttttattatgatatccttgtgaacttgattaagtaccttcattcaacaagtttacaagtgaattcagaagcaaaataaactaaaatgactgttcatgcactccaattaggtgtgaatgttgccacagagacagagatgggaaatgtatcctttaaatcaaacactattctagcctagggcacatctaaatattacttaaaaaataaagcaattaaatgataagcaggagattgaaagaaggaatagctagaatcaggtagaagccatctctcaaaactgttatttaagtgagtacccttcaatattttttgaaaaccaattgtatgcacagtaatacagacattagtacataagttctcagggtcattacagaaagtcataatgaaataacaacaacaaaaaatttagatatacctctcattcttgactaaagcctgaaaaagacagaaggtgtttatcactgtaactaagaggtatgtccctagtgaaacaaaaatcttccttggagagataacagtttaagacttgtcagacattaaccttttggagtgactgacagaccatgaggctgggtctttgaaaggctgaatgaggctgggtgccatggctcatgcctgtaatcccaggactttgggaggctgaggcaggtggatcatgaggtcaggggttcgagaccagcctggccaacatggtgaaaccccgtctctactaaaaatagaaaaaattagctgggcgtggtggtgggcgcctgtaatcccagctactctggaggctgaggcaggagaatcacttgaactcaggaggcagaggttgcagtgagccaagatcgcaccattgcactctggcctgggcaataagagcgaaactccatcccccccaccccccaaaaaaaccaacaacaacaaaaaacaacaaaaaaagaaaggctgaatgaggacaaggataagggaactggagtctaaaaggataacaatgggaaaacagtgcacatgaaaaaaaaatctaaaaataaactatggctgcttcaaaatcatgtgtgttgaatatcaaagaacagcctctgtaatcttatgataaggatcaaataaataaaactgaaagcgtaggtttgagcaatagattcataattttgacctttaaagaaaaaaatctgaaaatttgatgtaatcatatacgttgctctgtaaggtttatctagcaactgtatttctaaattttccccttcctcgttttactcctacccacagaagtttactgaaatgacagacagtgatttaagattttaggttgtatataataaagaatgagtctgtaagaaaattctgccattttaaagagaatgctggagcttcctttccaaatcagcaagccatgtaatcttaaactattgttaaagtaatcactagcacttagattgtgatgccaaacagtggcattaataaatgtgattgcggccaaaggataatctgtaaatctaatgctcattcaaattaaaaaattaaagtagatatatcacgtattctcttgaacttaataattaaacagaattggttgaaccatcaatgtgcatgttaccacactacagaagaagtcatttaaaattttaataaatttatctcatttataaagattcttgatttgaatattttaaatgtgcacctaaaaactattaattttattctcaagtattcacagataattgtacttgattttacagaagaaaaactgtctctataaattttattttaaatcattatcttaaaacatactttatcaagattagaaatcctggtaagtatttttcaataacaaatgtgctcttacctgaagcacatttttagttgtctgacaattatttattaagcatgtgagtgacaggcacttagatgagtttataaataagtcatccaaaggttggatgtcagcataaggtactcccctgacttgatccctggtgaagttggtgaaaattatttctttaaaaatatctaagtctctggaaatggtcctaaaggcaaatagaaagggaagaaacatctattcaaggcaatttatgaaaatttggtaagaaaggaatttgtggtatctgaaagaagatcactctatccttctctcccaactcagcaagtcagacactacttcagacagatgcaaccaagaacacagggctttctattggcctcactccgaatccaagagccgtttacctaggaggagcaggacttcaatatctctcatcctgctccttgtttcctgttactaagagaaagtcttgggtaatcatagtacagaggtggcatctcttcttcctcttagccaccacacatgaaacagaggctctacgtggggtatagcatgctgagaatacttcaggcccttattgtactttgcccagtttgtgatgtggtgatttcacgtgagtgatgcaagcagagaggttctcaggctactggtcccctcttcctgagtgcttagcttctagagcagggtgtctttccaggaatgttggccttgtccccacccttatctccagagctttgcttcagagattttgcctgagagagaagcaaggcacaaaacatatagcaccaaatatcttcccaaagaaactgacttctttgcaacgttgcatagagaagttcaaacctaaggtcacgctgaaaaagagattgtggtgaaaagtaattgtacggtggtggtttgtatatttaggaagatacagcctagactgtaggccagccattttgcaggagagaaaaaaagaatgagaaacttgggaggatccctcctggtgtcagaacaaatatcacagagagacttcaaaaactaacccttcaaatgagccacaatttgaacaggttagtgtgtagaacagtttatatcccagggcactgttaaaaacaagaaagcaatcaaccagcaattagtggtgtttaacagcaggatatggtcaggaaagagaggaagaaacccctacgaataccactgtcatctcaggctgaatgtgggcaacccaaagccacagccccctgaggagcaacgctggagacttaaccatgtaatgaaaagaaatggacttcaaacaaaatacggtggttttcttttatctgtgatttcacttttggaggctttatttacctgtggtcaatcatagtcaaaaaataagtgaggacagtacaataaaatatttggagagagagtgagaccatattaacataatttttgatacagtatattgttataattgtttgattttattattgttgttaatctcttactctgccagatttataaattaaactttatcataggtgtgtatgtgctggaaaataataataaatatagagttaggtactatctgcagttttaggcatctactaggggtcgtggaacatatcccccatggatgtgggggttgggggttggggactactctaatcaggccagttactaaaaaaataaacaagcaaataacaataacaagtccaagtgggaggcagaataatcagtacttagagttgctaaaatatatcatctgaaacatcctgtttccaacaaaaacttataagccatgcaaagaaacagtaaagtgtgacccctcagaataataaaaaggcaggtaatacaaactgtctgtgagagaaatcagagattaaatataacagaaaaagacttcaaactagccatcatcaatacatctactgaactaaaggaaacataatgaaagaaacaaagaaaggtattaagataatgtttcattaaatagaggacatcaataaagagagaaattagaaaacaacaaaaaagaccatataaaacttctagagttgaaagctgcaatagctaaaataaaaagttcttttgagtggcttaagagaagactgcaactgatagaaggaagaaatatcaatgttacaaaaggtagtaaggcagacaaaagcagggcaggagagggtcccccaccaccagaaatgtcaggcaaccatcatgtgatggtcaggcagttattaaatctctctaagacaataattggtcacagctggcactagggaaaggcagtcttctaagagagagaaacatctgaaactggtgatcagcagcttcctgataagatctcagaagccgggcaagtgagcccaagcatgcacacaaagaggcaaaatggtggagtttaactggtatatgaccctctaggaacattccgattggtaagagaagaacgcctcaagtgagcattcatacaactccagtaaacacactgcacgcagacagcccacccaagggaagaatcaggggagaagtaatgcaagaccctagaaacatgccaacatatgaaaccccaagtcaaaatgtcgaaccatgcacttgatcactcaagtcatgcacttggccgtcttctatgcgtagttcacttctattcatgcctgctctaaaactttttaatgaactttcgcttctgctctaaaacttgccttggtctttcactctacactctaccttatgccccctcagtcgaattctttcttctgaggaggtaagaattaaggttgctacagacccatacaaattcaccacctataacaccaacattgaagacaaatagagattatggaatatgaatgtatgaatttatactcacattactataaggaactacctgagactgggtaacttataaagaaaaaagttttaattgcctcatggttctgcaggctgtacaggaagcatggctggggaagcctcaggaaactcataatcatggcagaaggggaagcaggcaatttcttcatggtagagcaggagagagagcgtgaaggtggaggggctacacacatttaaacaaccaaatctcgtgagaattctatgggatagcactaggaggatggtgctaaaccattaaaaaccacccccataatccagtcacctcccaccaggccccaccttcaacattagagattataattctacatgagatttgggtgggaacacagtgccaaatcatatcaatggagaataagaaaaaaaaagaatgaagaaaaataaacacagactcagataaatgcaggacaacatcaagcaaaccaacacgtatataaggggcatttctgaaggacaggagaagagttaatagtagaaaaaatattctaagaaataatggcagaaatcttttcaaatttatttaaaaagcaacagcctacatatccactatatttctgccatgcttcatgagcacatggctgcaggaacacaacaaattatttcatcctttagtaaagacataaaatatcataatacataacattttaattagattactaaatgtcagtttacaaattaggtttctatagaataagtgagcaaataaagggataactgcatggataaataagtagtaatgaccccctcattcaaacatgcttgcatatacttggcagtccagactaatttttcagacctgtcaaaagcaaaataaattactagatatcactgccttatcaaaggtaactgacatgggcaagattagaatagaaaaacagtgtgactaaaaccagccactgaaaattgaatacgctgacattaacacaattactatgtaaattggtgcttggaaatgacttatacatatatgctttataacatgtttgtcactacccaggtgccaagttgacattttattcttctattgagaatgggaagagacaaccttaaatgaaccaaaatagttttgcaagaaatcatgcagtgacaaaaggttgaaagaaaataatttgctatctttctaaacatgtcagatcctttatatcgattttttaaataattggtttgctaactataatattattagctattctgataattatttttaggagatctggatttcacagaatttaactacctgaactgtcatctatcagtaaagccatgttacaaggcttttagtagactagtaggcagtaaattaaccaattaataaattagtatggagtctaagttgctggcactgttatttataaaggtgtctaaaacaccatttttgctctagccatgaggtcagaaacaagttctagtattttgaattggtgtcctttccacacagaccctaataaaactgactgtaaatgagttgacactccatcactatttcagggaattcctttgattatttcaaaatggcacaaaatcataaccatttagactatgagccataaaggaatctcagaatataacttgctgcctgtttattatgattattactatatgttaactcatttaccattatatgagaaatgttccaaatgtcatattttacatgatgtgtgtgtgtatgtattcattttaatctgaaatatgttaacataattaaggaatccttaaaaatacactgtcacttcattcttcagattatattatcaggtaaagtacgttgaataatatgatagagtcagacgccaatgttacttgaacaaacttattaatgaatgttaagaatatatttgaagccaatcatgtaaagtatttattttctgatattactttaaaaggaaaaaagaaataaattcacttaattttgagggctctaagagtcatgactttaaatactaagcttaaattttcctttttgaaagggcagttttctataaacacatattttggaaaatttaatagttctcttagtaattgactgaaatagaccaaaaaattaagtcggaatataggagatttaaacaaaatcaccaataaacaggcttaatttatatttatttatatttattggctactatatttaataatggcataataaatattttttcaattgtacatagaatatttaccaaaatagaacatatgccagtacataaacaactctcaataaatttcagtggattgaagtaatagagtattttctttgaccaaacttctattaaattattaatcaaaaataatatacttataaatatgcaaatatttagaaattaaatagcatttataaaggactcatgaatcaaatataaaactatatagcttagaaaatatttcaaatagaatgataatgaatatacatcccaaagtttgttaatatgctttacatataaagtgctccttataggtaaatgtgtagatttaaatgtttaaatttgtaaagaaaatttcatttagtaaagtaagtacaaagaaggaaataaatcaatgactttgtcaaaaagaagaaaaaataataattcaaactgtaatactttgaacagattaattaaatttctaaattccaaaaagtatttctaagaaaaaaaaagagaacaacacattattatcaattatgaaacatagacatcattaaactttcaacaagcatttaaattataatgaaggaatattataaccatcatgccaatatatttgacacttagataaaatataaaattttatttaaataccaactgttgctgtcacaaaatgaagcagaaaattcaaatatctgtggaactataaaacattaaatttgtaattaaaagactaccaggcaggttctgatttctgggtaagatgaaagaaacacatgcttctctcattctcattgaactcaaatgtaaaatctaggcagagttgtggccccgctgattgaaaacactggaaaaaataaatagcaataggtggagaaggaaaagacatgagaattcaaagtagcagtgaaatgaggctgtgagcctgagttccttaaaataatgtttgacagttaaagcaaaacaacatttcctgtaattttcaatgtacctaaatatatgagacaactatcaatcacttaggggagtataaaataatctatatggtaatataatttcaatgatcaaagtgaaatggtaaaatactcattttaaatacactggaaaaatgaagtatatattctttatttcctagaacaatcactaaaatgttatgcaaagattaaaatcacaatggattcatagaaatggaatactaaaaaatatatataaatacccaaagaaagcagaaaaggggaactatttgggggaataaaaaaagaaaactaaaagaaaacactccactctacaatagcagagtttatattcttctcatgtgcactatgaaatatttatcgaaacagaccatatcataagttatgaaacaaatgttaatgagttgaaatcttacaaagtatatcactgatcatagaattaaactaaaaatcattaacagagggataacagaacaatctccaaaaacttagaaaccaacacatagtttaataattcatgcactgaaaaggaggtttcaaaggaaattagaaaatatttttaaatgaacaaaaataaagttatacataccaagttatctacgtatatatagcaattttaagttttataattctatgtttataaaaagagaaaaaaccctcaaatccataatttaaggtttcagtttaagaaagcagaaagagaagagcaaaataaattcaaataatatcttactggatttgtgaaattatctgtatttacttacagttctatcaactttcgcttcatatttttggaagctttgttatcgggtgcataaacattttggattgttatgtcctcttgaggaactggcctctttaacatgagataaacttttatatcctagtaatattctttgctttgaaattcattttattacctactaataaagtcaatttggcttttcaaagtagtgatagcatgacatatcttctgtacatttacttttgaacttatttgtgtctttatattaaaaataagtttattggaggaaggaggtggcgatctggcaatctctgcctttatgagtttgtttagactacttatagtcaatgtgattattgatatgttgtcttaaatttatcatattaatatagcttctctatttgtattatttagtctacttttttcctctggctttgccttcgtttggattaattttatatttctaatcattctatttcacttttttgaggagtaaagttgatataattctttttgtgttattttaagttgctttagggtagataaaatatgaaattatattgatctatctttaaacaatgttacctgactttatttatagtataagtatttacaacagtatacatccttgtctccagttctggcctttatgctattattgtgaaatattttgcttctatttatattataagcctaaaaatataatactatcatttttgctataagctaatcgattagattaatatttttaagtgaatagatactaataaaagttactttaataactaacaacataattatcttttctgttgcttttttatttttatatgacctaaaagtcattcaggagcaggttaatggccatgtaattgcatggttttgagaaatattttttagttttgatttttatatctattgtgctgtggtccaagagtgtgtttcatatgatttcagttcttttatatttgctaaggactgttttatgtctgattatgtggtcaattttagagtgtgtgccatgtgcagcttagaaaaatgtatattttgttgtttggggtggagagttctgtagaggtctatcaaatccatttaatccagtgttgagttcaggtcctgaatatcattgttaactttctgcctcagcgatctaatattgtcagtgtggtgttgaagtctcccagtgttattgtgtgagagtctaaacctcttggtaggtctctaacgacttgctttatgagtctgggtgctcctgtgttgagtgtatatatatttgggatacttggttgttgttgaattgaacccttcaccattatgtaatgaccttctgtgtctttttttgatatttgttggtttaaagtctgttttgtctaaaattcgcattgccacccatgttttttttccccattttattttcttaggagattttcctccatttctttattttgagcctatggatatcattgcatgtcagatgggtcttttgaagacagcatatcatctggcttgctttttttatacagcttgccattctctgctttttaaatgggggcccatttacattcaaggttaatattgatatgtgtcgatatgattctcattttttgttagcaatttattatgccagcttgtttgtgtgattgctttatagtgtcactggtctgtgtaatgatgtgtgtgtttttttattggctgctaacaatcttcccttttcatatttagtgctcttttcaggattttttataaggcaggtctggtggtaatgaactccctcagcatttgcttagctgaaaaatgatctcatttctctttcactgaggaagcttaatttggctggatatgaaattcttggttgaagatttttttttctttaagaatgttgaatatatgctcccaatctcttctttcttgtagagtttctgctgagaggtctgctgttaacctgatggggttccctttgtaagtgacctgcccttttgccctagctgccttcaacattttttctttcattttgcccttggaaaatgtgatgattatgtgtattgaggattttcttcttgtgtagaatcttgtagggcttctctgtatttcctgaatttgattgttggctcctctagtaagattctggaagttttcatgaacaacatcctgaaatatgttttccaagttatttgctttctccccttccctttcaaggaggccagtgattcctattttaggcctttttacataatctcacatttcttggaggttttgtttattcctttttatttttcttctttatcattgtctgactgtattatttcagggatccagtcttcaagttctgagattcattcctcagcctggtttattctgctgttaatactggctattgcattgagaaattctcgtagtgtgttttttcatactgggtgttctatctttcagctcctgtgtcatttcgttgtgattcttattttccttggattaagtttgccattctccagaatcttgatgatctttgttcctactcatattctgaattctgtttctgtcatttcagccaactcatcctggttaagaacccttggaaaactagtggagttgtttggagaacataaaacactctggccatttgagctgccagggttttgggttggttctttctcatctctgggtgggtgttcctttaactgctgggctgcctccgaagtggtcaagcaggggcagggtggttgtactggaatctcaggtcaggcagccctgcccagtgaggaccaggacctacatggagaacagtctgtccattttttcttgaggtgggtgctctgtgttggtggtccataccagcctctggaccctgtcgattctacagagcctggagacagcaaaggtgagggctgcaagacagcaaagatggcaacctgttcctcttactgggagctctgtcccagagagttgcagagctgctattggctaatagccccagcagggggtggctggagacctaggccaggaggacccacctagtgagaagatacaggatcagggaaccatgttacaaactgtctggacatttttccatagggctgctgccatatgctgggtgtccactctagtccctagtcaccttagattttccagcacctaaagatatcaacagtgaaggctgcaaaagagcaaagatggctgcctaccccttcttctgggtgttcatcccagaaaagtatgaacctgttgcttgcctgaaccactggcagggagattgtagacctcagtacagagatcccacccagtgaggaggaacaagatgtgtgacctgtgtgaaaaagcagtctggccacttctctgtagagctgctgcactgtgccaggaaactgctccagtccctagtcacctcagaccccctagagcccgaaggcaacaatggctaaggctgtgaagcagcaaagatggcaacccatctgtccccctgggaactccatctcagagaagctgggaaccactgaaaggtgggaaacactggcaagggtggctagtgaccccagccaggaggtcccacttactgaagagaaagcgaggtcagggatcccagtctggccacttttccacagggcagctacactgagggcaacaacagctaaggctgtgaaccagcaaagatggcagcctacccctccctcttgggagctgcatctcagggacgtataacactgctactggtggctggctggagttccaagccagtgagtcttatccttcaaggtgcagtggaaacaggatctgcagaccattactgctcaaccccgaggattcatccccttttctaggggtgtgtatgggagtgtaaactcctgttttgctggagttgcaaccgcttttgctgagaagcccagagctgggagcttccagggctccacctgtgcctgagcggccactaagccaagactccatgtagctctgggtgtcagactgcaggtcctggtggaggggattcatgaggggatctcctgacccatggtttgcaaagatccactggggaggtgtgggtccccggagctgctaactcacttatcacttccctgagctagggaggctcccctggctccatgttgctcctgagtgggcattcatcttgccttgtttgtctttgctttccgtgggttgaattctcttcttgatgaatcccaatgtgtgtacctggctatttcagctgaaggtgctgtatttacttgtgccctctttttctctccatgagagtagcccacactagcagcttctagtcagccatcttggccagctcccaacatcgttgttttatcgctcattttaacaacttaattttgataggaagtagtatagtttatttgtttttttgtgttaagcttcactgagcttttgaagctcagcgtttaccaatttcattaaatttggaaattttccatttcttcaaatgtgtcttgtctctcttcccttctctttggggcactttaagtacatatatattaggcctcttgaagttgaccccttgctgctgacttactgttagttttatgttcagactgtttcttttttgtttcattttgggtagttctatttccagatgttcaagtttactgaccttttattctgcagtatctgatcagccttaaattctaaccaacttattttcatctctaaaagttgcatttggatattttaaatatcttttatatatcttaaattcaatttttcattatcttcttgaacataaagaaaacagcactaataactttaatatctttgcctattaattatattatctatcatttcacttaattttttctcattgttagttcattttttgttcttttaatggttgatttttaaaactttattttattttactctcatcagaacacttaatatgtgtgtagatattacacacatattacaaaatgttcaacatcttgtaaaaaaaaaaaaaagtagtttttgttttgttttgtttttgagatggagtttcactctgtcacccaggctggagtgcagtggtgcgatctgggctcactgcaacctccacctcccaggttcaagcaattcttctgcctcaagagatctactcttagaagtaaatttttaagtatacaatacattattgttgattatgggtacaatatcatacaacagatctctagaacgtattgattttaactggctgaaactttaggctggttgattagtagcttcccagctcctgtccctctatccactggcaaccattctactcttttgttctatggatttgattattttaggtacctcatttaagataaatcatgcagtatttatttttctgagactggcttatttaacttggcataatattctcaagtttcatccatgttgctgcatgttgcagaattttcatctttttaaggcttagtagcattttatttatgtatataccacattttctttatccattcatccctcaacaaacatttgggtttcttccatactttagctgttgtgaatagtgctgtaataaatataagaatgctaatgtctctccaagattagttacttttgataaatccccaaaaaagagattgcaggatcatattttagtactattattaattttttaagaaatctctatactgtttttcatagtggctgcaccattttttattccccagactaaacagagtgtaagggttctaatttctacactcttgctgacacctctcttttgtttttttgataatgacctttctgacaggtgttaggtgaaatctcagtgtggttttcatttggattttactaattagaggtgttgagcaatttttaatatgccagttggccatttgtgtgtcttccttggatgaatgtttaagtaattatctcatattttaaaatctgtatattttatttttttaatatttactatttttaatttgtaaaaatttataggatataggagaaatcttgctacatatatataaggcataattatctagtcagagtgtttacagtgtccgtcacttgagtgcaatacatttttaagcataggcaccctactctgctatcaaacattgaatttatttcttctatcttactttatgtttttatcttttaacccagttcttttcatcatccctcctaaccctggctcccaactgaaccttcctagtccttgttatctactttacactctctatttccatccgatcaagtttttttttttacctcccacatataagcgagaacatgtgaaatttgtctaccttattttaattaagataatgaccttcagttttatctgtgttggtgcaaatgacatgattttatttttttctggctgaaaaatatttcattgtgtatatatactatattttcattgtccagtcatctgttcatgaacactttgcttgattcaatatatttgctattgtaaatagtgctacaataaacatgtgagtccaagtatctttttcatatgttgatttcttttccgttgggaagatacccagttgtggtattgttagatcaaatggtaattctatttttaattttttgagaaatcgtcatactgttttccatgctgactatactagtttacactcccaccaacagtgtacaaaagttggcttttctctacatgcttgccaaaatctgttatttattgtctttttaataatcaccattctaactggggtaagttgttacctcattgtggttttgagttgcatatctctgataattaatgatgatcagcctctttttatataccacttggtcatttgtaagtcttcatcttagaaatgtacactgatggccgggtgcagtggctcacacctgtaatcccagcactttgggaggccaagatgggtgtatcacctgaggttgggagttcgagaccagcctgaccaacatggagaaacctcctctctactgaaaatacaaaattagccaggcatggtggtgcatgcctgtaatcccagctactcgggaggctgaggcagaggaatcgcttgaacctgggagatggaggttgcagtgagccgagatcgtgcaattgcattccagcctaggcgacaaaagtgaaagtccatctcaaaagaaaaaaataaaaacaaaacaaaacaaaaaacgaaatgtacattgatgtcctttgcccacattttaatataattatttgtttttctttttgttgagttgagttccttttatattcttgatattagtctcctgttggatgaacagtctgcaaataatttctcccattaaacagttcttttaatttaacagcctctttttctgttaattgttttcatttaacagcctctttttctgttaattgttttcatttactttgctgtgtagaatatttgtggtttaatatagtccctcttgtctattcttggttttgtcacctgcgcttttgaggtcttagtcataaattgtttgcctagaccaacatccaagggagttttcccaatgttttcttctaatattttttatagtttgggagcttatgtttaagtctttaatatatcttgagtttatttttgtatgtggtgagagataggggtctagttttattcttctgcatgtggctacccaattttcccagcaccatttattgaatagggtgtccttttcccaatgtaagttcttgtcaactttgttgaaggtcagttggttgtaaatatgtgaccttatttctggattctctcttttgttccattggtctgtgtatctatttttataccaataccagtgctatttggtatgggttacgataccttggttactacactttactctactctactctactctactctactttggttactatagccttgtaatatattttgaactcaggtcatgtgatggcttcagctttgttctttttgcttaggactgctttggctatttgggctctcttttggttctattgaattttaggactgctttttctaattctgtgaaaaatggtgtcggcattttgatagggattgtgttgaatttgtaaattgctttggacaatatggtcattttaatgacatcaattcttctgacccataagtatagtatatttttccatttgttttatcttcagtttatttcatcagtgttttgtaattttgcttgtagagatttttcacatctttggtaaaatttattcttagcatcttttttacagctattgtaaataggattgccttctcgatttcttctttggtgtacagaagtgctactgatttttttacattaattttttatcctgaaactttactgaagtcgcttattagttctaggagctgtttggcaaagtctatagggttttctagacatgtaatcatgtcatcagagaagaaaaaaaatttgattttatcttttcatatttggttgcatttatttccttctcttgcctgattgctcaggataggacttccagtacatgttgaaaaggaatggtgagaatggccatccttgtctttttcctgttcttaagaggaatgcttctagcttttgcccattcagtaggatgtttggctgtgggtttgtggctcttattattttgaggtaagttttttcaatgcctagtttgttgaaggtttttattgtaaagagatgttgaattttatcaaaacctttttctttgtctattgatataatcatatgactttttttttttttttgagacagagtctcgctctgtcgcccaggctggagtgcagtggcacgatctctgcccactgcaagctccgcctcccaggttcacaccatacaggcacccgccaccacgcccagctaattttttgtatttttagtagagacgggtttcaccgtgttagccaggagggtctccatctcctgaccttgtgatctacccaccaatcatatgacttttgtgtttaattctgtttacgtgttgaatcaggtttattgatttgcatatgttgtactcacattgcatcccaggaataaggcctaactgatcgtggtgaattaactttttgatgtactgctgaatttagtttgccagcattttgttgagaatctttgcatctatgttcaccaggaatattagcctgtagttgtctttattcattgtgtctttgccagatttaggtatcaaggtgatgctagctcgctttgtagaatgagttagggagaggtccctcttcctcaattttttggaatagttttagtagaattggtaccagctcttctttgcacatctggtagaatttggctgtgaattcttctggtccagggcttttttggttgacaggttttttattgctgaattcaaatttggaacttgatattggtcctttcaggatttcaatttcttcctgattcaatctggggagcttgtatgtttccatggatttatccatttcctctaggttttccagtttgtgtgtatagatgtggtcgtattagtctctgaggatcttttgtatttctgttagatcagttgtagggtcatctttgttgtatctaattgtgcttatttgaacctctgttttttctttattaataaagctaatggtctattgatcttgtttatcctttcaaataatcaacttttggttttgcgatcctttgtataaatttctgagtctcaattttattcacttccactctgattttagttatttattttcttccacttgcttcacggttattttgtttttgttttgttttctagttcctctatgtgtgatgttacactgttaatttgagaccattctaacttcttgacataagcctttagtgctatgaactttcgtcttaacactgattttgctgcatttcaggatattggtttattatgtctctattttttatttcaaagaattttgtttatttatatcttaatttatttgtttacccaaaaggagcaagttgtttaatttctatgtagttaggtgtttttgagaactcttcttggtatagttttgttttgtttttttttttttttgactgagtctcactctgttgcccaggctggagtgcagtgactccatctcggctcactgcaacctttacctgccaggttcaaggctattctcctgcctcagcctcctgactagctgggattacaggcacatgccaccatgcccagctaatttttttttttttttttaagtagagaccgggtttcaccatgttggtcaggctggtctcaaactcctgacctcaggatccgcccacctcggcctcccaaagtgctgggattacagacatgagccaccatgccagcctagatttctatttttattcctgtggtccaaaggtatggttggtatggctttgatttttttgaatttactgagaattgcttcatggcaatgcatgtggccagtcttggaatatgttctgcatgcagacgagaaaaatgtgtattctgtggttgattggtggagtactctggggatgtatatcaagtacagtttatcaagtgttaatttaagttcagaatttctttgttagttttctgccttatagatgtctttaatgctgtcagtgaggtgttgcagcacccctccaccccgtccattattgtatgactgtgtctttttgtaggagtagatatgtgttttataaatgtttgtgctccaacattggtacgcgtatatttagaatagttaagtattattgttgaattgaagtctttatcattatgcaatgccctatcatcattatataatgtccttctttttcccttttttgctgtcattggtttaaagtctgttttatctgatacaggaatagtgacccctgctcttttttgttttccatttgtgtaatagatctttctccaacctttcactttaagcttatgggtatccttacatttaagatggttctcttgaagacagctgctggacgggtcatttttttttttaatccagcttggcaccctgtaccttttaagtaggaccatgtaccttcaaggttacaccatgtacattcaaggttaatgatgatatgtgaggttttaattctattgtgaagttaactggttgctttgtagtttctactgtgtagttgcttcatagaatctatgggctacgtacttaagtgtgtgtttgtggtagcaggtgtaattattttgtttctatgttaagaactcctatatggatcttttataaggttggtctattggcaataagttccctttgtgattatatgtctggaaaatgtttctcttttgcttaaaaagcttagtttagtggtacattaattttttttttaagagtgctggctataggcctcaatctcttctgacttacaaggtttctactgggaagttgctgttaacctgacttttcttgttgttgctgttgaggatctgaccttttactctacccgtctttaaggttttttgtttttttttttctagtgttgaccttgatcagtctggtgattatatgcctggtgatgtttattttgtatagtatcatacaagtgatctctggattcttgcatctggatacctatttctctagcaaaattagagaattatttttgcattattatctcaaatatactttccaagttgtttactttttcttcttctctctcaggaatgccagtgattcataggtttgattgctttacataatcccatgtttctcgaagacttaattcattttctaatttaaaaaaaaaagatttttgcttgactaggttagtttgaaaacctgatctttgagctctaaaattcttttactgtttggcgtaggctactgatgaaagtcttcaactgtattttgaaatacactaagtgaattttttaattctagaagctctggttatttttttaagatgttaatctcttccttcatttattggctttctttggaagtttatttgtgttgattttcaaccttgtcttgaatatcattcatcttccttgcaatccaattctttatctgccattttggggtttctattttggttagggaatattgctagagagtgagcgtgatcctttcatgctgtcacaatgttcagatttttttttttctggtgcccaaaattctaatgctggctccttttcatctggagatcctggcacttctaatttgtgtaattatttttgtgtgaatcggattttttttctctctttccctataatgttgatttctgttctttccctctacccccttcctggggggtatgactgtagagaatgttggatagggtcttttggctttgtttcttcacccaacttctgttgggtggttttatattgggccatgcagttcaagctccgggccagtagatatcacttctgggtaaaagccagctgtggccaatgtggctgggtacatatatttgaaccttgtttactgcgagatattgcctgagacaatggactgattcttggaatacataatggcctgagctccttgctcagctgtaggggtgagccaagatggacaggggcaagccaggcaggtctgcctaaaggttacctgaagggagaattgagggcgcagccaccaagcaccaagaaatgtgcctacgactggcgctgggaaacctcttgagtggtaacttctctgcccagggagggagggcagcctaaactcctaatccaggagagtggatgttttataagcttggagatctgtccaggcatggaggggagagggcctcacttcacatggtctctccacagaaatggtggacactcaggctgttgatatgggtgagtgagtgctctgaatgcctggagatctgcctgggcataaaacagagagtgctttgctgcactgtggtctctgcgtaagaacgatgggacagatcagactgttaatccaggtgagcatgttctctgaatgtctggagatatgcctgggcatggagtagagaggacccctctgtaccttcatctcaggggagcaggctggggcacccagcaaacacacacacacaccacacacacacacacacacacacacacacacacacacacacacacacacacacacacagagtttccaggtcaccaagttggtttcttctcacccaggagaaatcatggctacagtagttcttctcttgccctagacctgtggcaaggggagggtacaattccagtgcctactcctggggcactttctacatttcctgctcaattctggctctggaggctcctaccaaactccagagcaagcactccaatcgctggcctgagactaaaatacctgtgtagtcacactgttgggttgccgaagagtgactgactctgtatgctcctggattaaaaatggcatcctgctttcaactccagtcggggaaaatgctgcaacttttcccaatgtctttccctctgagtttctccaagcctctccccaagttagctccaaagctgggagaaacaaagggctctcccttggcctggacaaatccccagtggaaaggtgagtcacaaaggaaaactctctgcccctctcatgtattgagacttgactcacttttgacagccagatgctgacacgggggctgtttgcacatggtcttctttttgggatctggggtgtccttcacaattccagtagattcccatttttcttcttgaattaaagttcacagcattgatctttatgcactgttttgctgtttctctgtggctgaggccatcttgaaacaacaacaaaactttcttttttatattgaattgttctagctaggattgataatcctatgttgaataggagtctcaaaattaagtatctttgtcttgttcctgatcttagaggaaaagctttcaatttttcataattgcatataatattagctgtgggctttttatatatggcatgtattaagttgaattaattttcttttatttctagtttgtgagagtctttaacttaaaaatgtgtctatttcgtcaaatactttctctgcatctattgagatgatcatgtggttttatgattttattttgttaatatagtgcatcacattcattaattttcatatattgaaccacccttgcatcccagggataagtccagcttgattatggtgtatgatcattttaatgttctgttgaagttagtttgctggtattttactcaggattcttgcatctatgttcatcagagatattggcctatagtttttctttcttgtggtgtctttgcccatctttgacatcagggtagcgctggcctcataaaatgagttttgaagtgtatggttgtcaatttttatttggtatcagacattgtgattttaccttcaaaggtgaaaaatattttgtattactataaatattattgagctttgttacataatgaatttaagttatgtgaaaacagtttgatactataagatcttgcttttaagctaagttggatcagagctatatttaggctagggataatttgccaccctgctgagataaaacccgtctaactctttccatactccacctaattctccataagcattagtttttaccctatatgaatgataggtattgtttcctctaatccattcttgggttttattctccagataagggttgttcctttgtatgcttgcactgatcagcgcttagctgaagatgtgaggaggactctgcagatcccctgagttctgtgtacagctcattcctttagagtgctctatcttgcaaactctagccaccttggtcgcctggactcttggctccattttcttatcttagggagatcatttggatctgcctgtgtttctcttaaattcaccatgccctggaatctcaggctagagtgtaagcaggggaaattgtatcctgtttctgaaagccactattgtttgttgcttgatattcaatgccttgaaaataattgtttcatattcaaaaatgtagttgtcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaatgtagttgtttagttggtaatatggtttggctctatgtccccacccaaatctcatcttgtagctcccataattcccacgtgttgtggggagggacctggttggagatgatggaatcatgggggtgggtctttcttgtgctgttctggtgatagtgaatgggtatcacgagatctaatggtgtgaaaaacaggagtttctctgcacaggctctccttttgcctgctgccatccatgtaagatattgacttgctcctccttccctccctccatgattgtgaagcttccccaaccatacggaacagtaagtccaattaaacctctttcttttataaattgcctagtctcgggtatgtctttatcagcaccatgaaaacagactaatacagttgaatcaagtagaaaggtaaatatggtccttattagtacatttgactaaaaggaaatctcaaatataattttacctagacataatatttgatagaaatagcaaaaatctgtattattatttaaatatgcaaaaccaatataggaatattgtgcatagtggacactatttctacttattttagccacctgataatataatattagtggctgttagagcctctattcacatgacagttcatcataaattttttgtgatgggtattttgtcacacattttattgaacggtttatctacaaaaatatttatggaggatagagcatacatctcacaaaaacgtttgagctaatcaagtaattgcctacccctccttaaaatattatagtatttatataatttaattaatttaattagtataaagatgccttaaagggccaatgatagaatgacatttccaaaagattatgtaatcaaaagtgaagaatgctggattcttattcgttgctcgtgttacctcctgtgtaggctataattactgaattttcagaaaagctataaacttcttagttcaggaacagtgcctcatcattgtatcacttttttacccagtacaatgcctttccaattagattgtaaaataatttatgtttaactctctaaaactctgtctcaattctcaattaaatggggggcttaactggatgatttcttaaatgtggttgcagctctaatatcctctgttgtcatgcttctatggatgtgggactgtaaatattctgtttttcatctgtgaagaaattgaatctctttcatttttccattaaattttgtccaacaagtaaaatgttcttttcttgttttgttctaaagaaggcagaagactaaaatgattgatttcgctagtgtcatttgccaaatgtttctgactctattccttctgtacaatatgagactgcacattctaggcccctgggctgcatgactagttctgaccaatgagctgtaagcagacagcaatgtgccattttagggatacatcatctaattactagcttgatacccatcagtgttctcatttatatctaccacaatgattgacagtgatcaagatgttggctatttctgctaagcacagtgagcagagaccctccttccaactagtgttgaacaggtaaaggaagcaaaaaagggaatagttattattttaagtcattgaaatttgggggtggtcattaccaccatataacctcctgactattgttataagtaaaacaaaaaacaaacaaacaaaacaaaacaaaaaataaagccatactttgaataagctaacagaatgatctaaagattgaaatattcaaacattttactcaaaagctgcaatcccagagttagaactttttaaatgtgagttgtaacaccctttccaaaacaaaatacacaacaataggcagcgagaagtaatgtttaagtgatggtgaagaatacatgaaagttttaagatctccaaatgaaaattaacctaaatgcctgtaatataaacattgacattgttgcatatgtactaaagtatctcttttagacaaaaataagtcactgataagtctggtacttatttcaagtatttgtaattaaaatttattttgtggccttttttattgttgaaaaaaccacttattttaataaaatcaatgaaataaaaaagataaattagtgtaaccatgaaaagaataaatgttaagtatgtgttaaacaatactgttgaactgtattttaaaaatctctcagtttagcaaatgccaatataaaaaatcagaaaacgtttatgtattctgttttggaaaaacagaagaatatgagaaaatttgccattgaagtttcattactgtgaaagacttagcagaatgtttacaaaataatttggattttttttttggatttttaaatgccttcacgacttgtcatttctctcaagtaaatttttaaataatttaaactatttcttttgtcttcttggtgcttttaaaatttgaagaattagtttttatccatttatataaactgttactcaacaaagagatgtccttacctctgagccattcctaaactgcaaggtaattttatgcaaatgcttatctgaaaataatacagcaataagaaatgcagtaattacacccatattcctagaaacctatttcaacacgttttagtttgtccctattttcttattctatttgtgaatttgctgtgcatttgtaaccataaaaagcatacaaattgtgtttgactttattttacttattaaagtcagttccatattggtacatcatcttcatatttgtaaacttttattctcaacctgacttgacattaaacctaaaatatgcaggtgcagagcctaaataaagccctggatgtgcttcactatttctagtaatactatagggcagtcatctggatcacaacttcttgaatccaatgcctgagcttggcagtgattcaatttttctttggagcagctcaagtgctagaatgaccgaataaaattcaatcagattaagtgcttttacaaaggagctggctttccttagagtgaaaatcagatctgcaccctcattattttttgctagaattattacaagggctaatctttctgcttctactctttgccatctgcaacacattgtctgccctgctgccagaggaatatgtaaacacgatccggtcttgtgattaacaatatttgaagtacttcatgttgactgcaggctaacatccaaattccttagaatcattttcaagattcttcatgatctgttctcaatgtacagactcattgataaagacgtccttaattctatcagacaaagttagtcacacttccttcaggctctcaatgtctgtgtgccatctattatgtcacttgtcttgtttgagtctaatcattttatatatctgctcactggtctgtgaacccttaagggaagagactgaaatgtattcatctttgtatcctaaatgtctctcactgtctcttctgcagttcctgtctttcctagttccacgtcttcttccacagaggatttgacaatgaaataatacagtgtaaacaacaatgaccgtaataatgacagtatttattaaacccctgctattattagatatgatgctatatgaagtacgttacatagatgtcccaattaattctccttagcacattatgaagaggtattgtttttttttttttttgctcccacattatcctctgtgagaaaattaatcttatagagggtaaataacttgcccattgtcacacaggcagtaaatggcaaagctatcatttgaacctagtctgatctataaagtgtggtgtgactttccaatatttgatacataatcatcaggcatgaaatagtaaggagtttataatgtagtctaattgaaaaataagttacagatatcaatgtaaaaaggcaatgttactactaataatcaactaattaggatgagaccatttttatgtatccactgtaatgtcttgatagttgtgtttcataggcctagagatgtctctgagtagagcaccagtaataattcaaaagctgaaagaagtaatgaaatgcatgtgtgataatcgttttttaaaaacttatttaaaagtatttccaagtataacaaactgcagccttcctaactgaacataaataagagtgttgcctatttgaccagcacattgatcaaagtgaatcttgaccagggtattgatttaagagactgttccaaagagactataccaaatgaggtataacttatttgcctatgtctaagtttaggttcctctagaagcaaaccctgaaacaaaaatttgactataatagtgtttaggaggtaatcacagaatgtagagtggtgcggttcagggaatgtgagaaaggaagacagaaaagggaaagtagccagtaaaagatgcattgtcaaactgctgatcactgtgggcaaccgaggtgtaatcctgctaggaaactatgggagacaatatggaacatacctcagggttatcccaccatacgactatttattctctaacttccattatttgttggttgatacttgttctaggggaattaatttttcccagaacttctgatctgccctttgtgcagagatgagagaaagtactcactttgctatctgcagagatgtataataggaccctcttggcttatactggaatggtgagtgctaaggagacattgatgtgccagcatcatctgctagagcttatctctcatgagcctgttcctccagcaaaatagatttttaccttgagctacacacccacatatatatagatagacatataaattgacagatagatgtgtatatgatatatgaaagctacgttccaactggatgtcgttttgacgtctcaacagtacatggtcaaaattgaattcattatcgttgctctcattatttgaaaccttcaatatgtccctcacacaggctcctatgtcattctgtatttcatctgatcagttgcccatgtccaaaacgtaagagtcctctttagtcacttctcctagttaccaagtcgtgtgaattctctttctacatagatcttgaacctgtcctctgcaggccaccttcaattctcacttgaatttctacaacattttccaaattggcttatgggcctctctcaaataatcttatagcactctattaatcttctacactatccatttcattttaaaattgtaactatttgtctttctgtatctctcattataatataaatgtcttgaagttcagaactagattttgttcattgttttatctcaactttggagcctggcctatatcaaaccttcagtaaattactgtgacatgagtgaatgaatgaatgaatagaatggatccttttatatttcatgtgtactagtaatttgatagtaatttgagctcaggcacatagaaattattgaaaacatttcaaaagagaaagcctttgtcacacatgattggtcttgcattcttttttgtctaccctttctctgattggattgtatatgactctgaaaagtcatgagcctattgatttttttcttttcttttgttttctttctttttttttttttttttttgagacagtctcactctgtcacccaggctggactgtgcagtggtgcaatctcatctcactgcaatctctgcctcctgggttcaagcgattcttttgcctcagccagctgagtagctaggatgacaggcgtgtgccaccatacctggctaatatttgtatttttggtagagatggggttttgctatgttgcccaggctgatcttgaactccaggactcaagtgatcctcccaccttggcctcccaaagtgccgggattgcagccatgagccactgtgcctggcccctattgatgggttataggatattactctgaatgcaattcctctttaattaatagacaagtaatatgtacaatagcttgtcctaatgtttaaaaaacaattggcttcattggggatatcaccttcattctaagaacactgtgaagtgtaatggttctcacaagtaggtgcaacattctgaatattgatgtatcaaagcacaattagttgggctctttgactttgttcagaagaatcaatggctctgcataattatgaccaggtatgctgaatttcattaacactattttccagatctgtgaattataagcaaaacatctatcttactacactcccatggaaattactgacaaatctttgtcatattatatatattttttgacatttatcctaaaatgaatttcatgtttttacacatttttgtgcccatatcattataattttgatgggttttcagacacttttcattgtctgaatatgtcaaaatttacttgtttaatgaatattgttaaaaataataaattattaggttaaataatgaataaaggaatacaattttaaaaatacttctttttcatcttctcagatggttccaacaatgaaaaaaatgaacttgagatttctttttagagttttcactgggactatgataacatcttgatttggatcttaatttaatcttattatgtggttgtgctcagttaacagttattttaaattgaattttaatttattctgtttagaagctacagttgtttttcccttcaggctttaaatactgtccagccattgaaacactccatgactaaaactgactaattaaacataaatattacagaagttaaatttttagatatcttcaggaagtccatctaaaccttaattatgtgctccatggaaacagttttaatgcatattactcatccttatttctattatataacaacaggaaaaatgtacatcaacaagagcacaacatttcaaaaactgacaaatttgaaaccctgataccagaggataaaacagttgtttcattaagagtgagtgtgaaaggagatcattaatgcattccgtgaaggagcaggataacaatcatgctgtacaaactctggttggaaagtattagactaagtcgtgtttccacagttgtctgataacataatgaataaacaacagaataagatatacaagagttttgtatttgacacaccattttcttttccctcatctccagctgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagaggtaagatacagttgataacattttatctgattctgctaccattcacataatcattaaggactttttaaaaaagacaatgggagcttctttctgattccatctgaaaggtgattatgaagttttatctatgttgtgatttcgtaaaatattcaccaaatgcaaaagaaacttaatgagaagctataggtttcatttgggaatctgtaagaaatttgcattacaatctctgttgcaaattaggtgttggcaaaatgcctcaaattctactttcagcttcaggaccaacactgtaaaatatattattgtaagtacatatgaatggtaaaatatttgagttagaactataaaatttgttcctatttctgaaaagtatctactctattatttaccagtatgacacatactccaggctgtgcttgtgttacttcataaatattagaaactataagggacacaggtacatatttttacttggtaattctagctattttatctatctgaacaataacagaaacaatctagtgtaatagtatcttacaaaatttagcataagttttaatacttttataattttatatttaccttataaaaattttataattttgtaatttactttctattgtatgaatatactataaagtgcattttataatttaccttatattttattgcacgaaggagctacacttaactgtatatctgttagaaagaatgacagtaaaatattttgattgaatattattcttatgtctcaaaagagaatacaacttgagatcacatgggttaatgaagttttggaagttttaattgaagttaatttgaagttttggaaatgttatttgtcacagaaacatctttttttcatagtattcaaaaattctgcaaaagatagactgcttggtgtgctaattgtgaagtttctttgacagaggtagtcagttaaaatactggtctttatacacttcttttaaatactgattcagaggttgcctagtatctatatatactgggacttacatgacagaaaggaggttgtttgacactacactattaatatggcggagattgcagtgagctgagatcgcaccactgaactccagcctgggtgacagagcgagacttcgtctcaaattaaaaaaaaatatatatatatatattttttttaaactatcaacctggtcattttaggtttgattttaaagaggtttttgtctcgtgttgcataggtaggcatgcatttaatactacctaataagagccactgtctaaaactgaaatttgcagatttttgaaaaacaatgtaaatggcatattcacttttttattctaattgaggttactatttcaaagcagtcatcattattacctcaggctaaagataggtacttaatgtgttaataaaacgttgacttcaaaaagtgaaaaaggtgataaagatctgaggctgcagattgccaagtgaatagtctttgtgattgactggtactaggagaaataggccagtgtaacttttgattatcttggtaaactatttattatagtagaattttgaactggtgggtaatagagtgagaaacacttggtagcagaaaattatggtttgtagaacatttcttgttaaatatttctcagaggtatttttcagttgaaagcctttgaaaaggttgaaaatactggcacctacattttcttggttccaaatcactgtcacctttggtacagtagcaactttggtggactatgtttctgtatgtcatgttagatgggaagaaagtagactgtcaatgtaattagtgttagtgaaaggggataacagaaaatggataatttaggaacagtaatggtgatttttgaatttcctaatggacatttctaaggataatcattactttaacgcttaggtaaaactttcattgagatattctattcttatgagcaatcaaattgaaagtataattttataatcaaatgcaaaagtaaattttgaaagaaataggtgataaaatgcttctataatcttttataatacatcataatttttaaattatataaactaggaaagactctttttccaaatttttgctttggattatgaaaatctcatctgagagtattggttgatgtacattagcacttgagtggacttaggagcatcactcctcctttctgaattatgagaactataaataattaatgtaatgaacacaggtcagaatcccaacatcaactattaagtgtacgacatttggtaaattaactttctctgagtgtctctgtttatcaaaatgagaatgatagtgactcttcatggagaggttatgatggagggccgccatggatgtttcagtgaattgtgtgctcatgggagagcgattgctctcagctattgatttctactcaccaaatactctactactactatagtataaatgtctatactttctggagaagagattctcttaatttaatcaaatgtgatccacaataatctgtctatctatctatctatctatctatctatctatctatctatctatctacctctttactgatttatttatctccagaatcaacagaagaattcatttagtggccatttaaggagttatcatggtaatttatatttggagaaattaggactgccttaacatttaaaacatctccaatatggccaataagctactataagcattgaagtaaaataaaattctgagaatttaatcaataaggagattatgttatctatctaaattatatgcatggccttagaagagtgtttagcagaatccttttcaagattgtttttactattagaagaaaaggaagatacccctagacatcacttgtttacagggcctctaagagagaaaaactttttctactcctttttattctgatgcatctgtagctgtgctgttaaaagctataattaacttatacttttcttagaaaattccccaaagctacaaccctatagtgtgtagagttcttttcaccaactctttaaaaatcagattaagtaggatagataaatttgaaaatacaggaagatataggaattctgttggattcctttaggaagtttttttgtttgttttacactttaaatttacttttagaaatacatcccaatttcatttctgttcagtatttgcactatttaccacctttgcactattaactttttcagatactctacaagatcctttggccaaaagcactaaactttaacaagacttaatcaaatattactcccttatattttacatcctccaggtcaatagaacagctatacatgaacaaaaatacaagaaagccaatattttagacatgtcattagcatgagccacttgctgattacttagaatgcatatttacaacaaatataagtatatagtaattgttaaattctgtaatagtgggtttcatatcaataaagtaaaatactaaaatattagataatcacagaataatgctaactattaccaagtgatttagaaaaatctgcttaaataagattgacctagttctcaaaatgctttaaaaaaagtgcatattccatcttgcagttctcagtttagacattttcctaaagcaagcttggtaacagaatgtcattttagcctcagaacataagtccaccatctataaaacatgaaggtaaaggcctgcaggtaagttttcaacaaccaccactgtgttttgctatctgaagcttaccaaagttagtgaatgtggctattttctttttttccagtaagctctgagaaatacatttaacaacttaacttgaggcctataacaaggcttcatggtgactttaaagcaggactaatcctgggcttatctccaaattccaggcaaccttaacggcatccacatggaaaatgttgaaatgtgtgaaatgggctggggcttaacctcagagatagggtatatttgaacttgacagttccctgaactttgcatgcttagatgaatgcaagtctaaattgaggatagtcgcaggagagttgctgacacactttccttaatgcaagtatggaggcactgctgtatacccgagtatgcacacacaaacagaggcacacaggcgcacactcactcatttctgctcctgcttgtttcaaagttcctggacagaaaagggaagtagttgaatatttgagtttcagaaagatctgttattctccatgtactatttagaaggaaaaacagacttgaaactatcctcccaatgccaacaactttcaagaaatccagcttacttttgcttagacagcccgcactcctactatccaaattgtggtgcatggaccagcagcagcagcttgaagcttgctagaaatgcagactctcagtcctcaccagatgaatcagaatctgcatttcaacaggatctatgtgtactttctataggaattaaagtttcaaaatcactgtcatgcattttaaaattggggttgaatggccaggcacagtggctcacacctgtaatcccagcactttgggaggctgagacaggataattgcttgaacctggaagatggaggttgcagtgagccaagatcgtgccactgcactctagcctgggtgtcagagcaaaactctgtcccaaaagttgaagcttcagtgaataatatgggtgcaataagtaacttcaaaaatctcctgtttcttacatgttattacaaaataaattttgctgtttgtttatactatttagtgtgcaattaatattggatttataagtttgtaaaggacatcgacaatattttatgtaacgttaattgttatatttccttggtagatatcgccattttccaaaaattgtagacatttgccttgctttcttgtgaactcattttatagcatttgatgtttaattccaatttactgtcatacctcatccccttgccaattttccctttttgttaaacaaataatgtctttcaaaactttataaatctattttgctttggaatcagccaatagattttatgccaagttcacaaggaaaaaatattatatatatatatgtgtatatacaatatgtatgtatacatacatatgtatgtggaaatagcaaagcaattcctataatgatccacattaccattaaaaaatcctagacccttcacagggctgaaagtgtttttaaatctttaaaatagcagagatatttttaatgatttcacaaatgatgatgtcaagtcttgaattcaatttctattttacacaaatagtctccaagtatacattaaggaaagtttccataagcagacaaatcaatcagcacaagttttacaactattcgaagttggaagatatcagtgtgaaaaaggttgtaaaaccgaagaagaatggtagtgcctttttattttatattatacaatactaacactaaagtgcatttaaagattctgagacgacagtcgacaaaaatgttttagtgctggtattccatcaggtacttcactagattataagacaagcaatttttatgtctcagatttattgagagctagtcactctaaataaatcttggagttatttagatttaatattcgtatttaaaatggtgaggataattgcgtttaaaaaaatcaaactacaatatcaaaccaaatactgtttagtagcaggaactaagcaaatgttaaaaatataacagtatatttagaaattcaagattatatgccaaagaatggaaaggagctattctgctttctgatatttgtatatcgtgttgcataaaagttaaatgtgcagattgtcctaatggctctgttaacaaattgctttaacatttgtgaatgtaagggaatctgggacattgagcgacattgctctctgtggtcagatgtatgaacataccacagtaatgtgcaatcaatgtcaggaaaattatcctacaacataaaggggtaaaagtttgggaagttacaaaataaaaactcaactcataaaaagtctttgtgcattcgtaaaagatggatattacccaccagtagcagaatatgcttggagtagaatctgtctcagaagaaaagcacttttgagatttctctccctcttacttgtaaattaaaaattcagtctcactggatgttaatgtcttcagaaacaacagaatttatctgacaaaaataatgatagttatatatccttattgagtctcacctttgccttcatgtttatggtagctttgtattgtctcctttttctcctgaagtgcgaatgtgaataatctctcaagtgttcaggaatgctacacacattcacaagcctcatgcttactactacaatactttatttattctagtagaaatctgttttaagcaggtgctcattttgtaaattaagaaaaaggattttgagatactatagaaatatatattttttcttaataaattgcattatggattagcttttataatgagggcattggtagtcagaacattgcaaaaagttattatggagataatatcttctgtcttctaaagaaagtaataatatatctcagttaaaattattttcagtttaattattttaggattcacatttaatttacaaagatatatttgctgaaccatgcaaatagacattttttatgtagctagctttaacaaaaaagaactgttagaagtgttctaatgtacgttgtttgagagaatggcattacgatgaaatacatgcaggctaatttgaacatgcatataagaattttggaaaatatgtgataaaatgaagtgatggaatggaaaggcacaacctaagtttcaatgtctaccctatattaggttgtatcttagttatcacatgtagtattacagcaaattccacagtagaaaaaaatcttatgcttgctttcttttcttttattgtaaaaggtatgatgagtactaaatgaatgaaataagcaaaacatactattactcgattgtctttaaaatgtctatattgaaaagttttctgacttagttaatttggggcttctaaatgtttacatttgtcctatgagtagcttttacattttttaagcatttcattttgaagagatgattaatctcatttagttgtcatttttctaactcacatttcacttttttgcagttttgctctcttctcaaacattagtttgtagtatatgaaattccattttttgtaggacattaatggttgactttgacagttttcatatatttcaatgtttacgaccaagcatcttaaaatctacctacctctggatggaaagtctatcctgggctcatgttttaaactaatacttttaaaggtagagaaaagcatcaggtgttggataagctgctctgactttccaactgctttttgtgtaggaaaattccacatggctgaattaatatgggtttggcatagaaggagacactgcttttagaagcaaaactgttacagctcaccaacgtcacaaaggcatgacttcctcaagaaaaataaattgtgcaattcatttcatggcagattaaatcccatttatttttctttcagacagctgttttgaatagaatgtcaccagtgtgaaaccattttatgcatgttgggcttcagatcttgggcaggcataactttctttgatgaaataaaaggttatgttttatgactattcctcttgtcagcaaacctcagcatgtgagctttaataatgcaatgttcagtatttcaagcagctctttttgatgtctaaatatccatctgctcttaatttaaaaaaaatcattgcatctacacaatggaaaaaagaaaacttcacaaacattttctcttttatcctgaattataacacttactcaataaaataaaaatatcaatctctcagcattcaagatttttcttaagctgacaagttttgaacatcaaattcatccatgtttatgaaatgtgttttaacaaaattctcccctaataagaattaaatgttttatgtcaactgaggaataaattcatattagaataataggatctttgagatgagggatttgtaggtgacatggtacatttgtaatatttataaatgagtaaacagcaactgataaagatgaagtcctaagtcacacagtgggtcaattttatatgctttgataaatgctagtttaatttaaaatgtacagttttcacagttaggtatccaaggttcctttctttgtagttttctcagatgttttattctgagaaactgaaacaattctgataactatcattaatttaataaaatgtaccacaattatatagacattctagataattgaatctaatttattacccatttttccttaggatcacaacaataacagaaaccatcatttcactatgtgtatacccaagtattgaaatagaggattcatgagaatcataatgactttagcacaccaattccagtctccataatggccttccaggactgcagggggccaatcagcgccttcctcctggagaaaacagtgattctaaagtttggaaaggctctcaaaagtagtaaaataggtcataaaacagagttaaatatgttttatatagcttcacagactgatgtgccgtagaatttattgaggtacttaaatggattttgggctggccccttgtgggacatctgattctgtctttatcctggaaaaagtgttaggcagcctagcaaggctgctttcctttacccaaaccaaggcacatttgagatttcacagggccatgctggtgcgaatgtctccagaagataagggtcattctagaagagagagaggctggattaagggtagaggaggcatgggaagttactgggcaaatgtccagcattggattagagactaattaaatacacatcctttattttctcatcttttttctgcctggcctctcaaaacgtagattgggaagactatatggagaatatatgtatatatatatagatatatacacacacacacacacacacacacacacacacacggaattcatatatatatgatgctttgtaaacttgtggccatctcacaacacaaaaaaacctgactgcaatattgtagttctgtaaagaactgcttaatgctagcaactgagaggctagtggagcaatgacgaaagaaaatttaattttatatcctgaataaactctagctctatcacttgacagcttcgacttttacatataatacttctgcaaaattattaagtccatatccaacttagtggagacacattttgagtttgaaataaaatttaagcaattctttttttgattgggtccatgttttcgtctggttttgccaagttgaaactctgcttcttagaaaataaatgaaagtctctatgaaaaaaagattttccttttatttgtccatttatctgtctatttatttattttacaatactgagtattataaaaccatagactcatgagataagtagaaatatagtgagtggttaagagcctcagcattggagacagagagtcttgaattcaagttccagctctgccacttacagcccttgaggccttgcaaagaactggatatgaagctggattacagaaaccaggtatgatttcactattaagaaaaatatttcaagaaaaggtatcaccaaactagaaagggtaggaaaaataagtcccccaatatagagaaaagacagcaggttactcattactgctttgcgtaagttcatgcttgaagggctaaaccaagttggtccaacccatggcctgcaggccgcgtgcggcccaggctggctttgaatatgacccaacacaaattcgtagagtttcttaaaacattatgagatttttttttgcaatttttgttttgttttgtttttaactcatcagctattattagtgttagtgtattttatgtgtggcccaagacaatttttcttccagtgtggcccagggaagccaaaagattggatgctccttgtctgaaccattgcaacatactcaaagaaaatgcaaaatttaccttttaaccatgaataataatagtcatgtaattgtgatgagggaaataactgcccaagactgcggtcagaagaataatttctatacatagaaaaaggcaaattttaggttccaaacttcagtgtgcttgtttttgacctttggaaaaaattctaaaataatgatggctattaaaaagtcaaaaaaaaaaaaaaaaaaaaaaaaacagaggctggtgaggttcagagaaaagagagcacttatacactattggtaggggtgtaaattagttcaactattgtggaaagcagtgtggcaatttcccaaagacttaaacacagaactactatttgactcagcaattccattactgggtatgtacccaaaggaatataaatcattctaccatgaagacacatgcacacaaatgttcactgcagcactattcacattagcaaaaacatggaatcaacgtaaatgtccatcaatggcagactggataaagaaaatggggtacatatacactatggaatacaatgcatccataaaaaagaatgagatcatattctttgctggaacatagatggagctggaggccattatccttggcagactaacataggaatagaaaccaaatatcacaccttcacacttataagtgggaacttaatgatgagaatacatcggggcctacttgagggtgaagggtgggaggagggacaggataagaaaaaataaatattgggtactaggcttagtacctgggtgatgaaataatctgtacaacaaatccctatgacatgagtttacttatataacaaacctgcacatgtacccctgaaacgaaaataagagttaaaatgacatcagtgtttttttaaagaatcagagaagtaagtactatgaatcagacttggtttgttaagttttagccaaacattacccctactggaggtatgaatttcaagcttagattcccttaaaactgggactttccccaccaccaggggtgatcttaatttagcatcccatcaaactgccccatggatcccacatataaggcacatagctttctcctgtaaaaaacatctggggttaccccatattgaatacaggcaccaatcagcctatccatctacccactgactaaagcacttcattctacttctctgtgaaaggtgagacatgcatgatgagtagtggcacctctactctaacagaacccaggctgagtccaaaagatgccctgacatatgactctcagccccatggtaagctgacaggagtccctgaacatattgtttttgctaaatgtacagtgttgtgttttgccttgctccagatcccttacacatcattataaaatccagaagagggcctaatggcatgactgccctgctgacttacttaagaccataggtgacatggttatctaataaaaccacatggatttcttattgcaaaaatgatctatgactcaaaagaagtcacattgagcagcaaagattcagggatatataattccaagatccacatctacatttaaatatctgcagctcctaagtagcaggcaataagttccaatggagatactgaaagctgtacgatcataaatgatgtatacattcttatgtgtatactttcttcttatgagaatgctttatcatcacagctgacctgcagtaccattaaataagattcacttaataattattaccttgattttagtcatatgtacctaggaaagtatattttcatctacagtggcatgacacatttcagaagtgtcccataattctgtatttacataaaaaatgttaaaagagatgctgtaaactcttctaatttctagggtacagataacttattcctcctaaatgaacggttttattgctgagttgtatgaaggcaatttagtagtgaccacagaactgatgattgacttctaaacttgaatcaacacacatagggaaatcatggggtaccgtctatgtaggatgagaaaagagggaaataatgggagaggaagactacttctgtgcagtcgatgttgcacttgactgaataacctacaccacaactgtttgtgattgtactgctcttgttagaaaatgtaaggtattattagtatgtagaagttgaaagagaatagaaatggctactttcaattatgttttcattatatcagactttcacccagaagataggaagtctaatgtgtgaaatattgcaagtccaggtttgaaggccagaagcaattgctttcaagtcctgcacagaagtttgcattcagcttcttcagcttgctccctaatttgcttcctctatctctccctgtaattgaaaagtgtaaaggaaacaacatacctccttagtttaatatgttaacacctgatgattaagaattgtgtgaaaaagggtacagcaaatgaatgaatgatgataaacgtttcaacttttagaaaagttcgccactcaatatatctaaaattggtttttgccaatttcagaattcagaaaggtaatctattttgttagttttagtgaaaactcaatttatcctatacaatagtaagtattgtatggtaaactcaagtccttaccagtgtagatcaagaatgtgtcttattattattgagtactatgaaggtcctttttcctgagagaaattacaagtcatcattagtggcaggtatagaaaatattattttcaaattctttaatccacttttcattttaggatcagggaagtcctacaagggagctgaaggccaatgtacatagcaaaacaaaaacaaaacaaaacaacaacaacaaatgccacagtatttcacattaatgctgggcctcttactttccaaggtttgaaaaagcttatggattctgggtctgtacttagcctaaaaatcgaacccaggataataagctttttccaaggcagtgcatgatgaataatatcagtgtattctattcattttcaatgtctgcaaacggggttaaccccctttttttcattagtgagtcaaaaggggcataaaatgggggcacattggttgaagaagaggccctggatgatggttccaatcaaataaccaatgacacaatttacaggactcccttttctcattgtcagtgagtggtggtggttaaatatgttattgggcatcaccctagctttatatcttggctttccctttactagctgtgtgctcatgaacaagttatatatcttacttgtcatgtactcatgggaaattgagtttctacatgtaaagctatttgatcttggcttggtacaaagtaagcactcaataaattttgaccattattattccggctataaaattatagaattgaactagatgagagttagtaatatctccaacaactttgagtataaaatttaggcttataattaatagattataaaacaacttaaaaataatcatttctttccttcaaccctactgcttacgaatatgtgcaacacattggtaagaacctccttttatacctttacaaagagcagaggcactatcttcagaggcctatctctggtgtccctgtgaatttataaagttaattctgaagttgtacaactagcatttcaaagaatgactcaattacagaacccaatgaactctttatatgaggatttaataattaatttgataatttaagtaatttataagtgtatttgttcacattaattaatattattaaacaaacttaatttatttaatgtaataatttaatattggaccctctctgcttcatttggcattgcttgcattcttcttatctggggcatgcttttctcatcgtttcctctatgggcttttccttgggcttctcttctgctatatttttcttaaatattgatgatcctcagggttccactcattactcacaactcataattgtgcacactatacctgggtgatcagttttttcattctgtacaactaaactcttctcatgcttctgacctgaacattcaacaaactactggacatctggagctagaaggcacactgatacttcaaactcaatgtgtccacatgttctaattttaaatttgaaaagttcacttcctcgcttgatgacatcatcatccattgaaactagacacctatgaattgctcttatgattcctctttcttcctcacatcccacatccagtcaatgaacaaatcttgccaaatttacctccaaagtactttgtagtcatttttccttctcattccattcaactgaggctttaattcacttgcttaaattcctgaaaggtccttgtggcttgttgttctgttccacttttgtctaatcaaatccattaccaaaataatatttataacaatcaaaactggcagtcttccctctctataactttttcttatgcacaacatgtcaaagtccaccctccctgaagaggcccttgatgagttctctagttcatctttctctatagtccatatggcaggttttgtcatgataaaaccaagatgccaaattttgcttcacatggcatatatttatcacccctgtgttttattaaataatgttttcactatctgaaatgtgtctctataacggttcccttctttctgtgttttttcttctaaccaatcactcaggctcaaagagaataacatcttcagcccatgttccctgaaaccctcccacctgccacgtcaggctacgccatttactgtgtggccttgaacaaattacttaaaaaatataaaaaaacactccatgactcagtttctctcatagtaaaagtagaataataataataatctcacagagtggttgtgggtattaaagagaatgcatacaaaatgcttacacagtcacttggatacagaagcccataacaattgttggtttctacctttggaatcattcttcattactactatagtaccctcaatcaataccattgcaattttcacatgatttgactgtgagtttatatctatctttactaccaattaactctttgaagaagggaagtacctgggtcatagtcagaaaattattataggttgaaccaatgtacatattcacccatttgctcatccctggaaatagaaatttatttatttatttattgagaatagaaaccttttacttcttcaaaactaaatgtctaaaagtaattttcagtcattaggagaatttatttcttcggttcctttaattaattaaagttgttgagagattctacaaatagaacattttaccactgcacactaatgatgtatgtcagaaatagtgaagctcagagaaacaaactatacttctttgcaataattatttccaaatgttacaatcccatcatctgttatgttattcccacttgagagagtttgtaagtaatttaaggtgtggtattaattattttaaacatgttatttgatttttctgagaaaaaaatttcaataaagcagaccttgatagatttagtaaaattaggactgggcatggtagctcatgcctgtattttcagccctctgtggggagccaaaggcaggaggattttttgaggccagaagttggagtctagcttgggtaaaatagcaagagtctgtctcaacaaaaaattaaaaagttagtccattctggtggcacacttgtagtcctagttactctggaggctgtgggaggatggcttgagcttagaattttgaggttacagtgagctgtgattgcatcactgcacttcagccagggccacagagtaagaccctgtctctaaaacaaacaaattaaacaaaaaaaaattagcatcagaacctatctagcacccatgtcaggggagtcttatattaaatgcaataagtattctatttatttaaattgaaaaaccctttgatcactgggaattttgaattctaagagcatgaacctactaacatttgaaaaaagataacatttcttcccttaacactgagtgtcagtagcagaatggcatgggttgggaagataaatatttattgaactatttgatccattgtcatttacagaagattcagaactttaaacaaagagtgtgtagaggaatctgtctcctgcctatctgtccctagtcaaagtggacctaaaaagatacagtaagaatgctcaactaatggacagagtaagacagatttgctaggtagataaattgatggatagatagatgcatagcagaaaaagaatcatagagaatttttttctccccaagcaatttttattcaagttaaaactgcaaatgtatgtcctgtgtccccatgtagactataagttccataaaggcaaacataggtgcttgtttttgtcactgctatttccccaaagactagaatatacaatagtaggatgtgtaacagttaaagaggaaaaacatgaaaaatgactcaacagtaaaagacaggtttattttggagaataaatctgagaggggcttctggccaatttcagtcaggagcacactctcttaaagactaagagtatttaagggtttagggagagagcatatcacagtcttgcaatgtttctgagtggaggagtttattgtggggttagaatgtctgtggtcagaggggaggtaatcttggggctgacctctccctggtcagaggggaggttatcttggggctggcatgtctctggttggggaagggtttatcttagaattggagtgtttctggtcggagatgtcatttgtggttcatggtcatgctgacattagccattaggctgatgcccttttgattggattaggcagttttttgatcaaggggaactttaaaatggtggttcttgtccaagatggcgatgctcctgctctgtcaggatgcttaattaataattaatatttgctaaagaaattaataaatcatagatgaaaataaactttctctccatttctgaaatcagaggccatactcccttagcactcatgactacaagggacctcagcttcaagccttgccttgcttatctccagagcccttcttataaattcgtgagtttatctccaaacctaatgtgggaaatctaaaaaaaaaaaaaaaatcaaaatgtatgtagtgcgagcctctaagttttaacttttaagtaaggacaaaaggtcctagagttctgttaatttggtaaccttgacaaaaatcaaagacattttaagagcttaaaaagctaggctgacccacctttagacatccggtataatcaacttccattaagatctttgttatgtgcagaccctgtcaaaaaaaaaatgagataagccttatataactgtaaaaaagcagcaattcatctgcattcattttaacttgaaacctgatggtagaagatatgaattagataatttgacagcatgtgttttggtggttcttatagcttgtgagagactttgtaatgttctttttcctcactttttcttaccaaaggtcatattcctacattctgtattactaaagataatatcaaaaactacatagtttttgcagtttatcaaaaaatagttttctgatacattttttacatagatctggtttacagattaaaaacagttcattagttaaatctgaatttcagaaaaaatgtttaactagtttcccatctttgtattttctatatctggcaaatgtgtatagatctgtataaatacaaactacaaaagcagttctggctatctcaatgtatgtttaggaatgtaaataaataatttcatttgtaatcaccacattgtcatatttttatttgtcattttatataagatatataataattttattccttctcttggaattaaaatggtagtgccatgtcaccttcatatgttgcctgactgattgccaaacatagatgaattgaggagacttatgaaaggtctcctcaaatacatactcagtacatgaacgctgacatccttgtagtaagatcaacgtgggaaaaaataaccagcctgtttttgagttaacaaatagaaacaaataccagagagatcaaagcactacaggtctgtgtgaataatcatcctcctcccctcccctaaccttgattttttctcttacaattaaatttatctaaagaaaagacatgtctgtctggttacactcagatatcactgagtagagtcagtggaaagagactgactatttccttgtccaaaaagagaatgaatataataatgctaccagcattcagaagttgctgggaggatgaagaatatcacctttttagtctgtaaacagttaagcacaaaattactgctaattaattaggtaacatcaattgtgtatttttcttgtggtttccaccaaggaattagaattagcttctgagatttaagttgtaaaattaataccccgtgaatcctagcaggaaggtgcaaagcactttgaaagagtggtggtggtccccaaacctgtgagatggcatacctgagtgtaagcagataggcatgtcttttctttagataaatttaagtgtaaacagacaataaaagtagtggggagggagagtattcacataggcatcacgcgttttgatctcgttggcatttgtttctgtgttaactcacagatatgctggttactttcttcccatgttggtcttcctacaaggatgaaaaaggttgcttatgagggtggaagcagtttcatttccatgtgtttgccttcattcatgattaacttgagtcttttgctgagatctgctgacacattgggtttcagaagttgcatggctcaggcatacttttgatacatttaccaagataatgaatgccttcataaggcccctagaaagacctttttttttgaggtggtactgataactccacgtagccaagaacgtaatcttgttcttatttgaatttctgcatacagtctgtattggaaaaattgttttaaaccatgtaaaaaaaagtgttgcttctatctggcattgaatatagcttaattaatctcattcacttctagtttttggaatatctcagttctgtcatctatcagaaattagggtaggaattgtgctaattttttaatggacatattaataatgcagataagtttatcattttgtacatctacaaataaaataaagtcctcatgaattaagttatactatataaaacttactgcacatgttttcttccaaagaaacttaatcttttgggagaaaaatatgtatatgtctcattaacatcgcttataaggttaatgtaaatttgctatactccagacttttaagccttaattggcaatacccataatgctccacaaaatgataaatattagttttttaatttttattcagtattaactgaagacacaaaatgatactcaaaatgtgtcacagaaattcttttgtctttttattatgaaactttaaaaaataccagggaaatagtatctataaatacttattacaaaagtagaatattggccaggcgcagtggctcaggtctgtaatctcagaactttgggaggccaaggcaggtgactgatgagatcaggagttcaaaactagtctagacaacatagtaaaactccgtctctactaaaaatacaaaaaaattagcgaggtgtggtggtgtgtgcctgtaatcccagctactcgggaggctgaggcaagaaaattgcatgaacttgggaggcagaggttgcagtgagctgagatcacgccattgcactccagcctgggcgacagtgcgagactccatctcaaaacaaataacaacaacaaaaaaaaacaaaataatagtagaatgttatccagaaccttgcaaccttgcagtggttttgcagtacaccaataagttttcaatacctcacatcacctttaagctctgctgccctctcatataaacaggtctagagatagttccaacataacagatcacaaagctcatctaaaacagcaaggatgttgtcaagtgctgttgtgtccggaatttttgggttcttggtctcgctgacttcaagaatgaagccgcggacccttgcagtgagtgttacagttcttaaagatgttgtagccggagtttgttccttcagatgttcagatgtgtctggagtttcttccctctggtgggttcttggtctcgctgacttcaagaatgaagccgcggacccttgcggtgagtgttacagttcttaaagatggtgtatccagactttgttccttcagatgttcagatgtgtctggagtttcttccttctggtgggttcgtggtctcgctggcttcaggagtgaagctgcagacctttgcagtgagtattacagctcataaaggcggcacagacccaaagaatgagcagcagcaaaatttattgtgaagagcaaaagaacaaagcttccacagtgtggaaggggacctgagcaggttgccactgcaggctcaggcagcctgctcttattcccttatgtgcccccccccacatcctgctgattggtccattctacagagagctgattggtccattttacagagagctgattggtctgttttgacagagtgctgattggtgcatttacaatccttgagctagacacagagtgctgactggtgcatttacaatcctctagctaggcataaaagttctccaagtccccaccagattagctagacacagagtgctcattggtgcgtttacaaacctttagctagacacagagtgctgattggtgcattcacaatcctttagctagacataaaagttctcaaagtctccacccaactcaggagcccagctggcttcacctagtggatcccgtgccagggctgcgggtggagctgcccatcagtcccacactgcactcctcagcccttgggcggtcgatgggagtgggcgccgcggagcagggggtggcacccgtcggggaggttcaggctgcatgggagcaccctggggggcggggcttgggcatggcgggctgcaggtcccgagccctgccccatgggaaggcggctgaggcccggtgagaatttgagcgtggcatgggcaggccggcagtgctgggttacctggtgcaccctctgcagatgctggcccaggtgctaagcccctcactgcccggggccggtggtacaggctggccactctgagtgcagatcccaccgagcctgcgcccacctggaactcgcacttgtgcacgagcacctcatgcagccccggttcccacccacgcctctccctccacacctccccacaagcagagggagctggctccggcctcggccaacccagagaggggctcccacagtgcagcagcaggctgacgggctcctcaagtgtggccagagtggatgccgaggccaaggaggcgccgagagcgagcaagtgctgctagcatgttgtcacctctcaatcctgcctctaaacaggacaccccaactgctgttgggaatttggccgatgaccactctagctacttccttctggataggggtgaagaaggggccctgcagttgtagtgtcctccagaggagagctctctaggccagtggaagggccagtgggtcaatcctgaggtcctcaatagaagttgttagttgggctcatttggggttccatttgtaagaccttctgtatgtagcttgatggcctcgattctagcggaaacaaatttgacaagaaggttaaaaatagagggtccaaaggcgagtaacagcaagatggctgccacgggacctagaaaggggagaagccatgttgcccaactccagaggttggtataagagtttgaaaggaggtcaggagattgagaccattctggctaacgtggtgaaaccccatctctactaaaaataccaaaaaattagccaggctaattttggtggtgggcgcctgtagtcccagctactcgggtggctgaggcaggagaatggtgtgaacccaggagtcagagcttgcagtgagtcgagatcacgccactgcactccagcgtgggcgacagagtgagactccatctcaaaaaaaaaaaaaaaaaaaaagagtttgaaaggcattgtctgacttcggaagccttttcctataaatgctgggtggcatctcatactatccgtgactggttagtgtaaaaacaacactcttcccctaagaaggtacaaagtcctcctttctcagcaggggggaggtctagacctcagcggttatggagagtcactgctgctaaggtgtctatttgggattgtagagtaaggatagatttcgttatttcttgcaaactgtctgagaaatcctttgagagtgtgtggtagtaggataatgcatgttacaccgttaacttttagcaaactttactttagttgaaaaccttgtaagtttgggattttaatttttctttgctattaataaaacctcattcagtccatattaacttagaattggtataaatgtctccttcctgattctgtaagtactttaagatttggctcagtgcaaacagctcacacgtttgagcagaccaattattggacagttttcctaaatctgcttctataagagtttccttatcacttactgaatacccattgtgtcttttttcctaatcgcccaaaaggaaccatctattgtcctgtcctgaaaggagttcctcctatgtctggtcggaacttcctatggtaattaattaagatttagatcccctgttaggaaacttcctgggttaaggacttttgataggaaggctatgggttgtcattggcctcagtgctttcgggctatgcccttgtttacactgacaacaaggtggtattgtagtgttacagggtcatggagaagaccgtcaattatcaattataggttttaaatttaccctggcttttaaaggaatagggtacactgttttttctttactatttctctctctctttctttctctttgacttctttgtctctctttccttctttctctctgactccctctttgtctcttcctctctttccttctttgactttctgtcgctctgtctcttcctctgtctccttctctttgtctctgcttcttcctctctctgtctcttcctctctctctctctctttgactttctgtctctttctctctttccttctttgactttgtctctctctttctttctactggtctttccctgcctctgccagctgcttatgctgctgttctcccctctccttcctctttttgatggcttcagcagtggaagactgccaccaccttgggtttttgcactgtgcaataactccataatttccttgtggtatttaatgggggttcccagcagttaggaaccccctttctttccatattgcagcatgggcatgtaggattagataagcatacttgctatctgtatacacatttattctttttccctttcccagttctaaggctcaggtaagtgccactagttctgctaactgggcgctggtccctggggaaaagggcttattttcaagtatggttacatcactaactatggcataacctacccttcgtatcctattctccacaaatgagcttccatcggtatataggttaaggtcaggattagctaaggggactttgaagagatcatctcagggggcataagtctggactataatttgttggcagtcaggcttgattggctccccatcgtctgggagaaaagtggcagggttgagggccacgcatatacatatttgaagcaccggtccctcaaggagtagcacctggtatctaagtaggcagttgtctgatagccataaacttcctttggcacctagtatgccattgacattatgagtagtccagacagtgagatcctttccttgtattattttgatagcctctgacactaagatggccaccgccacaactacccgtaaaacagtgaggccagccttttgctactacatcaatttccttacttaggtatgccactggttgtggggttgtcacacgagtctgagtatggactccaagagctatccctgctgtctctgtgatgtagaaagaaaagttttgtcctgtcagaaggcttaaagcaaagctgaagtttgaactagggcctgctttaaggttttgaaggctgtttctgcctctggttcccattctactagatgagtatttgctctctgggtctccttgattagagtatagaggggcctggctatctcgctgtatccggggatccatagtcggcaaaagctgttgattccaaggaacacctgcaactgttttaatgtcttagggcaaggataagccagtataggctgtattcattccttgctgagggccctggtccctctggctaagattaggcctagatatttcacctgctgcaggcaaagctgggctttcgacctacacaccttgtacccttgatcggctagaaagttcaagagttctagagtaccctgctggcatgaggcttccgaactggtagccaagagcaaatcatccacatactgaaggaccagagtgcctggacttgagaagtggcctagatcttgggccagtgcctgaccaaacaggtgagggctatccctaaacccttggggcaagactgtgcacataagttgggacgtgtggtctgtgggatcctcaaaggcaaagagaaactgggagtcagagtgcaggggaatacagaagaaggcatccttgaggtccagaacagtgaatcattctgcttcctctggtatttgagagagcagggaataggggttgggtacaactggatatagaggagttactgcctcattggtgagtctaagatcttgcactagtctccactgaccgtcggtttttgtacttctagaattggggtgttgcagggactgctgcatttccttactaagccttgagcttttaaatgtttaacaatatcctgtaaacctttatgagcttcaggccttaagggatattgcctttgataaggaaaagaggtggggtcttttagcctgatttggactgggtgggcattttttgcccttccaatgcacagacttcagggttgattccctcttcaagtaggggacaacaaatgggtaacttgtcccctatattcatgtagataatagctccacctaatatatctctacctaataagggtgtgggactttcaggcataacaagaaaggcatgtgaaaagagcaaagtctcccaattacaactgaggaggtgggagaaatacctggttacaggctgtcccaggattccttggatggtaatggaccttgaggacagtcgaccaggacaggagattaacactgagaaggccgcgccagtgtccaggaggaagtcaatttcctgaccctaagtggttaaacatagccagggctcagtgagggtgatgacatgagctggcgcttgccctgggcaccctcattcctgttgttggatcgtctggctgggggcttctgatccagagaatcttcgttctctggagcagtgcaccttccagtgattgcctcggcatagtggacatggacgatggggcagcttgtttctcattggacaatcttttttaaagtgtccttgtaaaccacactgataacaagccctactgggtgattagcctgctccattttctgtcctctctgaaccaccaaggtttctttgtctgagggccatgactaaggctgcggcctttctctgatctcgcttttccttttgggcctgttcctcttggttcctattttagaacaccgaggttgacaggtttaataatgcctccaaattttgttcagggcccagggcttgcttttggagctttctcctgatatctgcagctgattgggtaataaacttatcttttagaatcaattgacccttgagtgagttgggtgacaggggagtatattttcttaaggcctcccatagctgctcgaggaaagcagaaggactttcttcctttccctgagttatggtagacatcattgagtaattcatgggctttttcctaattctccttagtccttctagaacacaggtcaacagatgtttatgactccggtccctgtgatctgagtcgaggtcttagtggggatccatactggggatggcttgttgaccagtagagaatttattcttttcttcagctgtcattctatcatttactttactaagataccaggtatctccaaactctcaagctgcagctaaagctgcattcttttcattagaggccagggtttgatctaacagtagcatgacatctctccaagcgaggttgaaggtttgccctagaccatgtaggatatctatgtacctatcaggatcatctgaaaacttccccaggtctgccttgatctgctttaaatcagagagggagaaggggacatgtacctgggttgggccaaattcccctccccctatagcttgaagaggacataaccgatagcctggggggttagtggtcctttggagatttctttgcttatttccttctgggcaggggagattagaggaggattatcattaataggaaggggagctatagggatgctaggatatggggataagctgagaggtcctcctgtgggatgtaaattgcaagctttgcatagttgtgtattctccctcaatgaaaagaaagcttggacataaggcatttcactctatttgccttccctcttacagaaaaggtcaagctgcaggatagtgttgtaacttgtacttcccttaggtggccatttttccccatcagagagagaatattggggccaagccatagtgcagaaaaaaatgagccgcctctttctcagggtttgtgggtcaaattggtcccaatagctttggatgcatttcaagggtgagcctcttgatgcctgagtgtttcccatctgaaagacaaaaatgcccccagttttggtttgtttgtttctacccttgcccaagaacccacaacagtccctggaccctgctgatagaatagttgcactcaccaacacagcagcagaaacaacccctacccaagaacctgcaatggtccctggaccctgctgatcggaatagttgcactcactgacgcagcagcagaaacactagttttcaccttagaccacaaagagaaccaaggaaggtcagatttagtggcccttactgatgcattcttgaaaacctgcactcttgcctgtcctcctagaccacaaagaggaccaagaaaaatcgggtttagtggcccttaccaacgcattctcaaaaacctgttagagtcctaggcattcacctgttagtattgggactttacccgtgtcctataaagatgttatgccccaaaaatgaagtggagggccataccctgagggagggaagggatctccagagttggaagagtgatgccctttgtcctcacttacatgaataggaaggatacaatttctgaggctacccatatcctaccttcaggaatagcttttgttaggcctgcttgtctgaggagggatcctaaaattccaggtagtctcccctacaacagggctttgggcaaaaattgtgtccttctgattagtgagcccaggtgcctaaagaagataacagaatcctggagtttatactagaaatcattcttacaggagaaaatagaaaatcaccagagacagggagtgatttttagaagagggactagcctcagagaagagaggtgagaggaagttttgtctggcaggcattaggacccaggagtcaagggtcagggtagatagaatagatgggctagtcttgcttgggtgacatgcctttgagagttctgctcatggccgcatggtcaaccaacttgttgtcggcaccccggagctgaatggctttcctctctgtcgaccctcgactcagcccaggaaaacaggaaaagtggaagctggttccaggcaaaccaacgctcccaactccgaagagtcaggggttgttagacagccctttctcagaaagcctgacacctgtgtcttcagtctggcagccacgctagtcgcttttaactgtgcctggtatttagcccctgaattctaagaaaaaataggacagaatagcaagcaaaaggggtccgatggtactcaccgcttggcgataggtgatggtctcaccgcttggtgacaggcagttgtctcaccgcttggcgataggcaatagtctcttcgtggttgccaaaatgtatctggaattggtgtgttcttggtctcactgacttcaagaatgaagccgcagaccctcgtgataagtattacagttcttaaagatggtgtgtctggagtttgttccttcagatgttcagatgtgttgtttcttccttctgttgggttcatggtctcgctggcttcaggagtgaagctggagaccttcgtggtgagtgttacagctcataaaggcagcgcagaccaaaagggtgagcagcagcaagatttattgtgaagagcgaaagaacaaagcttccacagtgtggaaggggacccaagtgggttgccactgctggctcgggcagcctgcgtttattcccttatctggccccaaacacatcctgttgattggtccattttacggagagctgattggtccattttacagagagctagttggtctgttttatagagagctgattggtatgttttgacagagtgctgattggtgcgtttacaatccctgagctagacacagagtgctgattgatgcatttacaatcctctagctagacataaaagttctccaggtccccaccagattagctagatacagagtgctgattggtgtgtttacaaacctttagctagacacagagtgctgattggtgcgttcacaatcctttagctagacataaaagttctccaagtccccacctgactcaggagcccagctggcttcgcctagcagatcccgtgctggggccatgggcggagctgcccaccagtcccactcagtgcgcccgcagtcctcagcccttgggcagtcgatgggactgggtgccgtggagcaggggccggtgcccatcagggaggctcgggccacacgggagcccaccggttgtgggggagctcggtcatggtgggctgcaggtcccaagccctgccccacagggaggcagctgaggcctggcaagaattctagtgcggcacgggtaggctggcagtgctggggtacctggtgcaccctccgcagacgctggcccaggtgctaagcccctcactgcccagggctggctgcacaggctggccgctctgagtgcggggcctgctgagcccacacccacccagaattcacgctggcccgcgagcgctgcacgcagcaccagatccccccccccatgcctcttcctccacacctccccacaagcagagggagctggctctggcctcggccagcccagagaggggcttccacagtgcagcggcaggctgaagggctcctcaagcatggccagagtggatgctgaggccgctaagcaggcaccaagagcgagtgagggctgccagcacgttgtcacctctcactgtgactatcatacttttccagtcacctttaaccaaaagagccgcccgagttatctgctatatgatattctgatacagagttctaatattgaagttatagttcttaaataagtccttgttgcgtgtgaaagcaacacttggcagttccagagcctgagtagaatcctcaggaatagaccctgatgcttgaaagcagggaagccgattcaaggaaaaaggaccttgcttcagcctctatttccatgttcaggaaatgaaatataataacattaccagcatcagaaaggttgctgggaaggtgaaaagatattacttgtttaatctggaaacagttaagcacaaaattaatgttaattaattcgataacactaattgtgtatttatcttaaaaatacaggaaactaaacacgtgattattgaaataccagtgatttgatggaattcgaattaaccatactttgagataaattagaaagatgtttggttttgttgttttttaaaaaaaattgatatatattcagatgaataaagattattataatttatagttactactctagaagtttttttatcctagaactttaatgctgagtaatatcataaattattaataatatacaatgtgaagaaatatagtgtatataccttgatttataacatgtatccattataagccaaaatttttgagaaatatatttttgagagactgtacattaaaaactggatgagattgattatattttatttttatgaaaatgattatagaagttaattttattaagtgttttatgttcaagattttatgtaaatcctttcaatattcaacaccagaaggaataagtctaagatatatattattctggtagaatttagtcttttagtttattttcattttcatttatttttataacaaaaaacattttactaaaacataagacttacagaagtttccagacaagccatacaaaatggtcacaagctttttctgaaggggagaatctatacttgacagcaaagtcacagtgttattattgagagctgtgatgtttgtttaatgttcccattctggttcaaacaatcaagcttgtccatctacagcatctaaataaagttagacttggctagggaacatattctaaagaacaggttaggccgggcgcggtggctcacgcctgtaatcccagcactttgggaggccgaggcgggtggatcatgaggtcaggagatcgagaccatcctggctaacaaggtgaaaccccgtctctactaacaatacaaaaaattagccgggcacggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaagaacgggttagctgcttttaatcaatgcaattagatcaccaaaaaaaggtgggaaaggagctcataaattaaaataaaactacctcccccctgaaaaaaataaaataaaataaaataaaataaaataaataaaaacacccacgcccctggagctaacctgacaactaccttcattcacagtgctttacacttaaaccaggcttggggaaatgaataaaagcagagaggggccactgcttttaaacgtttcccaacagtccagacgatacttctagcctctgctcatactttttgacagtgaatcagaacaaaacatagatttgctaatgtgcatttaatcaccaaaggactgaagaagtctgggcttttattctgtagtgtttctaagaccttgtccattaaatgtaaaccaaaagaaagaagtcttggcagaacaggagaagtgatgcatacttgatgatcggatcaatttaaatattattcatggcatatagcctagtccctgctctagctgtttatatggcttgggcttcgttggtgtttccactgctcctctgcatcatttgctaatggatcatctggatttggagcacttaacaaggcctggatccgtagcagaactgtgcggatctgcagggctggggaccacttacctttcaaaatatcttaacgtattctccccaacttgtctacattaggatgacaaattttggtcataaaacgcactttaggggctgccattgggtattcttctggaagaaatagtccaagtttaaaagtccctccctcacagtgggaatcccagggactggcaatgaccacatgaaaataatggatgttgctctcatatggttctgctttgaggccaggaactggttctgccagcaaaagctgggtttccttgacgatcctgctgggcagcccagccatcttgtcaggtcctgagttgggtctctggtctctaacttctagtttatatatccttgttttcaatgtacaaagatgtacactttagtagggaaagaaagaacgattgtcactgtttaatatgcatcaattaacataagtaatctattttaatggtatttcagaaccacaaagaagaactctttccttaaagctttaaaaatgtaattgaaatctgaaaacatattccatataatttaccacgaaagagaagagacactctactacagtcatattcaattgttttgttttgtttattacaatagacatttagaacatcttatccttaaagtaatttcagttgttttgctgattttcagcttgtcagattgtttattccttttcctttttgcaatagaatgataatgagaataaattttgtactgtgtgaaaataaatttatttttataacagttaaattaaagagataatctgataaatctgaatgttattttaacagtttgtgctcctgtcatactttgaactgtaaattttattcagctgccctctatcaggcaagctttatgaattcctgcaatttgctgaaggcattgtaacaaaacaatagagtgaggtggaataaacctttaaaaattcctgtgaagattatacttactttttattatttgttattttctgtcagaattttggacaaagaagttaagacctatgctttggatgaaacaaatgattatttcctttaaagctatttcctttttactttttgtaatgaaaggcttattggtatataattcacctagcatgaaattgaccatattaaagtgtacaattcagtggtttttagaatattgatggaattgtgcaaccatcatcactatccaatcttataatagtttcatcacccccaaaaggaaccccacacccaagagcagtcactcccattcctccctactcccagttttctggtaaccagtaatctaccttctttctcttcagatttgcctgttctggagattttatataaatagaataattaaatatgtagtcatctgtggcttgcttttttcctttattatattattctgaggcttgttcattttgtagcatgtatcaatatttaattcctttttatgagctataacaataatgaaatattatatggatatatcacatctgtgtttattgattcatcagttgatggacatttagattgtttccactttttgactattatcaataatgcaaatatgaacattgatgtgtcagtgattataaagacagatatgtttattccacttgagtgtatacttaggagtcaaattgctgcagtgtatggtatgaagaaaatcattttatttatgatagcacaaaaaacaatgtgtaatattttgaggacctgccaaacaactttgcaaaatggctgcttcattttaaaaccagaaatttatgagaattttcatttttttccatgtcttcatctacactggatattttgtttgtttgagatggagtttcgctcttgttgcccaggctggagtgcaatggcacgatcttggctcactgcaacttccacctcctgggttcaagcaattctcctgcctcaggctcccaagtagctgggactacaggccaatcaccatgcctggctaatttttggagttttagtagagacaggggtttcaccattttggcaaggctggtctggagctcctaacttcaggtgatccacctgccttggcctcccaaagtgctgggattacaagagtgagccaccacgcccagccaatattgtctttttttttttttaagtttggttattctattaggtgtgaggtagtatttcattgaggttttgatttatatttacctaatgaataatgatgttgagcatcgttttatgtacttgtcagtcttttgtctttcttgggagaaatatgtactccagccttttgcctattttttaatttcttctttcattgttgagttgtaataaatcttaatatattctgagtgcaagtaatgtatcaaatatataatttgtaagcatattcttctattgtgtgcattgtttcttcatttctttatgtgtcctttgatacactaattttaaaattttgataaagttcaatttcctagatgtttttgtctcatacttttggtgttatgtctaaaaaaccattgcttaacaaaacgtcatgcaaagtttcccgtatgttctctcttctaaaagttttgtaattttggcttttacacttagatttaaatccaatttaggttcatttttgcctattgtgtgaaatagggggtccaaataaattctttgcctgaagaactttgaaaagactattcttttcaacccataattgggttgaaaaggcaattgtgaagactattttcacacaatttttaaaggactgttttttccccattaaatatttttggaattcaaatctaaaatcaaacgatcataaatgtaagctatatttctggatgctcaattctatttatttgtctgttcttatgtagtacacactgtattattatagttctgtaataaatctcattatcaggaagtattaatcttccaactttgatattctttttaagtgttactttgactattctggagccattacattctcatgtatattttaggatcagcttgtcaatttttttagaaaaaggtaattgatttttttggtagacattgcattgaatccgtgtaccaaattggagagtattgccatcttaacaatattgtcttccagttcttttcattttttttagattttctgtaacttttttcaacaaaatttgtagtcttcaatgtacaattattgaacttttgttacacttatttataagtgattgttttttgtgctattataaataaaattgttttcttcatttcatttttagacttttcattactaatgtatagacatccaattgattttggatattgactttgaattctgcaatcttgctggaattattagttctaatttttgtgtgaaattctcaggattctctatatacaagagcatgccatctgtgagtcgtcacgattttgcctctttccaatctgaatacttacttcctttgcttgcataattgtcctggttagaatctacaggacaatgttgaataaaaaggtgagagcagacatccttatcctgtttctgatctaagattgaaagcatgtagtctttcctgcttaagtgtgatattagctgtggataatcaagtttaggaagttcccttctatttggtagatgcttttcatcgggttcaggagttcccttctattcttatttttcttgaaagctcttatcatgtaaggatgatggatttgtcaaatacttttctacttctatgaaaatgcttatgtgatttttgtcctttattaatatgatgtgttatcctgattgatttttggatgttatatcaaccttgcattcctagtgtagtaaccactagttaatggagtataattcatttaatatgggtctgcatttggtttgttagtattttgttgaggatttttatttgtgtatttattagagatgttaatgtatagttttcttttcttgtgatagttgtctggttttggtatcaaggtaatacacagaataagttgaaagtgttccttcctcttctactttttgcaagaatttgttaaaaactggtattaattaaatgtttgatagagttcatcagtgaagcaggtgaagtgaagtagggcccaaacttttctttgtgggtagttttcctaattactgtttcaatctctttacttgttatagatctttccagattttttatttatccttgagtcagctttggtagtttgtgttgtatctaaaaatttgtccttttaatctaggttatctaatttgtgggaccacagtagttcatagtattccctcttaatttttttttaaatttctctaaggccaataacaatgttgctttcttcattcctgatttgtaatttacattttctctcacttcatcttgttttgtctagctaaaagtctggcaattttgttaaagttttggttttgttagttttctttattgtttttttttctactgtctattcattaatttctacccttaatactattattaccttctttctcattgctttgtgttgtttgcatttttacttttcctaatttctttagatggaaggttaggttattgatttgaaattcttcttgctttatactggcgtttacagacataaatttccctttaaagaatgctttagctgcatcccaaaaggtttgtttgttcgttttattagagacagggccttattatgtttcccagcctaaccctgaactcctgggctcaattgttccttctgtttcagcctctgagtaactgaaattatagacatgggccactgtgactggctaaggtttgttgtgttgggtttttactttcattcatttcaattatgttatgttgtaattttgtgtgtgtgtgtgtgtgtgtgtgttttgtttcgtttttgttgttgttttgtttttttgtttttttttttttacccattggttatttagaagtgtgttctttaattttcatacgtttcaattttctaattattcttctgttattgatttttgtttttaattttgtttcaagaagagatgatgaacaatttaataccttttaaatttatcgaggtatgttttatagactagcatatggtttatcaaggaactcatgagtacctgacaaaaatgtcttaatatattctgctatgattgcgtattctatagattatggttatacgtggtttctagtgctgtttaagtcttctgttttcttcatgatctcctgcctagttgttctattcattgttgaaagtgcaacattgaaatcttcaatatttatcactgaattatcaattagtctttcagttttcttagtttttgctgtgtgtactttgagactttttcctgtggttcacatgtatttatacttgttatgtattgctgaataattgacccttttttcattataaaatatatatatgttttgcttttatatcaatttttgttttacaatctattttttaaaatattgataacagctcttagttactgtttgtatagtatatctcatttttgtctttttactgtcaacctattatgtctttgaatcttgtggacaaaatatcattggatcatttttataaaatccattcttccaatgtcttccttttcattggagttttacttaattacttaattgacttttaatgtaattactggtaagatagaatttgtacattatttatttttaccatgtcttttgcttctttgttcttctattcttccattactgttttttcttcggttacatatacatattttcaagtgtactatttattacatttattgtttatacacacacacacatatatatatttttctaaagattatagtagaaattacaattaacttaaagcaatctagttcacgttaatgtcaactaaagtcaatattatacaaaaatttgctataaaagagctttgttctatgtactcctgctttatgctattatttaatcccaaattgtatctttattcattataagctgaaaaacacagttttatagttatagctttattcaatgccttttaaatcagataggagaagaaaaaatttacaaaaatacattaataataatttttatatttacctattgccttagtcaattcaggctgctataacaaaaatacatacactgagtggcctaaagagcacacatatttttttgcacagctctggagtctggaaagtccaagatcaaagtactggcagatctggtgtctggtaaggacactttccctggttttaagatgaccatcttctcattgtaccctcacatggtagagggcagagagagaggaagcaagctctctcttgtctcttcatgagagtattgttataatcattctgcagagagacagaactaataagagagggaaagtgagagcgagaaagagagagagaggtgagaagggatttattagggcaattctctcactcaattatgtagattgagaagttccatgataagctgcaagctggagaaccagagaagtaagcatcatggctcagcctaagtctgaaagcctcagaaccagggaagccaatggagtaactcaactgctggttcaagtttcagagtccaaaggctggagaatctggagttctgacatccacagacaggagaagggtgtcccattttcagaagagggagaaaaatttaccctctgctttttggttccaagcttgcccccagccaattggatagtttctacccacattgaaggcagatctttgccactcaacctaccaactcaaaggccaatctactccagaaataccctcataggtacacctggagaagcccaaccattccaatcaaatgccaaaccatctgagtttccttttcagcagaggagagacaggctcaatgcctattgaagcattaagaataattaatattttaccagctatctgtgtatacttcaatccagtcaaggtgacagccaaaattaatgatcacaggtactaataccatcctgagggccccaccctcataattttattacctcccaaagggcccacctccaaataaccttctatgggagtatggtttcaacatagaaatttggagcagagtgtacacaaacatgtaattcatagcacctatgtagtaatctttaataatagtcccttttatttcttcctgtgaagtaatgtttttatctattgtcttttcatttcagcctaaggtttctttctttggtattttctgtagtacagatatgacagaaatgaaatcactaagtttttgtttatctgagaatgttttattttctctttcctttttgaaaaattgattttctgaatataaactttttggttgacttcttacactttgaatatgctgctacctcctgaactctgtccttttggattagaagtcaactgttaatcttattgaagataccttatacccaatgagtcatttttctcttgctgctttctatcttctctttttgtctttgcctttgacagtttgtatatgatgtgtctaaatgtggctttttgagtttttcttacttataattcactgagtttcttgtatatgtagattgatttttaatcaaatttgggatatattggtaattatttcttcaaatcctctctaagcagtccatgatcttgtcccctgtctcttcaccttcttctgccaagtctacatttccttcagtttttataaactaaaatgttcttcctattactgaacattgttttaactatcctgcctctgtttttttgctcatgctgtatcctccttctgagacattttcaaacaacttatatttgttcttcaaacttcatctttaccataaatattactttcctctcaaatacatttccactccacaatctaatacaaatgtacctcttttaaagcagtcatacctttcatcacaaagtatagttactcacttgcatgttggatacgatcaaaataggcaccattttgatgtgctctgttttttacttctcctaacaaatccaagtgttactttgttatcaccatttttaacagatacatcctattttaacatcccaatatagtacttagccccagttttgcttattccagagctcatgagctcagccacttggctctaagacttgtgagtacagtaggagagtttaatgtagatggagcatctgtctgctgttgttgctattttttcgttttagaaataccatacattggtcaatttaaaatcatagaacgcaatgctctagtgctttgaatatttgaatcaattctagttgacacttcaaagttgctaatcttcattttggtggttcttttagtgtaagataaagtttacatatatgccacagaaagtatttttgtggaagaataaagacatttattaggaaagttatttagaaaattagagtaaccttggtaaggtatttacttcaacatccaagagacattacatattcaaaaggaggttttttcaaatgaaacctagattatttcactgagatttggcattagcattttatctgcttcaactaaattgtaatttgctatattagtgtatccactccccataagagtaatttctggaattcatattcatctgttaaaaaagatgcccttgtcctagtactaaaaccataatattgatgagaaaaaaatttgaggaaataacttgcctcctatgtaggatatctaattttatgcacactgtatttagtgttagcaacctgcttcgggggtagcgggtaccatacttacatgacatcctcccaaaaaatgaaatcatgatctatattattagccatttaaaaataagcaaccagaaaagctgtgctatatctatatctatatctatatttttggtgaactttattttcttggtttttccaattcctaatatttctaatagcttaaagttagttttttaaaatcatcctccgaatttaaaattcagaaatgtatgctatatgattatattagacaagacgtaatttcaggaactatgacctacattttagtttgtgttcacatgaaattctttaggattgtatggaataagacatctctacctacttcatattttaatacatatttaaatgtttttctgacacatttagtaataattaatttattaaatgtttcccaactaggataaaatttattaactatgtctaattcaaaatgttttaaaaataacagcagaaaaaaagagaaaaagaaagatataattaaagtaagactagaaatcattgatgtaggaaaaaaaagtactcagtggtgcattttaacaaatcagtaattttgttctttccaaagattaatgaatggtcaaatgcttccaagatttattgcagaaattatgggaatgcatatttattaaaaggttagaaattaagtcgtgaatgtaaataaaagttaagttgaaaattgtaataagttctgtttatgtagtaattgaaataaaatgagtagatgtatataacacataagttaagctaaaatccaagctcagtgtattggctgcatctgaagaaggtaggaggtaaataaaatcatagagaactacatggcttcagtcttcagcttcattttaagttttatttcttaatcaataaaagaaagtatgtagaacaaatatgacttaagtaacaatatttgacaaacccagatggtggatacatagctttttatatgcttaatattttcttactgtaatatatcgaattagttgagtaaagggctgctggaggacaataaaactaaggtattactaaaaaagaagcttcctttagttcatgattttaaaaaataacagttgctagtttttctttaaaaatgatacctttatgttcccatttgaccatttgaatttaatttagcgacagatccacactgtataacagattgcttggaagtgatgaatgatatactttctcacatttgtattgtagttgaatgcaaaaaaactcaatggaacaatttctgctatttaaatttttttcttattatttaaatttcctttagcaaaataaaggtcattacttttttaacccaaagaaaataacataaaatattttaggggcctattgtttaatattttaaaaattgacttatttttcaaacgttgtaatctaatagctatgtttgcaattgatgcttttaacatactcttgggttaccatggattgtttatgaaatagagccactatggactgtttaaactttaattaacagaacaaaaaccatgttacagtaatgctcccttactcatgcttgtgttctctgcactttcagttacccacagtcattggcagtctgaaaatattaaatggaaaatttcagaaataaacaattgataagttttaaattatgtaccactctgagtagcatgataaaatctcacacctacttgctcagtcctgcccaggatgtgaatcatccctttgtccagcatgtctacgcagcatgtgctacttgcccaatagccacttagtagtcatctcagttatcagatagaaaagcatagtttatacaaaattcagtgttacctatggttttggatatcaactggaggtcttgatacatatccctcatggataaggggggactactgtatttccagaaaataataaatataactaagtatgacgtaaaatgcgatattttgttcaaatgagaggcaaaaagcaaaaaagctttaattaatagtgttatatttaaacacagataagataaaatgcaaaaagactttacattgaggctcctaggagctttgattacaaacaggacatgtaaatcagaaatcttggcattcctaaacaagtcatacagtgagttaaggcactcttatgaaaaaaaatagagaagaacagtggttaattgtattaaatcaagtcaatgttatttacactttaaatgagttacattacttcagtgtttaaaaactaatttatagactaggtaaatgagaaccatcatactcaaatttcaataagctcaatatcattgtggatgtgggcaactgtcttggtccatgtgtgctgctataacaaaataccacagactgaataatttataaggaatagaaatttatttctcacagttctgctctctggtgagggtctggtctctgctttcaagacagttccttgaagagtgtctttgtgaggagaggaacgctgtgtcctcaccttgcagaaagaagaagagcaagagggatgaacactgtgaggagccacttctattcttttactttttatttttaatagagatggggtcttgctctgttgcccagagctgaaagtccgtgtcatgatcataactcactgcagccttgaactcttgggctcaagcaatcctctcacctcagcctctggaggagctgaaattacaggtgtgagccaccgtgcctggctcagaagcctccttcataagggctttaatttcattcacaagtggaagaggctttatgacttgattacctcttaaaggcaggcccctgttattaccatcaaattggccattacatttcaacatctgaattttggagggacacattctaaccatagcagcaactaagaagcttctggtgacattgggtgacattgggagtgtttgtaagatgacaaacataatttctaaacaactgatctcttactactgtttatttgtgaactttgttttgccaaacacatagaaaggattttgtactgactaatcaggcctattactagacagagggatatgtaatggtttcaagaatttcactctacaaagccttaaaggaactaaaataagttccttttccagctgatttccaatatcgattgaaaggacacactaatgagaaaaataaactaagataatgctaatcaactttttaactcaaaaaattttaaacagttttttttttctttgagatggagtcttgctctgtagcccaggctggaatgcagtggcacgatctcggctcactgcaacctctgcctcctgggttcaagcgattctcctgcctcagcctccggagtagctgggattacaggtgtacgccaccacacccccctaattttcatatttttagtagaggcagggtgtcaccatattggtcaggctggtctcaaactccagagctcaggtgatctgcccgccttgacctcccaaaatgctggaatcacagacatgagccaccatacctggcctaaatagttattttaattaaaaattgttctttacacataccagaatttttagaaacattctcgttacactataaagaccaatcaagctttgagaaaatataaaatgttagatcttcaatttctctttgacaagtaaaaacttctctcagaagcatttaaagtatttcttattcatttttttttttttttaatatagagcagtctcgctctgtggcctcaagggatcctccttcctcggtctcccaaagtactgggattgtaggcataagccaccattcctgggcaatttacagtatttaaaggaagagttgctctggctgaaagtttttcttggagagaaaaacatacctgcttaatgaacaaatctgtgtaaaacatctgtgtttcttgctcttgcagatacaaaataatatactaaaaattgtcctggctctggtgccaggttttgtggatttgaatctctactgcttagcttatcgggtttttgacctttgagaagggaagcaagttctctccacctttgttttcccatacatgaaatgaggataactatttatcaggggtccacaactcccaggctgcggacttgtaccagtccccgccctgttaagaaacctggacacacagcagaacgtgagtggcgggccagcaagcattactgcctgagctccacctcctgttagatcagcggtggcattagattctcactggagcacaagccctattgtgaactgtgcatgccggcgatctaggttgagccgtccttatgagaatctaactaatgcctgatgatctgaggtggaacagtttcatccccaaaccatcccccttcccgggtggaaaaattgtcttccatgaaactgagccctggtgccaaaaagggagccgctgctatatatgaacacagcagaggtgactattataactttgtgatagaacatgtgagtgtctatcccttaggagaaaacacttgagaaaaaatgagaataaggtataagcacttctaggaactgggcaacatcacccctccacatatctgtcccaggattgtcacaaagtgcctcctctgcttctttttcatgtagctctcaagcttctctgcagctctagcataactaccctcaggccaaatttgccattaaacaaaacgaagagacaacagagagactccaaccactctgagtagcaggttattaagtttcattttcaggaaacatcacaggtgttcattaatgacacattaaatgatgaagcttaacgtctcttttaaaaatctcatcttttgcttaattgaacatttctaatatgtaaaatctttacatagcatacgaaaatattttgagagtacaaatgacatatatttttgtcttcgagatttccctgtggcagccccaccagtgatcctgttgtgttcaattaaatgtggtaatgagtatctgactactgggctttatgtaactacttttattacgtgctttatttttacttctgtaatgtcttaataattcaaactatattttaatgctaatttattcaggtttctgctgagaattcaaaaaatggtgtcgattttattttatatttatgttcaatttttgccagaattttaattcagtcactcacattgtaggtttaaataaattgataaatggaatatatattattcccactgtttattataactaaagaaaccatacataaaagtttaataaaaagttgttttaaattaaagagatgtagatggttgattgttcatggctaatattattttaaaaactggtacacaggtaatctggcttttataagcctataaaacttctaaattttgttgagtttctttacaccacaactttataattactaattataattactttatacttgctaatttaaactaattactatataataattagctaacattaaactttctgttgctgtatttgtctctttattgaaaagcattttcaaacatataacaaaagtgaattataaccataaaaattgttatttgtattcacatattataatgtgagagccatggagtttctttgatgtaacacatgtgttcccaacttcaacaaaaaagccatatatacagaaattagcagtagtcttgcaatttattttcttcttcttcttttttttttttttttttttgagatggagttttgctcttgtcacccaggctggagtgcagtggtgcaattttaggtcactgcaacctccgcctgccaggttcaagggattctcctgcttcagcctcctgagtagctggggccacaggcacacaccaccacgcccagctaatttttgtatttttagtagagatggggtttcacaacgttggccaggctggtctcgaactcctgacctcaggtgatccacctgccttgacctcccaaagtgctgggattacaggcatgagccaccacgcccggcccttcttttatcacttggaaaagaagaaagttgaggcagttacattttcttctagcatgctgacacccctcctgacaagcagatatttactaacagagaacccttgtttatgaaataattttagcatgatgtatttggtctgttttggctgcttttatactacctgccacacagaaattgcagcaattactatcatttatattaagtttactcatcagctgtgtttcagatatcttctgttacttcatcagaaggtgctaggatgaacagcagtttctttctctatatgtttttagtctgtgttatcaggattattgatactacaaagcacctgacaagaaaatctcccccaaattataaattgacaggctttcgctagctttagaagcattctatatttatgaatcgattgttaattaacttatgtccaaagaggccatcactaccattccttagtcaagagttacacccatgagtctatatgtttctgtaatgtaaagtttcatacaatagtcatattgcataaacatgccttgtagcttaaaaaaaatcattacttttgtatttatggacatttacaaataatgtgtgcaaagactgaaaaaatataattttgttttatttattagagtcaaacagaaaagttgtaaatctctgctttttgtatgttttcattttttattttaatcagaattctttggacaaccattaatataatatttttattgttgttaccttgtgacctttagactatcttattattgtcaacatacaatatttttctcttgaatatattagagttaatggcacaggagtatataacacgtttagatgtttttcctaaaataaaatatattctgagatatcagacctttgacgaaaggattgaccatgtatattgtgttatctatagaagtctgacttaatgtagttcaataaagaaaaagaataatccctgaactccagtttcccaagataattattgatacaagagatgaaatattacaaatttaaaggagagtaaatagcaaagtttttaatatgggcaaaaattagtttcaaaaatttaaacatgaatgtaattttagtggaaatcaaccggcaacattaattaattaatgtataattaacatacaacctgatacagcctccctgaggagaaaaatgagtccctaaacctatggaattcactgcttcattctctgacttcacgcgtagttaaatcaatggaagaggctaaatcaacgtgtacagaagcagcaagtgcttaaatcatcctagtgcccctgccaccattctattataaaagtcatggaaacactccagcatacccacattttgtcaacttcagaaaagactcctgccctgataaccaaaaactgtgtatctcaaatatgtacatttttccttataataactataaaacactgtcatcagtttcttctttctccttgacctgagcccttcctcgggcagtttgagtttaaaagtgtctgccctgagtgttactcttcatgttgccaggaaacttgccttcttccgatctaaagcgtgcgtaactgcaattactattttctttttttttcttttttttttttttaagtctaagcctttatattctacgtgttttgatttaccatagtcctcactgcagcaaggacatttaaagtgagatctactatttatttttgagttcataacatttttcatggcaagaaaaaatctcagcaacccatagctgtagcttccaatagtgtttatggaagtgcaagccaagtgaggggtttctgaaaataagagatgttttccattcagtgcccaaactcagtgatatttttctccttacttaagaccagttctcaataaaaccactcacctgtacagttatgtttgtgacatctttgactacaaccatagctcagtttcaacaaacttgcagtcctaacttctaggatatgtgaggtttattgatggagatatattgtcagggcttgtgttaaaaaaatagaaactattcagataattgcatggatgccactttattgttatataattatcagtgtgttgcaattaaaagacaattttaattttgcacattttattgaatgcaatagttaaataagtcatccagtacattttgtttgcttactttcaggactaatagcaaaacatccatcattagaaatgttctttataaatttaaaaataatatataatctgtccttgaaatttatattgttaatgcagattttttctaccattatatctatcttacaatgactaacaaaactagaaaattttggtaagcatcaagatgtaaattcgagatggaactaatatctgatgggaggctacctaggtatatatatatgtgtttgttcatgtgagagatagtctatatgcttgtgcgtgaatcttagaaattatagtatttaataggtctgtgatagatgtaaactgttttaggagtcttcatattacatatgactctatttggggtattaatgctaattctttcatattagagttcacattagatgctaatagaaatccattgatctccttgacacccatgaaatgattaagataataaaagcattactggaatttgagggcaagatttagaagtaatattttgcctaacagttgtaatgttagcgtgcataatcattgaaacactgggagccacatgctaatttcttacacgttcaaggaccttttgagttgagtagtcatatccatataacaaatcactcaccttatgtgagctgtacatttattgttgtaataaaaaatggatttaactctcctagaaataagtatctcatttatttatttatttatttatttatttatttatttatttaaaatggagtctcgctctgtcgccaggctggagtgcagtggtgcggtctctgctcaccgcaacctttgcctcccagattcaagcaattctcctgcctcagcctcccaagtagctgagatgacaggcatgtgttaccacgcccagctaatttttgtattttttagtagagacagggtttcaccatgttggccaggatggtctcgatctcttgaccttgtgatcctcccaccttggcctccaaaagtgccaggattacaggcatcagcaactgtgcctggccactatcttttatttttatcttttctaaatataattgttgccagtatagtacaagctaaaagtctttctttttttttacttttggattcttctgtccttctttggattctttattattcttaactctttccactgtcttccctaactgcatgccaaccatcaggcaattgtcttttctgttttatttctaaagcagaatatattttgtaaaatttcttcatcaccatactgttagtatgatgacaaactaatttcacattaacaaaattctagctgtcaacattacatattttatggagagaaatttaggaaaacaattacatattcttaaattatgataatggaacaggaacaaaaggagttaatgtttattaaaaatgattagtcagtgctgacttaagaagtgatcttgatggaccaatgttaaaatgagctgtcaaaataagaagatatgagggctactgatctttcattaataaaatgaacatatattaaatggcatttatgaaaacaatggctgataatgaagtgagtgctatcctttttcatatctcattcagggcatccttgtccaataagaggggaggaagagcagtgctattagatttaatccgttagagaccggcactctccttttcaaaataagactagctttgcaatcgtttattgcttgagttatgtgttgagatgaaagaaagaaactgacagtactaagttaaagagtatgtattctttattgcagtaagataacctgtgaaatgatttcttgataatggtaaactacctgaacatccagcaagaaggtattggttcaataaactataatatatcaactctacaaatatattcaattcctaaaaataattttgtagaagtatattcagtgacatagaaatcgaattatgttaatttgtatttatgggcttggtttgataagtattttttggaggttctttcaatactgccctgcccttgccaatgtttgggtttttttttcttatggacaagccgactgaaaacatagactctggacactgaaaaggttatggtgcccacctccacagagactcaaatcaaacagcactgaaattaacacaaaaaaaatcaaccttttagttgtgtcttgatgatagcttctatattttatttaaacattaatataaatatgttaaaatatgtattttgttactactactttttacctggtcagaacatatagttaatcagcctactggataatagaacatgtgaagcagatactgtttcccatatggagttaatgtgaaatagttatatcatcatacattaaataaagcaattgattttagcaataaaataactctgcatgtatagatttacatatacatatataaccacaaatacgtattataaaaagttaacagtgtttaactctagtcaaaatattgcataaatttttatttttggctagcctatattttctaaaatgtctatattaatatttatatttttattaagaaaataactatatgcagagtaaacagaacactgcatgatatatacttttagtacaaattgtctttattaatatttctgaattatcaagaattttttcttctctgaatttcaaaaaaattcagtagtagccactgagtagtatagattcatgtgaacaactcaaagattcaagaaatcattttcaggcccccatactacattctaacaatttaatttaaataaatttattggttaaagtattgttagataaatattatttcttatctattcctacttcacatggcaggagtcctagatatgtgttgcttcaatctccgtatgattttgttatcctgctttacgtactgtgcagaaaaataaaactttttatggaaattgatgagtttttctcattcaccagcaaaatagaatgtaaccaaaaaatcaaagcatgatgtttaaatgaagacttattttattctttttaaatttttttgccctaaatttactatttgttaagatagttttatttaacttcaaacaagaaggttttctttttatcttcatataggtacttaaaaagtttgcttctctcatctactcctacgccatttgttctcagacatacaagcataaaccagttccagctggtttagccatttatttttcctcaaatttataacagccaaaacacccttacaccagatttttccaagtgttagatttgtgcccttttaaaattttagaaaaatctcagttgtgctaattggaactctcagtcctcaattatcacctacttgctttctttgtgtcctttttgtctaacaaatacatgctttggtgcttttgagattattaataggattagtaagtgctagataaagctcaaagatcaacagaagtttctctggcacttacctattacctacattacaatactactattaacctctaaggaaaatgaattctaatacattttaattttgcaaaatttatttggtaccatatttttgtcagtatagacaaggatctaacagaaaaccatcaaaactgtattgataatgaatgccaagcattatataatgacaagtaagggacaagaaatacttgtggtctcacagatgagcaaacccaacaactgtgacgtatgttaaaaatgcatgttaaactgtaaaagccacgggagactctagacagagtttaggagttgaaagactttacacgaacttgtgatcccttcttgaaggtgccatcatgtttagaaggtgatgcgtgtggcaggtcctagatagaggagcaggagaagtgaagtcatggagatgggaggagagcaagactcaaagaaagggcaggagtaagttgatgttaggatgatggcacagaaggttagagaggaaagccgacgatgtaagagcccagcatgagggattctgacgagttttatttccagacgagcctccacgtgaagtcagactttaaagagcatgtttactaaacatgaccactctatcgacatccttgactgtatgttcctgtttactgagtaatacatgttgcataggagaatgattatttttgtgaaatgaaacctaggtccaaaacatttcactacaaatgataaatgagacaatcggagactaaatcatctagcacagagaagatagaaaaaaagcaaatccaattcatccttttgttttgttagtgacatattgaaaggtgactgtgctcgggtaattctcttctccttttgcaaagtttcattattccttgttaactttaatgtcctttcatttgtgttgtttctattacatgaacaataaatcatatatgaaacatacacacacatgcacacacatacacatacccaattggtttagaaaatgtacaaaaatcacaaagagctttatccttctcttcttacagtcttggcttctataaagttttgctgcttaaaattcacaattagtgaattgtattgttattaatatcattttttaaaactaattttcattccagcaaaggagaaaataaagctaaattcaatactctacacgacatctaaaatctagttttcaaggtgttagatttgttatggtcatttctatataggttaaatctcatcttattttaaccttctaaaggatttatgtctcaccataaaaaatttcccagtcactgcaaatatttttaaattaggaaaatatagttcatttctcatttatagtttctctctttttaaaaaataactttgaagtcagtgttaactttcattttcttcctataaatttatgaccttatttaagtatacacatactatttaacatactttatcagagaaactgtgcttctagaaagttgtatcatcacatttgtggctaaattaaattatactgtagatatgaaatgtatactttagaagcaaacccaccgaaattacaataataacagacacctcaagtttttatgtatttgtcgtggtaaaatccagtgaagaatattcttaagctgtttaccactagcattgtgccttccctggcttctggaggaggaagagagagagagagagggggagagagggagagagggggaaagggggaggggggagagagagagagagagagagagagagatctttattaacagacacagaactctcctcctgaaagaaagaatttccagaaatcaacatctgcattcaccatacttcttacttagtttaataaaaatactttctaatgatacttctacttcacatgaaatatcttcaataaatgctactatttcatttcaggccttaggtctccaggaagggtcaattttttataactctcatttgggagctttaggctttgttctatgctgtgtgcctggcttagtgcaatgaacttaacactgtgatgttgtccctgtgattactaaaatgatttttttccttatgttcttgaaattgaatctatgttcaactggtaggctcagcattctctacagaatgatgtataaacctgtcattttaaaagataacatgaagaaatctctcaatgaggtcaatggcactgctacctttcagtaacaaaatttctactattgaaatacacttaaagcgtaattttaaatccaaagcagttaactgccattactggaacggtgaaggatacaattttaaagagaaaagattacgtttttctaaatgttccttaaattcttcaataaaacactgctattgcattgaaaagtagtatgccaccagaaatagaaaggatttcaaaaagactgttgttttttaattgttataggaagattttttggacgaatcttgtgaaaaaaaagcacttctccttaacacggtaagactacaaatgaacacaacatctgccacaaaacaaaaggaacacattcactaaaactgagctgtttgatcattttaccaggtatcagaatattcaaaataagagaaacgaagttgagggtgaaaaggaacaaatttaaagtatacgatttttactatacagaaaaacgaatgaatacagatcagcacatcttgcaaagtatttcaggtcattatactttatattgtagcccaattctccagcatttaaacctggacattcattttttggaattatctttcttaggcctaattctctaaagatcttgattagtccgtatcttcacataatttgtagaaaggaataagacaattaaatactactcaaaatagaaattataaagctaaagtctagttagttgttcaaagatatggcattgttcgtttcccagtgtctgactagggaacacacctcagagccagcacagcccagggttaggctgataatcaaatgaactttcaaacttcctctttacctcaaagcaaagtgcatcagaaaactatagaatgggatctttttgtcccagctcaatatttacactgattctgaaattttagcaaagagttatataacccatacatcttattcatagttgttccctttgagaatcagaaacaattcaagtaataaatgaggtagaacacaggtatatttggccgtacatgccatgaagagaactcattgaacacatttaagaagttctaaatctttcatgaactaacgtatcaaataaactttttaaataaaataattaattcagagtttggcaaggaaatagaagtctttttcttacggttagccaaaaattgtcttaaataactagatttcattacactacaataaaactgaatgaaaatcacaagtatgtacaatatacatcatcacttagtatgtcaaaaagcatattaactgaaggagcatatatttgcatagacacatatacacatatattactttttttaagttgcatgtattcaaaggaagaagaatttacattcgatttccaaagcaatggatctttgactggaagtattaactctaccatagaatattctatcagtctattgtaagccactgaatcttcttttgttagttcatttcttcagaaacggttgatacttttactaaatgccaactatctggaatatagaaataaagtgacagtccctgaattaaagaagcgtacattgttagaggagaggcacaaaactacccaaaactcattactccattgaaaattattttttaaaccactgtcttttaaggaattaattcttttacaaatttattgcctgcacagcccaggggtaggcttattatctggatgatctttcatttatttctctttctctctctctctctgtaagtatatatacatacccttagtttaacacagagaagcatgccctaaatgccttaaaataaggttgccagatgaaatgaaggatgcctatagttaactgaatgtcttgtatttttatttgccacatcaggcaaccattctccaaaactcccaccagctactccccacagtgattattacaactctaaagggtagagtgccccagagtcaaaacccaatgagaaaggatgaacaccagccattataatagctgacaaatactaaatacctagtgctgagaaacacacaaactgaatgaagagcttatactctgctttaacctaatttgaatcttactcaattctcgtgtgccctggctagaaaataatttcgttcaaaaataaatttttcatttcctcctgttatgttttagcttctgatttctatcataagagccttaaatggtcatggcttgagctcaatgtaaaatattctgaacacaaatcttggctttcttctttaattataaaaagtgtgaccattatgtagctgttcttgtatatacagaaatattcagtgttttaattaggcttactctactttagtgttaaaggaagcaacaggcctgcgattgcctgggcactaatagtacataatatagccaattgcaaacagcagtctaatttgttgatttcaagtgaagtgtaattatattgcttcatttgctgagcaaatcatacgagagtttctctaaatcagcctgattgtgtaatgaagagctaattacaaacagcagtgttcttgcagtaaatttattgtaagtgctaatgccaggttggctccattgtgacaatggctcattagtacattagcaaaagcaactgtgggaaaatgcccaagcagggctaccggtctctcagtttcagaagctgcaatgattacatccttcaacatgtaattactaagaaaatggtgtttgatttaggttttggcaaatttttaaaaagaactaaaagacatttttagagcaaaatgaaatgattcggaaagccttcttgtcaggcttaattggtgcttcatttcaccaggtgtgccctggaaaccgaatttaacaagaggctcttttagacactaggccattcttgacaactgagttctcacatttcctcatccacatggaatctatgacttaaaagaaatacatacttatatgtacttcaacatatatacttaatacttatatatataagtatatataaatatgtatatacttaatactcatatataaatatatatacttattcctattcctacttatacttgatatatatatatatatatatatatatatatatatatatatatttttttttttttttttttttttctccttgcattgaagtgaggtgagtcaattaagctcctgctagacaaacaaaacaaaggatcagtagctacacatataaccatgttatctcacatcctaatgtctagggttttttattctaatgaagtggaaatacctgagctttgtgtcttgaaacagccccctactccatgcagctggattttataaactaccttgttcagttgagccagttggtcttaagacggcccttatgccatttccctaccttcaccttcagagtaaccaaaactgctcatcaatctcttccttttattgattttttttcatcacaaagttttatttatctgtgcttatcctaacatgaaactttaagatgcagacttttctagaatccttaacagtttagtacattgcttcataaactttagtagggcattcacggaagagccctctcccaaggatattgatagtattgtgtctacaactaatgtgttaattaatttttcaaataaatttaaatatatttttaagtaatgttattgaatattcagtcactatgccctgaaatctaaatctagtcttattgatctctaaacactttgattctctctcctaataaggaaaaatcataaataagcagacatgcaaagtttcaatgtaggctaataggtataagtgtataagtattatgtatatattaataatacacattttatctgtctctgtttatttacttatttatttatttgtttatttattttgagagggggtcttgtagtgttattcagaatgaattcaaactcctgggctcaagcaattcttctgcctcagccaagtggctgggaccacaggcatgtgccattgcactgcacagaaatacatatattttagaaattaaaaattaagtcagaaatatattttagtggataaattataaagtcaaaaatgcatatgcatgctaactagaaaatttaaataatacatatatatataaatgatgtttgtatatacaaacatactcattgtcccttttatactgagaactaatggctttagtctattagctgcacaaaaaatattgtcttcaagagaaaaaaataagactattgaactgaatatcagatagctattcttctgttcctaaagacctaaccataaaacaacttagttgcctgagttcttacaactaattagtgacagagcagaactggagatatttattttctaatggtcagcccacttttctgagtttactaggctaaatttgtcatatattgtggcctctatccaattttgtatcttaaattattgctataataaatatcaatacttttcaaattttacatcaaacaatatttctttcatcctttagatttaaaaagtttatttctatttttaagtttattcatagtttcaataattcaagatgagaaccaaatattaaatagctttcgtgtctttaaatgtgaattaacgtccagtttatcttgttctctatcttctcccaacaaatgattacagaaatcatctgatatctatcattatctcttttttaaaatcattttaaatgggtcaattttatttatgatttgtgtgtttaaatttttattattacatctcttacagcaaaatttatagggtttccaagatctttcaggatcatccaaaatgcatataatctaattctgctttttatattcgcactttatcattgctccatactcatgcttcaaatcaatcttttaattttcatgtttatgattgcttatcatattatccaatatgcacttcacaggatcaataatctgatttagggtgtaagcaggaaaactaagtgaatggcagtaggccaatgattaatgatttggtccgtgtagaaaacaacatttattcaaaaatcacagcaatgaagtaagctgaactaagtgataaaaaattcatgaagatgtaaaattattcaggcatgtggcagattctgtggcaacaatgccacaaacttatattaatgtctactatgtgcaaatgtagcatttctttcttgggcattactgtcatttcatatatcaatgcttcactgttttgatttgtttagaatctatttgaataactctttgtaagatattgaacttcatattggggaaaaggatcaatcattgtataatgaattcatttttggattatgtctacacaacgaaacaaaatgaatatttgctttatttgatgattcaggcacaaggtccattgagtttgtgggctgaatgattacatttgactttacttgaagtaaccatatacatcattaaaacacataccggttttttgtcctatgcagaattagcctcaataaagagaaaatggaattgaatgtttagctaattccatacaatacctatgctactgtataatttataagcagcgggtagcctaagaatataatgtttttcttcaagattaatgtgtggaatacaaaccaaatctttcttctaagagtataacttgccaatatattattttgctaaacatttttaaaaggattattgaaacggtggaaaatatatagaaggccactttaggaaacactgcctttttcttgctaatacataaattgtagccatttgttctttttgccacaacctttggggattcgggtgaaatacttccttcagaatgtttcttggcatcccttatttttattgacccgtgaacttgaaagtctgtcataagatattattatgtgagaatagtggaaatgtattccattaaagcaaaatctctatatacagaatccattcgagtgctatcatttgtcttctctatgaattttctatctcaaataggaatgattgtatgcttaatttgttatttttatacctatacctgtacacatacagatataactgatggtatagtatagacttttagagaatgaaaaaggcctgtgtttgggatttgaataagtcccaacctatattagcatataagcaaaataaatttaaaaaatatatatctgtgtgtgtacagaagtagacacattttatcatatatttacatatgtgtgacataaatataaaatgtataaaaataaattatatatttgaaatagaagcaactctacacatgcacattattatgccttccctctgctgttcttctcattttttttttcagattctaccctcattgctgaacccaaaaccataaactatttgaggtaaatgctaatcatttgttgaattaaactgatgttgttagtaggcgaggaaatactcctctgttgttgctttagtagaaactgtgggtggaaggacacaggagaaaccactgctccgatgacttgctgacactggctctacttggctgtattccacttttatgactttaagatttacaccaacagtttctctcatccagaagtgtatttttaccaatagaaatcttcagaaactgaacagtgaaatgcatcaacaaattatgttcattattttgaagttagtagcaaatgttagaaatcacttactatacactgtactctgttccttagtattattaagcctttttaatttaaaagatattgaatattttcagttctaaaatattttattaagagcagaaacctttaaaatcttgttattgctactcaaaaagaaaatatttgtaacatctgctataactagctttaaaataggtgattattagctaaaatgcctggtaaattattttcaaaacatgtatttcagttgaagactaaattagtgtttaaagcagccaactggtgatttatatcccaagtaagatattccaattaaccagcagttattattgatgctactagtaacaacaataatcaacagttagacaaagtttggtaatagattttttagggaccccattatcaatatatagctcataggacttaaagtaattacaaataattattatattgactaatcaaatatctaattttttgtaatgcatgctactacataaaacaataactggattttatagattattagcctctgtactgctttgtgtagtattgcctattagttggtacttgttcttagtctaatgaacttacaatcacaagacatgtaattctgaatttgcatagctctaatctcatgaatatcaaaatagaaacttcggatatataatactaatgagaacatttcaatgaggaaaggttactataaaatataaagtagaaaaattttatttgaggttacattccatctttccatatacatttcctgatgttggtatttaatagctaaaacaataattaacaatttttggatataattaaagcaattactgtatagtagctagacctgcaggcatcaacatcctttgtctattaattcaaagtggccaggtatgacttttgaacctgtattttaactgaaaagaaagaagttcacatttgttgagcatctataatgtgctaagcactgtgttagatactttttgtagactatcttgattaatcaacacatctattatgtgaaacaggtagaaaccaaggtttataaatgtgacaaaaatttatttctagatttttctacttttacatgttatgctaattattctagaatactcataagaataaatctttattcattaaaaacaagataccacaatcactttcaaaatttaaattaaaaatttttattaactttttgttatttgaaatagcaatatcctggtatttttatttaatgttaatgaacttatacatatcatgaagcttattttactatgtattttttccataaaacttaatttactttttggttgtgttaaatataaataaaatttaccatcttaaccatatatatgcagttcagcaatattaattacattcacattgttgtgcaaccaatctccagaactctattatataattttttaatttaacacctgaatagaaataaatttagggaatacaacaggctcataatcttggttattgctccgaaaaatatctcttaaaatattattggtctttatgtgaggcaagcactgccataacactgcattgcagggagatttagtttatgccaccagttttatataggaaatgtgacttactaattagctaactgccttaatgtctgggtgagtcatgtcatcccttatggtctgcaaagttattcaatgaagtaattttctaaccagaaatgtaactatacttgtttggtctcttcaaagaggtcccagaaaactaacttaataaataaataaataaatacaaatgcatctggttttttaagtttactttggtaggtgtagaaatacaaacaccatcagttaattgtactgggcttttttattggctcttttatttctcactttattttctgggttgctttatgatgttgtgacacaatgattttccctcctaccccctcatgtcaacaaagtttatagaaaataaaatatctttattgttatataacagcacagcaggcttcacatttattatggaactaaataaatgcaagagtagcttttcactttaggcaaaacaagccacatttgaagagaccctgggggttaaaatgtcacagattatgtacattcgtaaaataatttctgattaaatgaactatgctacccccatataaaaggaacaactttttgattttttctgaattttaattgtccttaatatgtaaacatgagtgtgtttagtcagcaaacatgaatgtgtgtttgctgatgaagtagttacattagggccaaagggcttttaatggagtaagaaattggtgaagatttatatgaccactgtggaatatgctcttgttatggaaaatgatacctgcctctttactaaaagaaaaaaaaacaagattaaattaactgatattggtgatgtcgtaagccactaatgcagagtttgagtggtttagaaatatcagaggaagctggtaatgcaattactacattagcatgcagttggaatctggttttcgcctgcagaataaactccaatgagacatttatttgtccttgagtaatgataattgtgactaagtttcccacctgaaagaggctttcagtgaaattgtcttttcacatattacatggaagaccagatgtttgaaagcaatgctgatggcgtgctttctaacctttttcacctcactggacatgttgaaaaaaaaaaaaaagtacagcacactggaatatacagaagaggctttttgtagcctcttccagttgtcctaagggctgaagggacaaaatcttggcttagctgcaacctgcctgggacacaccagtatgctatggaacataaattgagaaaatgtatacagcattcatttatccatgtaacatatacttctttagtacctactatgtgccagttgctttataggccctggggataaaatagcgagaaaatcagacaaaaatccctactttcatggcgtttatattctggggggaaaatagaaaagtaaaaagttaaataagggaaatatagcacattacatggtgatactcttaagaagaaagaaaaaataaaacaaggagtggagcactggaaatatattttatttatttattatatatttatttatttttagttttagttttttaaaaatagggtctcactctgtcacccaggctggagtgcagtggcacgatcacagctcactgcagcctcaacctcccagagttcaggtgatcctcctgcctcagcctcccaagtgcctaagactacagattcatggcatcactcttggttaatttttctatttttaatagagactgatttgccttgttgaccaggctgatctagaacttctggcctcaagccatccactcaccttggcctcccaaagtgctgggattacaggggtgagccaccacgctggatggaaatattttagataatgagatcaggaaagccactgcctggcatgttctcttggttaattgtaaggtggctctctgtggttcttttatctcaaagcaccatttatgccaggagcagggctgtgtatcagaatcagcattagcagaaaccacagatagcataacgcaagcaaaatatgcttatagaagtccagatatctacagacttttagttaagacaccttagataggttttttagagtttagttttgaaatattttgatagctaaactttctttttccaaatgaaatcatagatgggcacaatgtaaacaaaaataatacagctcagtattaagcagaaagtccttcattgcttgtgaaacctggaaatcaattatttcacacccttatgattcttagagacatcatttagaaaatttattcattaagattgtttttaacaacaagtaacaaaaaaatccagcctcatagtcttaacatgtttttgctcatataacaaaatcagaagataagtggaccaataatgttaaactgatacctccagattctcctgtcctctgcctactgctgactgagtcaaaaaatgactattacagctccagaaatagagccacattctcagcaggaagacagagaaggaagcagcagtgcctgtcatttcaaatctttcatcaagaaagaaacatttttcagaagttcctccatccccagcctcagaagactcccacttagttctcattagccagaagtgaatcacataactattcatagccgagtcaaactggtaaagcaaagaacagggaaatcctgattgacttaaacagggttcatcacatgggactgggtttctgccaccccaaatgaaagtaagtttctgtcactccaaagaaaggaaaaaagatactgcattggcaactaagaacatctaccacaagtagacactctataacagatgtagctccacttttgattacagcgtcttgattttgaaattgcatttacactctggcaactaatatcataacattgccctagaggcaattctaacgtaacataaaaattgggtctagcaatgcataatacttgaaagcaattgttcataagcatatgccataataacaaatattcccctgtaggttttcaaaataaatgaaaagagatgcagatggatctgttttacagccaagtatatttccacatggcagcatgaactgagattaggcataggaattaggcttttatgatgaccaaaattgtatgtgctagtaactctacttgacattaaaggttgtaatttatcttctttgtattagtttttttttttttttttgctatctgtgaaactggaataacattctcatccttgtagggatcatatagattacctgaaagggaaaagtgccctccatttccaaagtgctcaataaattacatgcattaaattgccataggtttgtttgacacatcagaaaaatttcactgtttttcttaagattccctttccatttatctttatttcctgatctttccccaaatgtctaagaatatgaaaagtaggtctgtctttcactgcctgcatagaagatagactttatctatatcaattttgtgaactgtgaaggaactttatgagcctgtttgtttggaaactgaatcacagggaagttcggtatcttcaaaaaataattgttaatttatagggcatgttaaggtgtttattatttcttattccatttgtttcctcacaattaatcctaatttctattttcttacctgatcacaaggtaagatgtattgatatactagaagcacccaaactagtagtcataagatattagtttaatagtggcttatcattgattagctctgttaaccttagaaagtcatttaaaatctctggacctcaactttctcatttacaaaaataaggtgatgctatctttgctgcttttcgtacagaattgccatcatccaaaatgtataattatattttccaaattccacatatttccaacttatatgtgtatacacaggcagatttgatataattatgaaatgatttatatctctaaacccaatatgttcaataaaataaataatatttagcatccccagatgctaaatattcgctgtagattttctttcaatatagaatgaaggataatttgatttgaattttctatcgtatttcattcacacgatgatctgtaggtttattgtcaaatagagcacactactcttagcggcacactgtgggattcaattttctgtagattcctagtttttaaaaacaatcgcatttttaaattgccagtcatcagaaccaaagtcctttcctagaagttcttgaatctttgtgtctttgttatctaaaacttaactccgtcacctactgaggctatctcaaagcactcagatttaagtaggaagactttactcatcatatggttttatcctgaggcactttagtcaattgaaagggttttgttgttgttgttgctaaattgtgtatcacagccttaaattgacttttatcttgagttgttttaattaatgtgaaggtattattgagtcttggtcaataaaagtctcttacaataacatcctttttttcactttgcatactcacacatttctgatgtctctatttcttttaatttaggcttgttgactgttaaattctttcttgtaatactgtgtcaaatattatcaatagcaacctttgcttgctattaagtttctatttccagacttttccccaagaaatgaactttctgtcgtcaaagtaattacagaaagcattttgaccaaatattttgctatcggtttacatggctgagcaactttccaaaatccaaaagtaatttgttcacaactcatgactcaactgctaaggcaatgcaattttgtctagaaattttattagagtctttatccctgaatcagtttcagtattagctacacaattaacccccaaatctcagtggccagtagcttatcacacagaaattcatttcctcttcatattctatgtccagcacagccatgtgagggattctactccacacaggcactcaaagctccagtctgagggaggctctgccccttgtgatgccatgcagctctggattaagtactcatggctttttgccctgaatggttataaggctcaaatctaactaaaacgtaccctgtcgaagaaaaacgacactcactgaatattctgtgagtacttttgtctttgccatgtagcaggaggagctgcagacaagaacccctcagacaccaagctgtggaaggaaagggctttattcagctgggagcatccgcggactcacgtctccaaaaaccgagctccctgagtgagcaattcctgtcccttttaagggcttgcaactctaaggggggtccgagtgagagggttgtgatcgattgagcaagcagtgggtacgtgaccgggggctgcctgcaccagtaatcagaatggaacagaacaggacaaggattttcacaacgcttttccatgcaatgtctggaatctataaataacataactggttaggtcaggggtcgatctttaactaccaggcctggaacgtagcaccaggctgtctgactactgatttcatttctgtcttttctttaactcctactttttctttgaggcagaaattgggcataagacaatatgaggggtggtctcctcccttagccacattcacccagatcaatttgtatgaaggtctcgaaatgtatggggatacgattcaataaaagctcaaagaatttttgctttaaaagatttttaaagaatcagacatttagagtgcaggctcagaaagcacaacattagacgtaggtgaagaaataaccttattagtataggtctccttaacacctctagcttaaatggattttaaatcaggaaaagaaaatatttctgaattgtcaaggaataacagtcttcaaaactgattcaaatgtagtctaacttttcaaagaattccggcttacatctagacatctgtgtctccttgtcatatgtgataccacataaaaatagtgcagtaagatattctttcaattgtgtattttagaagagataaacgaatacaatgaccattactgtactcaatttttcactcttcatttatctaagtgtacatatttgtaaattaagtgagaagcccccacctttttcataataataactaaaatcaaggatatttatatgtgccaagcacagttcaattttgtttttattgatactttttattgatataaataaagaggattttaattcatattagatttaaatatataaaaagtacatacaagatttaatttggaatgaacattttttcctgtaatgaatattttaattaagttaataaacccttaaaagtagagatgattatagtcatgtaaatgtggtttaaaaagtagctgatgacacttgagacacaaaacatttaatttaaaaatgagtctcctttcacacttaatttctttttgtcattgtcttttcacagaaattaaaaacttgtataaaaacggggtaattgtttccttcaaattcataagcttgtgttttataatctaccataaaggtttcagtccatggtttataagcttataattgtttgcagtcactgattataatttcatgaataaaaattgctttaggtaatcaatcaataggaaaacattatataaatccgacttttctcataattggctttatagatgaagtatataaaaaagtgagaaaccttaatattgtctaaaaactcggtcattcctgactctgattctccttctgttgctttatgtgtgtgtgtgtgtgtgtgtgaaccaatatcctttcataatgaaaaaatcattttttttaatgtagctgttctttttgtttctttcaaagacccacttcactatccaatgaaagcaatctgtggccctcattctccaagggaaattatgcacagaattcaagcctaagacctcagtttgttgctagaccctggctaaatatcttttttcaaataaaatttcttaatttgtctgtttatacttgggatagatgatgcttcttcctctgggagttcgggaccagcctggccgacatggcaaaacttcatctctactagaatacaaaaattagccgagcatggtcacacatgcctttaattccagctacttggaaagctgaggcaagagaattgcttgaacccaggagacagaggttgcagtgagccgagattttgccactgcactccagcctgggtggcagagtgagaccctgtctcaaaaaaaataataaaaaaattaaaatttaaattgaaaaagatattgcgattgtttttctgtcactagatagttgttcttgactttttgtatgctgcttctccatcttttggaagagagtatcaagtggaaacttaccattctgttgtgtttgtttttagcagttattttgaatataatgctacagcaataattaaaaccacacctatgcatttgatccatgaaaagaaagtttctcagcactgctgcagttaagtatgaggtttagagggtgaaaaattactcaagtttttttgagtctgtttcatttttgtgccactttataatacctctatgactttcagatgtagtcagcagcttcaccccactaagcgtcattaatccttctgtgctgaacattttgtatagtttacaattgtcttactctttacctaatgcataggcaaacagacaacagtagttaagacaccatagcaaagttttcactatgccaaattggggtaggtgatgtatttcatttattggttcttttattgttgtttaaaatttaaaaagtaaaacttttttttaggttaaaggttattttcaagatgtttgcattacattcagcttcttctatgttcagcaatattcatttcttaccctctcattgaagaatagtgtacttttctcctacattgatgtagggcttggccaatataacttgttctgacagatggaatgttagcagacataacccagcagggccttaaatgtattgggatcacatgacttggcttctgtaccttgaatgacaactgtatgcccctttggtctgagctccaaaaccttcacatatggagcagatctgaacccatcctatagtggggaaccaagccaagtcaacccacagcctgaggctgagggaatagccaaatccagcctagatcatccaaattacaatcaacctgcaggcttatgaccaagagaataaatgcttgctattgtaagtgactgcatcttggagtagtttgttataccgtgtcattgtggcaatagccaactgatagaacatctaatattagcattcttgcatgttttcattatactccgatacatgggtttaacaaatcaatctatgtgacaaaggaggaagattatatccacattaagatgtacacagtacagtgatttccgattctcaacagcattgtccggagtcatcaacatttttatttaaaggtgattgttttcataataacataatcattgaatgtcttaaaggattattaaaatttttaaaaagtagttttctacgagatttatcaagcaatagggaacttttttagttatttgttttcatatcggaagttttactatgaaatcaattaatcaattgaccttttatcccttgagaactttgttgttactattgtatggatggtggggtggtatatgtatatttgcacctttatagtgtgtgtatgtgtgtgtgtgacataactttgtagctagatatgttcttcaagacaaatgaatttcatgaatatcgagaattttttcaagaaaataaccctaatatgttacctaacatcctgttgattaaagaccaggctttcaaaccaaggcaacctaggtcacagtcctggcatggctctttctggctgccaactttggtgataataatgtttagctcataggttcattgtgaggataaagtgtgatcgtgtatatgaggcaaagagcagagtgcctggggcacagaaactgctttattaaatatgattattttagttataatttattggatattttcgatttctttctttcaaagacatcatctgccttgtaatgtctttgcaacatttaatatatttagcatagtgtgaggcactttggatgctcattttttacaataatataatagttacacaaacttaagctactgcccataaacgtttctggagtgactttcgaattgaggctttatgaagttaacaaagaagagtttatagtataactaaaattgcaatgagaagtgaggacgacatacattttaatagatgtaattctgttgcacactgtaaaggatgtggtgagagttttgtgtctgtctacctccttctcacacataaatttgagtgtgactaagagacatgtcccagctaggctagatcaactgaggacctctctcttggttcaatgtttatttgcttacttttatggcatgctttcattgcctctggcttttgtttatctgtttgtgtcagcactaactgcacaaaagtttcagaatttcttcaaatatcatttatgttttgattctacttgattctagacatttgtaagaattttgtgtgaaaaaacagagggatgttaattttaatatgtccttgattaaagactaaactttggatatcgtaccattatgtgcttatttatggaagtctacttgtctacagtaatctgttcaaaagtgagccatccattttactaaataatagaatggaactcatgtaattttctctctttattgagtttttacagtctaggctcattgtcatgagtgagaatttttctagcaaaagaaagtgacatgaatatcgtgataacgagggtcatttcagcttacattgttaagaagattccccttctacatagcattagggatagtccgtggtgtagcaccatagcacatattgtgcaactccataaaaagtcccgtattgggagcagtaactcccagatgttatttgtaattgcttcacagcatagtgaattctacacaagcaccacatggtagttcatgcagcaggaagttaaaggggaatgtgttttttaagtgatttagtatgaatgtaactacatatggagagtaataggcaaaggaaatttggaagagattgaattagttgtacatccttcctggtgacattctcaatgagcctcaacatgatggtagctctgaatgtctcatgtactctacatccaaaacggctcagattagaagagaaaaatggaaaaccttgcaatctaaactttatataatattttaattgctccttagtatatatgagttcaggcaatgttgtaacatattgcagcactatttacaacagcaaagacttggaaccaacccaaacgcccatcaatgatagactagataaagaaaatgtggcacatatacatcatggaatacgatgcagccaaaaaaaagaatgagttcatgtccttttcagggacatggatgaagctggaaagcatcatcctcaggaaactaacagaaacagaaaaccaaacactgcatgttctcactcataagtgggagcttaacaatgagaacacatggacacggggaggggaaccagggcctgtcagggggttgggggcaaggggagagagagcattaggacaaatacctaatgcacactggacttaaaacctagatgatggtttgacagcagaccaccatggcacatgtatacctgtgtaataaacctgtactttcagcacatgtatcccagaacttaaagtaaaataaaataaaataaagtaaaaataaaaaatggcaggatatctctatccctgtcagagctctgatactgtataatattgaatacatttgcctctaaatttgtttcctaatttgtaaagtgaaaataatcataatttacaccacagaagttaacagataattaatataaagtaggatagttccagtcatattggtgctcagtaattgatagctataaacattggtgccagaatatgctgtgtgctataatatgctggatacttgatcacataaataaaattgtattgtttgtataagtattatagaaaacttttaatggctaagagagaaaaataagggagataaaataaaaaggatgagaaatatatttataaattcataatttatagatataaatatatagcaaataattttaataaatgttttagagaaaactgtaaaataaattcttttaaaaattacatatgtatataagcaataaaactttaaataactctacataagaaatgttctttcaaaaattcttgaggatgtttcaggtagttctccatgagggattagtaataaaattctgttgaaataataatgaggaacacatttttttcctgacatttaatctctcagtaacaggagagagctatattgtctcccatggctcctgaatatttgcccccagacatgcataaaatagttgtcatgtttataaattcattctttgttgttatttgaaaggcattaataatagagtgaagaactatttttgaaccgtttctagctgtgtgaaagtgtgtttttaatctaatcaaaaaattagatgtcctcaaatgcacttcttccattgctgtctacttgtcaatttctaatgaagaccaaagaaagttattcactattttttgtgcctatactttgcaattccttagcatttctgaaatagcttttcccctgcaacaataacaacctcatagaatgatgatttattcctccactagctgtggcttcattcctttgatgttttgcagcaaaacttatcaaatagttgtgtatattctctgtctccaatttctcttctggacttctctcttgaaaatacttaaatgaggcctttgccctcattgcactttcatctgttcttgctaaggataccaaatggcttcatgttgctagatcctatggtaattctcagtcttccctttgcttgacctatccacagcctattatttttataataacaggttgacctattatttgactaataagttttcttcatttggttacaggaatgtccaaccgtcctgatgttcctccttctagtttccttttctggttcctcctacactctgccacctctgattgttgaagtgtcccaagacttcgttcttgatgtctttttcttctgtagcttcacttagtcccttggtgatatgtagtctgctgactttcatgtcatctagatgacagagactccaagacttttatgtctagctcagatcttctcccaaaatccagactcatatattcagtaatgtatttgtcatctccatttacaggtctaatggataatccaaactcaacatatccaaaactgaattcctgacccttgttccaaaacctattctgccacagcctttcccagcttgattcatggaaactccattttccagttgcccatgagtaaaaccttgaactaatctacctcttccctctattgtacattccacacttatttccggattaagtgtaggatgtacaatagagggaagaggtgattagttataaaatggtaaaaaccaaattgacttcctgttgtctacctctgcaaatgaagaataccaaagtatagatatttctatacctatacctgtagaaatctctatactttggtattctacatttatagaggtagacaccaggaaatcagtttggtttctagcattttaatgcaaaatcccatcacttcttgccacctctacatctccactctagtctgtgctaacatcattctctgacctgggttatgcaataacattgtatctggtctctgagatttcactcttttcttcccagtcctttctagtagccaaagtggttctttaaaatatgtcacatcatatcatttctctgtgaaaaacccaacaatgtctctgcatttctcacagaacaaaagccaaggtgcttatggtgatccatttggcattacctaatttgccccctttttttaattaactgcctgacctactctctgacaactcttcccctcattactgccgcagtcagtacactggtgccttccttatccttgaacctgccaagtgcattcctgatttacagaagtggctattccatgtatctggaagcctcttctcctaaatatcctgataactaatattttcacctcctcaaaagcctaccttgactacattatttaaatttgcatcctgaaatacaacatcaccctccacttacgttttagtaatatttatcattgcctaatatatcatgtatttacttacttataattttttcctctactttcctgctagaatgtaagctctaaaaaggtaaacatctctgtctattttattcactcatgtatactaaatgcttagaaccatgcatagtacatagtaaccactcaagaaatgtttgttaaatgaatgaattaggtacagtaagggatagtttgatttaatggaaaccactgtctcttacaattataaaaagcaaagcaaaactatagtaagcaagatactctatatccgtatcttgatatagagcattgaagcattgaaggcaagttacttacatgcctcagctttgttgagatacaattaatgtacaaaaactatacatatttaatgtatacaaaaaaagattttgtaggtgatggagatgttaattaccttgattgtggtgatagtatcatgagtgtatatatatatgtccaaactcaccaaattgaatacttttgatttttgacttcagcactaatgctgtgcaccacatactaagaacattcaactatgcactgaattttaacttgtaaattttttgattttgttattttttaaattttatttatttttccccttttctgtggtgctgataactttgcaattattttgaatattttacatatcatgagactttctttcataagcttagtttttgacaaatggattgattgatgaaattgtataatttaatggttctacacattctgcatgtctgtatttgcaatatttgcagtagggccaaattgtggcatgttaatatacagaaatttgtaataactgtaatcattagaggaagtgttttagtgacggtgagctaactattataaaaaataaattaaaactataaaaacgatttaaatgtaatagaaatgtgtttctaactcatgtaacaaccaagatgcctccagttcagtgggcggagggtatggagatgagcggctgctccatgcagttattcatggaccaggaggatagagactcaaacattttcagaactccacggttgccctgatatcaatatccaactggcagagaagcaaagaaaggtttttatggtccagaattggaagtgacatatatcattttagctcttattccattggctagaactcagtctcatggccatgaccaaatgcaagagaggctggaaaatgtactcaaagtatgtgttcagaaagaagagatgaaaaaataaaattgttttcaatgactagaaattttagtcatagaaaactatgcaagtttgtcatctcaaagccagatgtagggaattctagtttatttcaagcatcaagtgtggtaaggaaaataaaactcccaacattattatgagctttattgcatcaaggttatttttctgcagtgctgacttatttggaatgtgaatttatgcatatactacagatgaaaagtatcaaaattctaatatgtctgtatcttgaaataatgagtactacagtatagcacatatattggacagaactagattcttttctaataatatatgtgaacaatgcatcttagttatatctatactaacagagatacgctatggcacaaatcacacaaaggtatgcaatgaatatgatatcctactttcctttctgcagattggtggaaatcaacaagctgaaaaaactaaagttcaacatagtgagtaacttaaaagtcataaatttcttcccacatgttttcagagaaggcatgtgcatatgtgtactatgttcttgggtacgacattaatgatgaataaataatcaatactttttgaactttatggagaggaattttattgaatgagttaatatcttaccaaagtacacactgagaaatggggaacaaagaaaaaaattggcaaaacccctttgagatactccaaattttatatgtaatttgaacaagcatgactgatgctgtctatcacagaatacaccttctcataataagagcaaatagtaccctagaaatcctagaagtttgtggaatattatagagaaatgaaaattggtatggcaaataagtttagggattcatgttctgcttacatcagagaccttattaagtagttaattaattttattttagcaaaataaaattatgctatgtttaatgtcaataaagaagaaaagaaaacaattctactgagaaataattctagtatcaaaccattctatgcatatgttagatgaaagcctaaaaatactctggagtaggcaaagttgtggattttaaaagaatctgtggacttatagaaaatgtgtaatttgaaaataaagtagcatggtattctccttgctctgattgtcttttagttattgaatataatttcctttgtattttaaatgacgatattaaaaggagcatgaggattttatatttatcacatggtggcatgtgttttcagacaacaaataatattttttctcttcctttggcatgattataatataatagaaagatcaggacggcactcaaagactggttctttaagggaagggatcatgtcttctttgtctctatatcagtatcttgtacatagtggctttgtaactttactagaaatgtgatgaagcttctttgagatatatttagctattcaatgaggataacaccacaattaattgttaaaacatctatgaaataacattggtgaatctgtagtccatagcagagtttttttaataacaataaatagtaaaaccctgtgttgctctggccaagaacatttaacaatatcacacaaggactataatggcaaccacatgggagactggctttcagctttcatccagtttctaaatagtatccccggcacaaaaacagctgaattttaaaatgccattccattattatggaggaaaagtaaaacaagcaaaatagagaggcaggacacagatgcatctaaggaagagagatgctgaacagaacttcagatccatgcaaacagaaataaacaagttagcaatttgtaacaagctgtctgccatttacaaagtacaggagggaagcatggtttatttaccgatatagctaatgtagaatctgaccttatattgaatgttgattcattactgacatccagactggattttcctctagtaaaaatagcagtgccactaggctgaagagaaaatagcatgggcaaccacagcacagttagcagaatctaggtgacaaagcaagaggaagtcagactggactggcacagaaacattctctagccaattcttatgtaaggactcttatatatatatatatatatatccaaatacattatctcgtattctgtgggtcaatgtggttatcaaagtatcattttatgtacagcatgtatgtaattatgcataaattaactgaattataaattatatctcattcatattctgtagtttgagataagtcattcaaccaagtcttgttttaacttcataaaatgcaaagttttataagagagagaagaaaaggaagacagaaaggaattagtctgcttcacgctgctcataaagacatacccaagactgggtaatttataaaggaaagaggtttaatggattcacagttccacatggctggggaggcctcacaattatggcagaaggtgaatgtggaacaaagtcacatcttacatggcagcaggcaagagaatgtgtgcaggggaactctcctttataaaaccatcagatctcatgagaattattctctattacgagaacagcatgggaaagacctgcccagatgattcaagtacctcccaccaggtccttaccagggcatgtggggattatgggagctacagtatcaagatgagatttgggtggggacacagccacaccatatcagaagggaaggaggaagtaaagaaacaaaaccagatgtttatgtgtcagacatgttaaattgtgctcaataatgttaggaaaaaatattattaaatatacaacaattaatgaagctttcacatgctttaataataaatagggaccaacagcctattttaaaagagatattaattaggttaaagtcccagaatgaactggaaccatgtagtttcacaatcattgttgaaccatgtctgaactttttgactgtgacaccgctatgcattttgttggtattaaaacaccgtaactatattttgaattaaaaacaaagataccatcttaacagataaatatttttgagaaaaggaaggacatatttgctggtttattgcacatataaggaaaagatattttactgtctatcaataaatgcaggttcctttgaaaagagcaaagagagtgtcctcatcaagataatggagggtagaactaatttaccctgcagtatctatttgttgtctgggtattctttggcaaagacttattaaagaagttgagaaagtttggcagacaaatgcattatgttaaattacttaagcatacatcatttatgatgtgataatttcagttaccatagatcattaaaccaaaatttttagtataactacttttgaaatattaaaatataaaaatgtcatttatgttttcactgttcagtaataacagtttcctaaataccttttaggtagaaataggagctagttaagacatgaattttaggtagatagatctttttgtgaaaattagtaacaaaataataaaatcagtatatctgaatgtgtatgaaaaatacaaaaagtaaaatggcgttaggaaactgacaactatttacttgaagagtccataaaatctcctttaaattgggagattaaaatgtaaaataaagtattatgacacatagtatgattattagagactctctaacaaaattgcatccacagatgcttgcattaccatcagtccacagctatgtcccacggaagggcaagcagaggctaatagctgccaaatctcttagaggattatttgtctcattgatcctgaaaaatgtatatgccattttgtctcacttcaaaatacacttaagtcattttatgtccttttaccttcacatcatgttctctgtaatgcaggctttgcccttattttaatttgaaaaactgaaacggagatatagagatagaaccaaagaatcaaaattctgcacaatttttttccaaagtattctgccatcaatgaacgaaaactaaagtatgtttgttaaagaatcagtagaaatagatcatcagctgtcagattcaggggtctgactctttggacattgccttagtctaagctgctataacaaaatgccataaaatggatggctcataaaaaacagaaatttatttctcacagttctggaacatgggaagtccaagatcaaggtgccggctgattcggtgtctgctgagatcccgctttctggttcatagatggttaagacgtcttctcactgtcttcacctagtggaagaggcgaacaagttcttttataaaggaactaatcctattcatgaaggcatgccttcatgagctaatcacctccccaaagccccacctctttattttattttgttttattattttattttattttatattattttattttattttattttattttattttttgagactgagtctcgcactgtctcccaggctggtgtgcagtggcgtgatctcagctcgctgcaacctctgcattccgggttcaagcgattctcctgcctcagcctccagagtagctgggactacaggcgtgcaccactacgcctggctaatttttgtattttcagtagagacagcatttcactatgttggccagcctggtatcaaactcctgacctcatgatctgcccacctcggcctcccgaagtgctgggattacaagcctaacctcttaatatcctcaccttaagagtcaaaattttaatgcatggattttggaagagaggtacacaaaactagagcatagcagacatattctagggttttactattacatcaggcaatctttctatcagaatcacttgaacatattctcttgatcaggtatacttgacacagaatttcataatgtaacctatgctaagatgtaggctttcaccttagtcttacttagaagaagataaggaggaaaacaagaaaggaggaaagaaatcctcaactacatttgtaaaagtttgggaatagtataatctatagtaatacacaggagaagtatgaagcgtatttgataaaactacatttttaaaatgtatgatgaataataattgtctataaatactgcaaatgggttagatgggtatcatgcctttgcttatctcagaaattcataccaatcacctaactgcttcaaacagttttctcaataagtgaggtattagtgtaaaaactaatagatatgatatttaattttatagaatttcttacaacttagtatgaatgcgattttcttgagcaaaatatatatgtgtgtgtatatatatatatacatatatatatctgtgaagtgaaacggagagaaaatattaaagctagttgaccataaaagttatcattttatgaagctagttcttagaacttgacagtgagaaaggaatttgtgaatgtgtctgatgaatctgacacagactattctaggtgctaaagactacatatggcatgatgtggagaggggggtaggaggaagagagatagagagacagaaagagagagagagaattccttgactacagtgaaatgacagatgtgggaattcacctagcaaataatgatctgttgaaaaatcagaatcccaaaatcgaattatagaaagcgtatctctaaatttcagagaagaaacagagcgtttcagtagtgatatgattcccagaaggataagaagtgaagactcaagtaaattaattggttcacatgttttataagttataatacatgaatgtcagcatacattattatctttaaagtttggtaatgtggaaaacaagtatctttaaaaagaataggagacataatgagatcgtatctctaccaaaaattaaaaaaaataaataaattagcttggcttggtggtacactcctatagtaccagctactcgggaggctgaggccagaggtttgcttgaacccaggagtttgaggctgcagtgagctctgatctcaccactgcactccagcctgggtgacagtgaaaccctatctctaaaccaccaccaccacaacaacagtagcaataaaagaatagggaaaattattttatgagttgaaataggattattaaaatagccctttgttattccaattcacctcattaatcataaactagcacaatcttattacaaaacaggtgtaattaaatacctttaaggaaatgtgtggagaagcatacaggcatcatcagaatacatttgactttcttaaagctattttttaaaaagagttattgcattatacttattttttcttttgtttatgatgtgatatatgaattttgaagttggcaaaataaaattaaattctgccattaaattggtaaggttttgtgtgtttcttagtcatactctattctacaagttcctgtattccccaaacaataagtagatttgaatagatttccatattctaattataccaataactaatgaattcagctattacttacgatgcattccaatcagaaatgtcactgatgtcaaacgcagtgtcagggaagtttctctggtatttgaaggtactgactactcacattaatcaaaataatcgacttatttataatgcaattggtttctgcttttgatgacattgtatttaataattatctttatggtttcacaaaatggctatttacaccccttaattaggaaaactatgtcagcatataaatacatatgcatatatgtatgtgtatattgtgtgtaatgtatgtataagtgccatgtaagaatgttaatggaagtatgattgctctaaaaattcagaatgaattggttcataagattaattgactaatgtttagaatgtgaataccatatttctaaaaatggtcttccagctaaatgggttctaccattaatttgtggaagatttcataacataatttaaaatttgtagtatcaatacaaacatatgctcataaataactgattagtgtttttcttaaaaatggaaaagtcagtatttttactgactgactttacataatggtaattttatatttatgcacttgaaaaatctcactgtgatattaacatatttacatctatgtaaagttgaggtcaaggaaattttcttgcatttatttccttacttgtaactattatatgacactaatcataattctctcctggcatgtgacctcagttatccaatagcagcattcctttgataggtatattaagataacacataaaaggtagggctgccattttactaataaaagtgtgatttttaaaaaataaaatagcgctttctagctccacacatcatgactgaaccagacactcatatttacctctatcacatatcataatagaattcttgagtcagtagaaattaagcagaaatgagtttaaatcacacagtgttgaagctgaaaagacatgaaatattacccatttcaacagttgtactttatacttgaggaaacaggctcacaggagagttatatgagtgtggtctagtatgcagaggaaattgaattaagagttagaagagctggtctgcagtcccttgctctgtcagtagtgcataaaatttaggaaattttcttaactattttgcaactgaagttttgcaactgaaacatgagcagaataaaaaagaataaagatttttcagtgtccgaaattacatcacgcaaaccctctgatcacattgagcacagaaacctcatctcagaacttttctgagaaatttaaataatttaagatacaaatacatccaaattaagtcccaaggatttactgcaaatggacatgacaaaattttgaaaagtgatgaaatatctaaaactggattgtagtagtggttgtataactgaataaatattctaaaaatcatcaggctgtacacttttaaaatgaataaatagttgaatttataggtatgtaaattatatctccataaatctcttttaaaaatctggtcacaaaaaaaccttgacaagtaaatttgacttaaaaaaaaatctgaacattctgactgaaaacaaaattttttaacaaagaagaaactgttcaacagattatctctcaaacagaagacaacactctgctggatagctttacaatactatcaatctaacttttaccttctattaatatttttctctaattgatcaagccaagtaaattcattttgagtcaacaaagacagtataatgacaatagagtttgctgttccttgtatctttgtgataagaaaaataattacaaaagagcaaatgtcattgtagtttgcgtatacaaatacaagacagcttctttgaatgtttgagttatgatgtgtgtgtttaagaatagagaatcacagattatttcagggtcatactgtagcaatgtaacatctaggactatcttcaagaatggcttttctagactattttggtgctttaattctattttaagcttccctactcagcttcattgttcatctggttgttaagcatgagcatttttttaatggaaagaaagcttgtctaaagggtaaattgccaaaaggattaaaagtgtgttcgttgcccagtcattttccaccctcagccccccgcctgctcccacctcatacacttatcatgctgtcactctttgctccagggcaatacgtttttatatacccacccaggcaggattccctgcctgatggacacggcttatagtggcctcaaaggaccagagatttgcgaagatgatcatctttcccattctttgaagagcagaaacagtaaaattgagtttcagggcattagccaatgagatgttaaaatatcaactaccatgcctcacctggcctgaaaccaaggttaagatcttctttagtgcttcctccccatctactcttcattcctgaaaatccaggctcccatctgccccttgcccagtgattttttttttctccataagctgatacatccttccattgggttatttactcccaaacccagcagaagatggagtcctaccactattggttctattactttctcttactcaggaatataattgatttgtgttgcgcaaagtaaagttggctttgattcaaacacatttttagaaaaattgtcccagtacacaggtttgtaacacttttatttttctcataccactccctcccagcctcactgagtttacatactcacatacatttaatactaaaacagataagctctgtaatcttcattttagtttttaattctgggacaccttaaacaagattttctagaattcaactattagatgatctctaaactattaatacattatcgtttgtaataagatactctgtactaactatatattttagcaaattttcttacattcttccatattatttatcattttgtgacgaaaatataataatctatcgattatgggatatagattctagtttgcttaagagagttcttgtataacttgtcttgttatacaagacatatttggatattcacttttactcttagaagtattccattctggtcaaaaactgatatagtcaccttagttatctgtcaccaattagatgtctctacaagtgaagtatagttgacacattacattacccttctccctttaagctgagtactgtatatttatgctgtaattaaatagttattattgactattacagattatgttttctgaaagttaaatttgaattcttaaaactcaaaatgtgtgggtatgcttgaaaaactaagcagtagatacaagaaatctaggaatttctgaacatagacttgccttttttgtagacaataaattgtattctttctttatcaccgcctaattaaagaacacagaataacttgccttcctgtttcagcagacacctaaagtaacacaaagaaaacacacatttacacacacattcttaataccaagtgatggtaatggcaatcacaaagaaaaaaaatggcttattggtcaaaatatctttctgaactaagagaaccaaactcatatgtgataagttgtatcaactgtttactacattgcattgcactgttttcctctatatactttctgatctcatttctgtggcatcatattccatagtctttattttcacgtctatattttttcttccaagctctttgttattctgttcatcttttaagcattaagtattcattatagcagagctctatatgcaagatccatctttagaaataccctttgtaaatgtaataaatatttactttatatttttgctcctcagtaaaaggagaatggcatttaattaattactggggtccttggattaggcaactcctctttttccctgacattgttaaaatttcatcaattattataataggttccttattgaactctacctctgctatatctccactttataaatccttgggttctactgttatatctgtgcactacttttaaatttgctctcatgctcaaaactctttggtagttctctgttgcccacaaagcacctagatgactggcttgggtgtctgctgttgctattcaccaactaagaaagaaaacaaggaaaaaataaaaccatttcctggaaggcagatggggaaaggaagaacatgaacttagttaaggtatgctgtcttgaagatgctgtagaaaacccagatcgaatttttcaacccttgcagtcctgaaataggatctgtgagacgttgatgagtgggcgttacagagaaaatgggagaaatcaacaaacagtagggatttaaagctgtgggactgaatgagatcattatagctccatcacattctatcttaatgctgatgagtctgtcttaatactaaaatataagctcttcgaggaaaagatttttttccccagaaactaaaatagatccaagaacaagtatctttcataattattgttttcattttaataaattatattagttattgtacatgggatataacgagtggttttcctttaacctagaaagaaaagcaccgaagatataactagtaaacgtctgattctattcttctttaaaagaagttagaaataagaatagtatgagcctttttaaacatgttttgggaaactggggtattatctgtaaaagtaaattacagttgcaccaaggtttttatctactctggacatttggcttgaggattatccttccatcctttcacgtgtgaaattgaaggtttccttttggttgtgtaagaaagttcaataccttagcatcacactctttaacagggcaatgaagctgtaatcctgccagtctcctttccgtatctaaatggttattagtttatcatgtgtttagttatccagggacgtacatgacaatctctttcttatgtctctacagttaataatacgtttaaaatcatatgtataatttatccatctgttctaaggcaagcattatgaattagaaggctgtagcacctcttaccactgcaaatactaactcactagaaaggaacattaaaatcaccagatgcttttgacatagtcaaaaccctttaatcctcaaatcttaagctcataagatatgagataaaagagatttttaaaaccattcagtccaagaagtaatgagacactagaattcctcttgatcattcagcaaggcattgcccatccttgcactgtggttctccccaggagacacctgggggagagaaacaggtaagtcccgacatcctacttcagccacagcaactccccctttttcataaacagaacttctaagtaagttttcacttaaacaagtagatctgaagattaattggagaaaattgttgaaaaccaatgcttaagtgaaaaacacttaaaccatattcaggtgatattcttccttataattctatggaattttttcttctggttctaccactgattttacttgactcaagaggccataaggaacagcagacttactctctcctcttgacagctttctgtttttccactttgaagtatttcaggagttgttgtcatgttccctataatcagatttcagcttattttcctcaggctcctcctttattcaactttaactagtacttatttttcttatggtacaggttatggaataaggagggggtgacttttatttggtggatttgcagtctagctgttctactgtgcttcttcccagttttttaaaatatgctttttaaaacttttttcagtactttatttccatacggtaaactaccccaatcttcacacagctctatgattttttgcacatatatataaacacttgtgaggccaccacacaaatcaagatgtagagcagttcagtccacccaactacttcatgtgtgcctttccagtcaatataactctccatggaatcgttattacgacttatattacctatacttatgcttcttatctatgagatcatacatttgtccctgtttgtctcacctttttagcttaacaaaatatttttaagtttgctcaaggttgttaaagcatagtacttaaaactgaacagaaagttcaaggtgaattctaaaacatccacaatgatgggttagcactttctttgctctgggtgggagttcaccctcaaatccttgcagtcatgtgacctgaatatgtgaaattatgcatttgtgaggaccatagatataagatattttggagtgatagggaccaaactagagagaaatttttatctcacccccaaaaagcattcaaggcaattcagaaaggaaagaaaaagaaatgtgataaatgattctatgcttcccttgaaaaaccagtcttcttgtcctattagccaacaatcttgcttagcttcctctcttccagattttgtgctgttaagaaatagtacagatatctcctcttttttagtaaccatattatactttccctaatgttgaaacataaggtcttaaaagaattcaatctctgaatagcatgtaataatccaggaagtcacacagacccttatctaaatttatccaggctttctattttccatatttcaggattagtggcatcttgtagtacctccttcttcctctgctgattgaccgtctgagtcccagaatttttattaaacacctctgttttccatctgctggtttcaagtgccattagatgtgataggcatgcaaatgacagaaagggtggcagagcacaccttgtttcccttcctcctccattgttaaaagaaccattttcactcctttcttcaagaggatattaatcaaaagccctcatatttgcaagttgtgttatcaatggattctcccactatttctactaattgtggtgttttttggccatgaagtcatttcttcctttcttgaaatattttagctgtgattcattgacagtgcttttgagaatgtatttgctacattttctggtaatttcaatatttacaataatcatctttataatacccttcaatgcagtggtctctcagtcccttgacctctgtcctccagatgactatgacttccactcaccttcaggcaatcatatggtcatgctttcagtatagatcttgtcattttctgtaactgcaaacctcatataacctcactttcattatccagctcctacttctcagcttatttcatgtagtactctgattccaataatacttggtcccactacaacctagaatccatcaattctaacatttttgcacagccccttatctccaatcatgtccccactcccatatttccttgtttaaattcttcaattcatcattatatattattgttttcatacatcctcaaccgttatgaccttccctcaattaatagtatatgcccttgacaaaactctagcatttgttaaatcttactttttgcttactctgtacctctgtcagtgcagttaaaagtgactagaaaaaaattcacaaccatgttgacaggtctcatttaaaatttatgatcagtaacctcaaatgagacattagtgttgcctggaattaggccaccactctttccttctcctttacctctacattataccttctcttttctcctcatacttctcgacttacccacacttacttttaggttataaccttgcttgataattctctgagaaaataaagggggctcagacaagaatttctgcatgttcccacatccatcccttacctacatctgcattcatctacttcttttctatgcctatgaatgaatatccgtccttctaactagggcaaagccttcctctttacctctcgaggacactacatttgcaaatctctcctctctctcattgttataaatatttccctccatactggatcatttctatcattatactaacatgcttttataattcctaattttaaaaaccttctcttgataacacttcatcctccagctacccatttctctctccccttcacacacacacacacacacacacacacacacacacacacttctcacattctttctgtttttctcaacttaccccaatcaggcttttgctccaatattccacaaagactgttcatgtcaagatcaccagtgaccccccacattattaaacatagtacctaattctcactcatgtcttatttgaactgtaagcagcatttgatacagattagtccaccatcctaggaacacgtttttcagttgacttcatacacacaaactctacttacattcgtcatgactcgctggttgttatgtcttactcttctttgctggttcttcttctccctaaggttttgctattgtcactctccaaggctcagttgttgatcatcttctcttttcatttatacttctttattggttctatctagttgatggcttgaaataccatgtaaactcaatgattccaaaatttttatgttcaaccctgaccattctcctaaacttcagaatgttttttcaattatctacacctccatctggatttctaatatttatacacatttaatatatccaaattcctgaatcccttgtccaaatcaatccaaatagtcgattttatttttagagaagttttaggtgcacatcaatattgaatggaaagtttagagatttcccgtataccctttgcccagttggtttcccccattatcaatgtttcccaacagagtggaacatttgctaaaattcacgaacctacattggcaaatcataatcacccgaagtccctagtttacattagggctcactcttggtgttgtatgttctatggcagaacactgacaacaccaaatgctggtaaggatgtggagcaacaggaactctcattcattgctagaggagtgcaaatggtacagccactttggaagacagtttagtggtctctttaaaaactacacatactcttagcatatgattcagctcttggtatttgcccaaaggagtagaaaacttacactcacacaagaatttgcagctgtgatagcagcttttttcataattacctaaccttggaaaaacccaagatgctcttcagtaggtaaatggataaactatggtacatccaaacaatggaatattattcggtgctaaaaagatatgaaatactgagccatgaaaagacatggaggaatctcagatacattttaccaagtaaaagaagccgatctggaaaggctacatactatatgattccagctatatgacataatggaaaaggcaaaactatggagatagtaaaaagatatatggttgctgagggttggggtattgggagggttgactaggcagaacacagaagatttttagggcagtgaaaatattctgcatgatactataatgatgggtatctgtcattatacatttacaacatcaagagtgaaccctaatgtaaactctagaaattgggtgactctgatgtgtcaacgtagattcatcagttaaaacgaatgtaccactctggtagaacatgttggtaatggaggaggctatgcatgtgtagaggcaggaggtatatgagaaatctctgtaccttccttctaactttgctgtaaatctaaaactgctttaaaaataaataaagtcttaaaaattgttatggatttctttcttactgattcataaaagcttttatatagaaattaggcctttttatgatataactataaaattttttatcaatttgtcttttactgttagcttattataattcattaagttttatctttttgtgtatttattaatgtatttaatagttgtagagtgttgagtcatatttagaaataacttcccattctaaggttcaaaaatatttccaaattttttctcatattttatgttttcttcattaaattaaacatctcttccaacctaatttgtttttatataaggtatgatgttagaattcaaatttgtttttgctccagctggctacacacataccaatgtcatttattcaactatccatctatttcactaaaggtactatcttcaatactacctttaccatatccaaatatacactcattgatatccaaacagtaatattgtccatcagtcagtgacatattattttcattgctatagttattattatttctgtaaatcaagaaatattggacagttaatctttattattcatagattccatgtttccagattcacctattctttaaaatttatctgtaatttcaatcaatactcaatgctttcgtggtcattcacagaattaagcatgcacagagcagtgacccagctgaggcccaacaagatgctgctctggttttttcagctctcatgccttaagtgttctttatgtggtttatttactaccacatttttgcatttttgtgctgtttgctgatgattttgctgtttaaaatggcctccaagcagagtgctaaaatgctgtcttatattcctaagcacaaagaaggctgtgctgggcttaatgagagaaaaatccgtgttttagataaatttcgttcaggcatgtgttagaatatgattgtccctaagtttaatgttggtgaatcaacaatacatacatccagaaaaagaaagaggaaattttctaatctgtacatgaaactaccccagcaagtgctacagtaacgtgtatggtgtatgagggagctagggaagacgtggaaatgtggctcaatttgtagtttcatgagataagaattgatttttttttaagtgtagttgatagtattgttgcaaagctgaaagccaaagaaatttccagtcacattatccagcatcagggaaatgatagacccttctctgctagtttttattacaacaaaatccatatataattagttatttataagaaatatatattaaataatgcatttttaaacacatatgaaacaaggttatgtgttcatcagttgatgaagatgttttgatcaaaaggtcgcaggatcctaaccttgtatttccccttggaacattgactcagtattcactgattcagtgttgacagcaactttgtaggtcacaactactatgtcccactctgagttttctcacttctctgttgcctttggaactgtctcattctcatatttaagttctgggatattgctggtgatcatctcgatcacctgtatatttgtttctcacttcttctggggggagtgaagccagcttgcttctgcagcaccatattgaaaccagaagtaagaacaatattaatgtgaaaagcaagaatcatttgtacttaaattttataaataatgctcaataagtatttagactatacttacggaaataatctgtatgttagataaatttttttacttttgtaattccttactcttataaaaaaaggatttcttagtcttgtagcctttaaactcaacaagaaaggacaacaagaaaattaaatgctctatcccatcagcttatgtcgtattccgctcatgccttgcttactctaaagtgagactatagtcagaaaatgagtccatccattcagttaccgatatatttcaaggcttttctgtaagttaagcactgcacttgttacttggaatgcaaatatcagtatgatgtgctatttgccattaagatctagcaaaaattgttatttcaattgatggcagggaatttcaaaataacatacgtatttttaatgagagaaaaaaataccaataacattaaagcaaatagagatgatatcacaaggaagctttgcaagctactgagttttctaatagtacaacatgactaaggggattttatctattggtgactttaaagttctaacttatttatttacctttaaaaaatattttggtctttttcattctgattgtaaagcgatattatgttcaacatggaaacttgtaaacattgacaaacatgaaggagagaaatcaccagtaatgatccatatacatatatatatatatatatatatatatatatatatatatatatttcttttttttttttttttgagacagagtttcactcttgtcccccaggctggagtgcagtggcacgatttcagctcactgcaacttccacctcctggtttcaagcgattcttctgcctcagcctcccaagtagatgggattacaggtatgccccactatgcccagctaattattgtatttttagtagagacgggtttttaccatgttggccaggctggtcttgatctcctgacctcaagtgatccacccacctcggcctcccaaagtgctgggattgcaggcgtgagccactgcgcccagctatgatccatatatattaacaattaagtagctaaacttatttagtacttaatacataaaaaatcctgttcttggctttcttgtattcattacaataccctaataaagtagtaatattatagcccctttttatatgtgagagatatgactgagaacacaggtgatatatgaaaaacaaggtttactatgaagtccaaacaatttttactttactacttatgtgatatcagtagcatcaaatgttttatgctatttttagtattgggggaaataatctggtaaaagctattaaaatttaaaaatatgtttatctttcaacacagaaaactgaaaacctatatatatgggatctttataaggacacttattccctccaaggaaaggtgtggcccggatgttgggaaactagataaggaccttgaactttacccagcaaatcctagagaacctttaggatgctttgaggtagtgaagtggcctagcataattgaattttagataaatcaccttggtggctatgtggtagcagattttagagggacaaaaccagttagaaggctgctttggtaatcgaggcaagagccagtaagagacaatcagtgagttcagacagtggtagtggagatggtgagagagagaaagagattagtctggagtatataaactgaaggttttaagactaacacactgaattggagtgcttgggcgtaatttgtgaaatgctagatgattgactgtttaggttatgacttctcagttcaaaccatcttttatgccttaagtgatctaacggtctacattctacaaagaaggcaaactaaggaaaacactgtttgttggccccaatgttgatgccagtctaaaaatgatgtatttattgtgctacttcgtgattcccttgtttccaactctttgctatcaataattatctaaggtaggcccgtgactgtggcccccaacatcctgtctagaaatttgaagaagggccaatgactttttgtaaattggttgtttgagagctggactgtctgttttgcagcatgtagtttgaagctataaaacatagatacttccatgcctcagaccttgttatttctaggaaagaaaaatgagaacagtacctttgattgtaatattttttcaaaagttgctgtgccatgatatgtctcgtaggtttcagaagacaaaccattatgaaaaaaatttgttgaaaaagcatgagaaagaagataataatatgataagctattccatagagttttccagtgagctagagaaattaggcagcaaaatacctcatccaatccttccacatcagcaaattgaatccttaatagcttctatgttcttaaatcctgaacacatttattaggagagttttagaatgaggaaaaaaaaactgaagtaaggacaccaattatccaccttcctaaccttcatccttggtcccaagccaggatattctcgatgtcctagagtctgaactcaaggtagatgtggctgagaatgcagccatgactgtaactctgtcattaagctatgaatttagggaaaagccaacaagttgattaagtcataaaacatcatcaaaattagcaagaggcaagccaaaaaagccccagcctataaccagggcactattcctcagagaactttttgtcccactagagacatgagaagttaggacctcctgctcactggtttcccccaccgcccactgaattatcagcatccgtagccacagctcattttaattcttgcatttatgataacgctatgtcattacaagaaggttcccatttccaaataatttaaatgatttatcttgcctggtgacttgaagtttatcaacttaaaattgaaataatagaagaaaaaactgcagatgagaacattttatcactttattattcaaaatagtacattctgaacctaaacatatttaactatctcatgttttgcgcttcccaaaaaagataagtaaaatatttttaaagaaaccattgataggcagatagacagacagacatacacgcacacatgcacacacaatcattagcataaaactgtctttgtagagacaaaattaattgaatagatgtaactgaaaagttggctttttattcttttatgagccttctatttggaagatcaacttattaagtaaatgcctttctttcctaaaacaattatggtagagagagttctttctcttcacctatgtaaaatgattattttttactgagagctaattatgtcagtttcttattctttccctagtgaattgtaaattatttgaatgtatgagtgtgttttctctcttcctcctttgttattcattgagaagatggtgaataaattttttgtcagaaaaggtataaaaatataaattaagaaaagagaagaagatggctaaatgcatgcttagtactattattctaatgccttcattaaaccagcagacacttgctgagtacctgtcctgtgccaatactgggatataaaatgaaacaagacgttatccctaccctcaagttcaatgtagaagacattaaataagtcaaaattttaatcaggtgtgatacatcctatcaaaataaaaacaaaagcagcaggtgtaataatataataaaatcctgaattctaatgtaccaaaaatttatccacatttaattatttgatatacataatctcactttatcttaatattatcccaaagaagtaggtattaccatcttaatttgataggaagataatagatataagaggcacctttatgacgatcacagagctttaaggtggcagaattagaatttgagtccagatctgtgtctccaaaactaagattctaaatagaaatctgtgctccttatgaataataatttttaaaaatacattgagattgcccttagaaatcagacaagaggcatttgaaactgactagaaagtcacagaatatattacagaggaggagatttgaactgacccattcatgaaggactactaggaattaactaggtgaaatgaaatggccacagtggggtggttttctaggcacagtttgcagcatatataaaagtttcatcataaagcccatgctaaatcttgcaagaaacaagtgttttttttctggcttactagaaggctttatatgacagagtgtgtaggaagctagaaatggagtcataggcctcatggacctcaccatatgatgaaaacgatagagcttcattgtcacaaaagtaaaaagtatttaaagctacatagtcttgctctctgaagtggagagcagcaacactcatagccttcatcatgtccccttgagagaaggataaatcccaagcccaggaagaacccctaaactttttgaagatgtctattgttttgcaactgtggatgatatactctgtgcaggtctgaatttctctgactcctggatggttaatatctccaatccacatgctattatttttctcaaaaatattgctttgtgtgaagtggcattttctaaatttactcattccacatatattcctacttgaggtcctggtaacccaaagattagtgggacatagttataaacttggaggatcttatagttttgtagaagagaagataggtgaagagatcatgacagcaaaatgccaaatgtgctgtaaatagcattataaaaatgaagctgtatgacaagtcaaataagcggttcaaagagcaggaaaagagtctccagaagaggccacatttgagacactatttcacagaaatgttctttctttcctccctgcctgcagtgccttcactttggcctctcagagttattgctttatgtatcagtctcccattatattctgccctcaaagactgagctgaatcaaatgtcactcttcctggctgtgtggctttgcaatttaaagggagatatatgcatttgtaagtctaattcaccttcacaagtagccactgcatttggcatcggttgtaggttcaaactttacatttccccatacttacagaaggggtgaaagagcagtatgtatagaagcttcatgtaggtatacctggcttaaagatagcagagaagaagcccatttattataacaaatatcttctaaaagcatactataaatgtaaatgatagttttatgaagtaaatggagatactaatgcatttacggccagtgtcaagagttcagtgaaaatggccctatacatcgtactgtcttgagttcagaaagtctcattataagtaatttcatagatatttctttataaagaccagggagcatatatactgcttaatgtgggtcagagcctacacttcatgtaaagtgcacacagtatttattaccaagactagggttttaaaaaaataagagctttagaagggaatgcatttcatttatattaaaggcaaacctagactaaggaataagttgtctcccaaaagttcaattgcaagtaagttattttgaaataagaacatattaacttaggagattattataaagggtggaaataaataatacccaatgtcaaggtaggatttaaaaattgagttgacttatttttttaatgtttctaaaacatgaatgatagaatattaactctagtcactgccttcttgctctagtcatatgcatggttatattttcctagggacaatcaggaatagagccagcgctactgattcttcaattcatgaagagatcattggtttagcatatatgtcaggagattctgttggttctgtgagatgctgtgagtgacaaagtccagaaaacatatttgttatatcaaacagcctagatcttacttctgtggtttattcataagcactttggaatagtgcttctcagcaatcattttaatgcttattttccttggagttttgtgtccatctttggaaatatctctaagatttctttagaagttgacccaggtgagacttctttagatagcactctggccttcaatgtctttattctgtcatcttttatcaatttacacaatgctgactgatttagaacattgacacatcagaagttactcatatttataaagcaggcttatttaaattcttaaaatcagaacaagaaaaaagttctgggaaaccaacatccacacagtctactgtcccctctattcgctatctggggaacgctaggaaaagtttagatattattgacaacgctttttagtcttctctagaaatagaattattttaaaactctgagaaatctagaatccatctgaactggaatgatttgtttggtcttggggagcagacaagaagttcataaccatgaaattatgcaggcccttctggaacctgcttaaaagtgggagtttttctgatgccttgattacctcaccaggggcagaaattgttaggagtgacaaccttataatcttattaacttaccaacactgggaaatcagatctcactttactaagtatattcactttcccttttaataagaaaataatctcatattttcctccttgaatctctagaacttagcccctcatccctcaactaattaactttaccttttatggagaatatggatacaagctgaaggaagccacactatcttctggccattgattccacaatctgaattgcactgggatccaaacatttgggcttcttttttacaatagtgaaaatagccttgcttttatccctccattggtcttcagatgttgccccttcttgtattgtggaagaagttccctagagcatttctcttctgcaaccagtacctcttaccttcctaccaggtcattccgtccatgtactaaacatgtcttagaccatctaattaaaagatatttaagtatccctccaagtaccaccattatgaaggtatagacctcaccttcaaggaaacattttcaaagaaaattcccagagttgttattacactttctaccttccattaaccctctccaagcaagttcccattctcaccaccccactgaaatacctccttccagactacctgtgatttatatcttgccaaagtcaatggccaattttctatccttaaaaaacttaaactttgaagctagttgactggttgagttttcctagatgccagaaatattttcttctccaggttccataaaaatccagtcttttgattttctgtctacaacactggccgttctttcttagtcttttttctgtacttctctcctatcaaacttctaaatagtgtgattcccaggaatttttttctattatcctttattctctatgtaagcttcctttctcatccctattaatgactttagatgctgtgcttacacagatgactcttgaactaatgtctttcacccagaatattctcccacatttcaggtttatacatccaactttctcatcagcatcttcctttggaagtccagtaggcaactccaacctagcatggccaagattaaattacttatttcagctgcctccccctgttgggtgctgtggctcacacctgtcatcccagcactttgggaggccgaggggttggatcacctgaggctgggagtatgagaccaacctgacgaacatggagaaaccctgtctctactgaaaatacaaaattagccaggtgtggtggtacacacctgtaatcccagctacttaggaggctgaggcaggagaattgcttgaacccgggaggcagaggttgcagtgagccaagatcacgtcgctgcactccagcctgggcaacaagagcgaaactccattaaaaaaaaaaaaaaacaaacaaacttcctccccctaaactgacttcttctgtcctaaatcttcttcattacattaaatggagctaccacccatccagtggattagatcaaatagttaagagtaatccttcatctcattcttttttccccactctatgtggtctatcaacaagccccttcatttgccatcatctccactaacatgatccttgcacaggctattgtcatctttcactgaactgctgtaacagcatcacaatttaattcctttcctctatttttgtcccttgcatttagttcaacgtacagaatccaagttatgtgtgtaaaagcatacaccagcatatgtcacctcctgcttaaaccttcaatggctttcagttgtaatcagatgaaatgattggccattgcctgtgagttccttgtgttcctcaccaacctcattccttttctctccatcatcacagaaggtgcctgccatactggcttcctttttgtcttttgaacaaacagagctaatacgtgcatcagagatttaacacttgcagattatctgccgggaacattctttggctgcttccatgttttggttcaagtctcaactcaaatgttttcttctcagagaagtctttcctacctgaaatagactccagtcattctctcatgttaacctattttatcttttacatgacacttattattattagtctctgtaattcctttctgtatttattcatttatgtacttactgtctgtctttgcctatgataatgtgtgctctggatgtcagggaatctgttcaccacagcattcccagtgcccagactctgttcagcacacagtatgcatcctgtgaaggttttttgtagattctagaaacaggtctctattctctattgacgatattaaatttgcaagcaagcataatttctggaagggaagattctcatggtaatttagccaacactgtatgttccattttgtgagtcatctagatattgtcttctgggagatgtacacagagcacatgcttcacatataataggcaaatttactaatcccatttgtttcctgtattttgaacgttaccaggagatatagtgaagaatttgactacgggtttcccagagcagtcactaattcaaacaaatgttcacatattaaattatttataatagttcttagctcttagagcaaaccacaaagacccatttaacctttatagttaagacctcaagtctcttaatgggcagaaagtgttacaaaatatgggcactaggaagagattctagaggttgatagaaagtggtaaggattagagtagtgaggaagaaaagaggttgggatctgacttcttcagcttatacagatgcaagatgggtcagtgatgcctatagtatttgtttgaagaagtggttatatatatagatatagatatccttattataaatattatatgccttgcaagaaaagtcatcagcaaacaatttaaaaacatgtatgtaagtgggccaggtgcagtggcgcatgcctgtaatcccagcactttgggaggccaaggctggagaattgcttgaggccaggagttcaagaccagcctgggaaacatggagagacccagtctctataaaaatgaaattaaaaaaattagctgtttatggtggtgtgcacctgtagtcctagctgctcgagaggctgaggcaaaaaggtcttctgagcccgggaagttgaggctgcaatgaactgtgattgtaccgctgcactccagcctgagtgacagagtaagactctgtctcaaaaataaataaataaaattttaaaagttaaatttgtttccaaaaaacccatgtaagcataatcttttgaattcagagtattccagaatgaaacctgcaaacgaaattgataaatgagtgatttcctgatataactgtccatgagtccacaaacgtaattgaaattcaatgctatagcaactacactaaacagaccatgggatggagtgttgaaaagtctttcattaagacagatgaatctatacttataaaagtgaacaaaaaaaagacacacacacatacacgtattttcactatttatttatatatataaaaataaataaatggtgaaggtgcaaaacaaaactaaaacagcagcgaaagaaaaaaaaaattagactgggctgccctacccctaacaagctatgtttccagagatacattactaacccctctggacctcagtgctctgtactctaagatgtaaagtctgtactatatgttttataagatctttattcaaaacagttgttctgtgttaccaaggagactctttggatgaatatcttttgtggataaaatctttctctattcttaggatactcagatgaagctgctcctatgagttttgaaaataggtgagaatatttctttaaataactgaaattgtgtcttaaatataataacaagctttgttttaaaaagtttacaacaaaactgattcatatcatgtacaaactaactactgacttgtaataattcctgatgtgttagtacaaatattttctgtaagaccttatatacgtaaattcataatctattgtattcactaagaagccaaaacattctggaagaaaaagaatattaagaaaagcattgacaggtaaatttttcccagaaattaaatgattatgtaatgctaagatgtgagggccaggtgcggtggctcacacctgtaatcccaaaacttcgggaggccgaagtgagtgtattacctgaggtcaggagctgagaccagcctggccaacatggtgaaaccacatctctactaaaaatacaaaactacctgggcgtggtggtacacacctgtagtcccagctactccggaggctgcggcagaagaatcgtttagaacccaggaggcggaggttgcagtgagctgagatcccgccattgcattccagcctgggtgacagcacaagactctgtctcagaaaaaaaaaaaaaagatgtgcaatgtgaagccattagcactatcaaatcactacatcctatgaatgctaatctgcctaatgaaggcaagtttttagttggggaacataaaattaccctaataagaagacagagaattttaaaaaggaatgcatggaaaaggtctgacttttcattttaaaaagtattatgcttgaaatgctgattattttagctataaatcatgcaactaactctctccttgaaaccattagggtttaaagctgatttacttagagttgctactaattacatgagttttaaatgacacatctgcagttgtattaagaggaaacaaaagcagaggcacatacaactctgatcaacaaggaatatttgcagtctacttaatcctttacctccttgcttaaatgcttttcaccatctgaaatttgtcatgagctgtacaaaaggtcatcattaaaatacgaaaagttcccagcatgtgaggaggaaagttacagaggatacactgggagttaaggacttaataaaatgttttatttttatttccttttctggcaaagatgctgaatgcatttatctgcttttttcttctaattcaacaggccactgcgacacccttaggagagaggcaaataagtccagagtactaaatgacagcaagaaacatgacatagactgttagttccatccctgaaaacatgccccattcgtaaaataaataagactgtacaacttacagaaatatagtaaacaatactatgaaggaattaatctactttaagaaatatttactgagaacatcctacaggcaagcatggtgctatgtcctccacaaattccagagcctgcccattgcacatttataatgtttcagtggaggaaaagataactgtaaaattttattcaaagcccaatggaatgaatcccataaaaaaaataataagaggcttcagggagtcagaaaaagatttactgtagcttgggaattaggaaaactgccctcatgtgttttcctctacatttgctcatgatctcccacctccatccttggtcctattccagtttactgataaaacataattgagtcaaaaaatatatcatcagcttcagtcccgttgataaagatggtctttcttctaaatctaaaatccacccaaatctggatacaatgcaatagcttctaggaccattatgtctctgtttctcaagttggtctatttaaaaaacaaagtgtcatttggatccccattccaagatgcatgaggtacatagatgttttgacagaggcctttgcatccttctgggctcttgccaaatccattctcagaaactgaatccatctcctgtacttgcagcccactgggcagaattctactagttatggaaagattagaaataattggtgcccaagtgtccaacatagaataaacttgtcactgctgtaccctgccactccactgtctcaactcctggtatcaacaactgtcaatcacaccagagctttagactctatattgtacatcaacctggatgctcaggttagttcctcagactagttcaaatagtctcctgtcctgtgtgtattcaggcttcccagtgtagctctccagccccattgctagctccaagtgacttcacaataagccaaatgaaaataggaaatccttttcatcatgcaggcatttttttttaaagattttttttcagtgcctggcaagatggccaaataggaacagctccagtctgcagctcccagcaagatcaatgcagaaggcaggtgatttctgcatttccagctgaggtacccagcccatctcactgggactggttaggcaaggggtccagcccatggagggtgagcagaagcagggtggggcatcacctcacccaggaagcgaaaggatttggggaactcccctagccaagggaagccatgagggactgtgctgtgaggaacagtgcactttggcccagctactacacttttctgatggtcttagcaacccgcagaccaggaggttccttgggtgcctacaccaccagggccctgggtttcaagcacaaaactgggcagccatttgggcagacaccaagctagctgcaggagtttttgtcatacctcagtggcgcctggaacaccagcgagacagaaccattcactcccctggaaagggggctgaagccatggagccaagtggtctagctcagcggatcccacccctatggagcccagcaagctaagatccactggcttgaaattcttgctgcgagcacagcagcctgaagtgacctgggacactcgagcttgggtcggggaaaggcgtccaccattactgaggcttgagtaggtggttttcccttcacagtgtaaacaaagccaccgggaagtttggactgtgtggagcccaccgcgtctcggcaaaaccactgtagccagacctcatctctagattcctcctctctgggcaggtcaagtctgaaagaaggcagcagccacagtcaggggcttattcccatctccctgggacagagcgcctaggggagggggcagctgtgcacgcagcttcagcagacttaaaagttcccgcctgatggctctgaagagaggaatagatctcccagcacagcgctcaagctctgctaagggacagactgcctcctcaagtgggtccctgaccccagtgcctcctgactgggagacacctcccagcaggggtcaacagacacctcatacaggagagctccagctggcatctgacggttacccctctgggacaaagctcccagaggaagaaacaggcagcaatctttgctgttctgcagcctctgctggtgatactcaggtaaacagggtctggagtggaccttcagcaaactccagcagacttgcagcagagggacctgactgtaagaaggaaaactaacaaacagaaaggaatagcatcaacatcaacaaaaaggacattcacacaaaaaaaccatccaaaggtcaccaacattaaaggccaaatgtagataaatccacaaagatgaggaaaaaacagtgcaaaaaggctgaaaattccaaaaaccagaacacctcttctcctccgaaggatcacaactccttgccaacaaggaaacaaaactggacagagaatgagtttgatgaattgacagaagtaggcttcagaaggtgggtaataacaaactcctccaagctaaaggagcatgttctaacccaatgcaaggaagctaaaaccttgaaaaaaagttacaaaaattgctgattagaataaccagtttagagaagaacataaatgacctgatggagctgaaaaacacagcacaagaactttgtgaagcattcacaagtatcaatagccaaatcgatcaagcagaagaaaggatatcagagattgaagatcagctcaatgaaataaagcgtgaagacaagattagagaaaaaataatgaaaacgaacaaacaaagcctccaagaaatatgggactatgtgaaaaaaacaaacctatgtttgattggtgtacctgaaagtgacggggagaatggaaccaagttggaaaacactcttcaggatattatccaggagaacttccccaacttagcaaggcaggccaacattcaaattcaggaaatacagagaacaccacaaagatattccctgagaagagcaaccccaaaacacataattgtcagattcaccaaggttgaaatgaaggaaaaaatattaagggcagccagagagaaaggtcaggttacccacaaagggaagcccattagactaacagaggatctctctgcaaaaaccctacaagccagaagagagtgggggccaatattcaacattcttaaagagaagaattttcaacccagaatttcatatccagccaaactaagcttcataagcaaaggagaaataaaatcctttacaggcaagcaaatgctgagagattttgtcaccaccaggcctgccttacaagagctcctgaaggaagcactaaatatggaaaaaaaaaaacccaaaaaaacagtaccagccactgcaaaaacataccaaattgtaaagaccattgacaccatgaagaaactgcatcaactaacgggcaaaataaccaactagcatcataatgacaggatcaaattcacacataacaatattaaccttaaatataaatgggctaaatgccccagttaaaagacacagactggaaaattgtataaaatgtcaagacccatcagtgtgctgtattcaggaggcctatctcacgtgcaaagacatacgtaggctcaaaataaagggatggaggaatatttaccaagcaaatggaaagcaaaaacaagcagggattgcaatcctagcctctgataaaacagactttaaaccaacaaagatcaaaagagacaagggcattatatcattgtaaagggatcaatgcaacaagaagagctaactatcctaaatatatatgcacccaatacaggagcacccagattcataaagcaagttattagagtgatacaaagtgacttagattcccacacaataataatgggagactttttaacaccccactgtcaatattagacgtatcaacgagacagaaaattaacaaggatattcaggacttgaacgcagctctggactaagcagatctaacagacatctacagaactctccaccccaaatcaacagaatatacattcttctcagcatcacatcgcacttattctaacattgaccacataattggaagtaaaacactcctcagcaagtacaaaagaatggaaatcataacaatcataacaaacagtctctcagaccacagtgcaatcaaattagaactcaggattaagaaactcactcaaaaccacacaaccacatggaaactgaacaacgtgctcctgaatgactactgggtaaataacgaaattaaggcagaaataaaggttttctttgaaaccaatgagaacaaagacataacgtaccagaatctctgggacacatttaaagcagtgtgtagaaggaaatttataaaactaaatgcccacaggagaaaccaggaaagatctaaaattgacatttcaacatcacaattaaaactactagagaaacaagagcaaacaaattcaaaaccaagcagaagacaagaaataactaagatcagagcagaactgaaacagatagagatatgaaaaaccctgcaaaaactcagtgaattcaggagctggtttttttgaaaagatcaacaaaatagatagactgctagccaggctaataaagaaggtaagagagatgaatcaaatagaggcaataaaaatgataaaggggatatcaccactgatcccacagaaatacaaactaccatcagagaatactatgaacacctctatgcaaataaactagaaaatctagaggaattggataaattcctggacacatacaccctcccaggactaaaccaagatgaagccaaatccttgaatagacaagttctgaaattgaggcagtaattaatagcctaccaactaataaaagcccaggaccagacagattcacagctgaattctaccagaggtgcaaagaggagctggtgccattccttctgaaactattccaaacaacagaaaaagagggaatcctccctaactcattttatgaggccagaatcatccttataccaaaacctagcagagacacaacaaaaaagaaaatttcaggccaatatcctcgatgaatatcgatgtgaaaatcctcaataaaatactggcaaactaaattcagcagcacatcaaaaagcttatccaccaggattaagtcggcttcatccctgggatgcaaggctggttcaacatacggaaatcaataaatgtaatccatcacataaacagaaccaatgacaaaaaccacatgattatctcaatagatgcagaaaaggccttcgataaaattcaacaccccttcatgctaaaaactctcaataaactaaccagtgttggaatgtatctcaaaataataagagctatttatgacaaatccacagccaatatcatactgaacgggcaaaagctggaagcattccctttgaaaaccagcacaagacaaggttgccctctctcaccactcctattcaacatagtattggatgttctggccagggcaatcaaacaagagaaagaaataaagcgtattcaaataggaagagaggaagtcaaattgcctctgtatgcagatgacatgattgtatatttagaaaaccccattgtctcagcccaaaatcttcttaagctgataagcaacttcagcaaagtctcaggatacaaaattaatgtgcaaaaatcacaagcattctatacatcaatgatagacaaacagagagtcaaatcatgagtgaactcccattcacaattgctacaaagagaataaaatacctaggaatacaacttacaagggatatgaaggacctcttcagggagaactacaaaccactgctcaaggaaataagagaggactcaaacaaatggaaaacattccatgctcatgggtaggaagaatcaacgttgtcaaaatggccatactgcccaatgtaatttatagattcagtgttatccccatcaagctaccattgactttcttcacagaattaggaaaaaaactactttaaatttcatatgagaccaaaaaagagcccatgtagccaagacaatcttaagcaaaaagaacaaagctggaggcatcacgctacctgacttcaaaccatactacaagtctatagtaacaaaaacagcatggcactggtaccaaaacagatatatagaccaatggaacggaacagatcagaggcctcagaaataatgccacacatctacaaccatctgatctttgacaaacctgacaaaaacaagcaatgggttaaggattccctattttataaatgatgttgggaaaactggctagacatatgcagaagagtgaaactgaaccccttctttgtatcttatgcaaaaattaactcaagatggattaaagacttaaatgtaagacctaaaaccatgaaaacccttgaagaaaacctaggcaataccatttaggacatagtcatgggcaaagacttcatgactaaaacaccaaaagcaatggcaaaaaaagccaaaattgacaaatgggacctaattaaactaaagagcttctgcacaacaaaagaaatgatcatcagagtgaatagacaacctacagaatgggagaaaatttttgcaacctatccatctgacaaagggctaatatccagaatctacaaggaacttaaacaaatttaaaagaaaaagacaaccccatcaaaaagtgggcaaaggatatgaacagacacttctcaaaagaagacatttatgcagccaacaaacatatgacaaaaagcttatcatcactggtcattagagacatgcaaatcaaaaccacagtgagataccatctcatgccagttagaatggcaatcattaaaaagtcaagaaacaacagatgctggagagcatgtggagaaataggagtgcttttacacagttggtaggaatgtaaattagttcaactattgtggaagacagtgtgacaattcctcaaggatctagaaccagaaataccatttgatccagcaatcccattactgggtatatacccaaaggattattaatcattctactataaagatacgtacacgtgtatgtttatttcagcactattcacaatagcaaaagcttggaaccaacccaaatgcccatcaatgatagattggataaaaaaaatgtggcccatatataccatggaatactatgcagccataaaaaatgatgagttcatgtcctttggagggacatggttgaagctggaaaccatcattctcagcaaactaacacaggaacaggaacccaaacaccacatgttatcacttataaatgggagttgaacaatgagaacacatggacacagggagggaaagatcacacactgggacctgttggggggtggggctaggggagggatagcattagtagaaaaacctaatgtaggtgacgggttgatgagtgcagcgaaccaccatggcatgtgtgtacctatgtaacaaacctgcatgttcttcacatgtatcccagaacttaaagtataagaaataaaagattttttttctcataagggaagataaattttatagctaaaataaaatgcaaaatgtgcagctcaggcaggtgaaatgtctggttggaccacagaacttactaattactcttatcttttaggcatctgagttttctactgcttcttgttgtagacactgctcctctcgccacttttattgcaggggaacagtgtttcactctggcccaaaaaaggataaatatcccttcctttgattctttttgcatgactaagaggagctagaattttcctattgctttactaaattgtaaaagagaataaatgaatactacataaagtatattcagttgaatgtttttgcttataaggtcagagttactacttagcttgcttttgggcactcttgggcactattcaaagatcaaagagtggaactatagatctgtgatggttaattttgtatttcaacttcactgggctatgggatgcccagatagccagtaaaacattatttatcaatgtgtctgtgaaggtgtttttggaagagatcagcatttgaattggagaactgagtaaagcagatgaccctgcccaatgtgactgggcagcatccaatatgttaagggactaaatagaaaaaaaaggcagaggaagggtgaatttgctctctctccttgacctgagacatccatcttctcttgtgtttggatattggtgctcctggttctaatgctttcaggctcagaggaggacttacaccatcagcacctcaccctcattttcaggccttcagactcaacctaaattacaccactagttttcataattctccagcttgcagacagcagatattgggactttttggcctccatatccatgtgagctaattccctgttatctatatctatacctatatatccatctctttattctgttctgctggttttgtttctgtaggtaatcctgactaatagaagcaccaaaagactagtattatttacagctgccttgtgtgggtcttaagatataaaaagtgtgcttacctatagagacaggatgttatgcatgaggcctggcccaggtagctaagtaaaacaaaatcaaaaacagatagcttcttctctgatgtgttttccaatcttaggaatcttagtgatccgctaacctacagtgtcactttcagtaaacttttcgctccttagggagtgtgcctgccaaatgattttatctatacagctccatcagtataactgcttatttaaaacaacataatatttaatatgccatgcaatccctggattgcaagtttcaagagtactggattatatatttttcactaatatattactaaagctttgcacaatacatggaaaacagatgtgtcaagaaatatgtgttgcccaattgaataaattggaattgcgtctataagatgaagggaagaggagaaggaaaagttgcatacttcctttcagccttagacagcaggtaggatttcagaagacagaaatttagggtgaggatactccaaacaagcaccttaaacaagacaatccagaaaagtgtgaggaccataatgaaatgtgttgtaaagagtgagtaattctgtctgtgtcatatccacaaaatacaaggactgcctaaacacaccaattttgttacagttcctttttagatcattataagatatctaaaacctgatttggttaccatcagtttattttcctcatggtttgctttgtaacttgtatgcaggaagataaataatgagagctgtttcaaaaaacacaagagcttagaaggattgtaactgcagttattgattgaagtggaaaaataaatataaaatatatcatcttgctatttctagagcaggaaggaaaaaaataatatcaaatgagggagaaagcaaacctctttctccctcatagggagcataggatgacactaaaaaaatcaacattctcagaaaatgagagacagaaaaaaaaaaaaagaacacttaagtaaaacctgaaggaagactagtagtcagacttttggatgtgtcaggattactcataattataatgcctatatcggtatgtagccagaaaaagtgaaatacgcttagaatacaagcaagaaattgaccgtgctttgtaaatgcgtgtttctatttcattcatctcttcatgtattcacctgctctatgccatgcactgtactagattacagggatgcgacagaaagatgcagtaactaggctcctggagtccttcaccgaattagagagatacatacaaaataaataattgtatcattaactaattaataacaatgtgatgagggatatgaaggagaattccaggggactaagggaatatttaactggaagaccctaatttagtcaatgaaattagaaaaggcttttctgaaaaagtacccttttcatatgcaagcaatctgtggatgattatttcatacttgcatgattttctattgataaatgcccccacaatattttgttttacctttaaatagtatatattattagttttcaaccattgtctgtttgcccgtatagctaacacttatgaataatagttactttctacggataaggaacctggataaggatatggacaaggaattctggatcttatttcatcttattcttttctgtccaggttgagtgatgctctttgtttgtctttttcttttctttttccttttatggcattttttatatgagacagggtcttgctacattggctgggttggtcttgaattcctggcctcaagcaatcctcccaccttggtctcccaaagcgttaggattacaggtgcaagccactgcacctggccctttgtttttctttgtcttgccaggtttagacaatacaataaatagtagaaaaattatgacttgcagaacaggggtaataataatagtaataataatgatgatgatgactaatattgagaatttattatgcaccaggcactgttctaaatattttgtgaacattaagtacttcctattgataaagacctagaaattttaatatggtcataattcaagccgaatgaggccaggcatggtgtctcatgcctgtaatcccagcattttgggaggctgaggcaggtgggtcacctgaggtcaggagttcaagaccagcctggccaacatggtgaaaccttgtctctactaaaaatacaaaattagccgagtgtggtggcgcatgcctgtagtctcagctactcaggaggctgaggcaagagaatctctggaacccaagaggcagaggctgcagtgagccgagatcgcaccactgcactccagcctgggtgagacagagtgagactctgtctcaaaaataataataataataataataatttcaagctgaatgaaatttctttaagttatattaaagcaaatcaaagcacaattctatgtacactttaagctggagaaattaattccaactatcttttatatacaaaaaatctctgatatataggttttaatataataatttcagattatttttctgaatcctgtcataaaattttacatttataaaactcaatgtgtgttcttcaacacttagcacagcaatgaacccaaggaggcatagacttggaataaatatttttaagtgaaacatcgtaatgaaaaaaacaatactgatttttatttcctcggctgaggttctttggcttgaacatgattaatgcaatctttgacatcttttactttgttatctagggttcagcatgctgacaatatttccagtggtgcatgggtctttcaatatctccatttgatggtctgctatatttaagaaactagtactggcagcgcgcggtggctcacgcctgtaatcccagcacttggggaggccgaggcaggtggatcacgaggtcaggagatccagaccatcctggctaacacggtgaaaccccatctctactaaaaataccaaatattagccgggcatggtggtgagcgtctgtagtcccagctactcgggaggctgaggcaggaggatggtgtgaacctgggaggcggagcttgcagtgaacagagatagagccactgcactccagcttgggcgacagagcgagaatccgtctcaaaaaaagaaaaaaaaagaaaaagaaaaagaaactagtacttggtatttcattaattgtgagattttttaaaaatttatgtttttatacttgatgccctttactaattaaatgaggtaggaatcctggcatgaatatgaagaaacaaaaatagcaaactccaaacatgccacccaactacctaacatatatttctgatcaaaacttaggattccatatgcaaataatcttacatacctggtctttgttatataaatgttctgtcctgagtttgagaagatcataacaagtagtctgtcaaacaacccagggtaataatacaagtttttctgaatcatatccacaccttttataaaaaatgtccagcagttgcatttagaaatatgtaataatttttactaagatgttgcaacatgctttatggcttttcttcaaaattatatttcctaatattgtacagattggtttcccatcctaaaagtcagtttttttaaaaaactgtcccaaattttcgagtgtcttcatttcttaaaatgtttttgtaacaaatactaaaatcattgagtgtgttttcaacaaaatgagattatgtcataaaatgcgtctttaataacttttagtaacattttgaaggaacgatgaaatgattacttttcctttagtagcttcagtgactgtctagcaaaatctcacaagatggcaagaattaatccaaagctgaacaaagctaagacatcacttcctaaaaagcgtttcttttacataaataaaatataaattaacttaaaatttatttttgaaaatgtacaaaagtaatgtgatagttgaatttcaaaaacaaggtcctatgaacttccacttgtaattttaaaatagcagctacattagaggtaaagttttaatttctggaaaagtaatacctaacgaaaagaataaatttttttatttatttttcattttcttagtcttgtatctcaagatttgcagctaggctggagttgacaagtacagcgcactcttaattaaagttacattgaagacaaagattagaaataaaagtagatgctttgtgaaaagcattggcctttggtttcccttttacacttttcttagaagtaaaaaacacgctattaatagagaagtctgtactcataaatgtcactgatccatcagttggtacatttgaagaaaaataaaacttctttcacctaacagcagctcagattggaccatgaactgctgtcaaatgttcacaaagccaggaggaaatataaataggattatctcaggtaattttcttttaaaaattgcctgtgagactttagataactagtgtcttatactgcaaatttattatcttgtttcttttctttttctcatctcagtatgcttatagacctcctctgaaaggtttcgaatcttacgagatttgcatttacatttcactttgctgcacagtgcacaagtgttccttagtaacgctgcaactgattttagcttagaaacttccaccttgtattattaactgtctgggaggatgcccagaatttaactggactactctaagtcactaacatgccttattaatcaatacatcaactcttagggcatagaaactcaaagcagtacactagaatgaaaaagattatttgtaagctaactagaagaaaactttagcaatataaaagagaaaaggccgtgataattaaaaccagcacaattcaggctacagttggaatgaatctattcctacatagatgtatacaaattgttctaaaaccactagcatgattgaatcaattagctactgcataaaagcctcaacaattagttgtttaaaacaccaccatttgtttagcacatgattcagctactcagtaaatttcgtagggttcagagaatagttctggcatcatttgggctaccctatgcaactgcgagtctcctgagagattatttctgcagcttgactggctgatggttggggtcccttggccctcccatatcatggagtcgctcatcctccagcaggctcggtttgtcacatggcagtgtcaaggttcacagggagagggggaaagagagtatgtctggtatcttgaggtatcttcctggtactggcacactgtcaattataccacttcctattggccaaagcatgtcataagactagcccacatttaagaggtggggaaagaaactttacccctttctgtatttatggcatttaaaataagaatttggaaagaaaaattgaagccatccttgcaatcagcttattgaaatattttactttctgaacatttgttgagagataaaagcattttacattttctttctttctttctttctttctttctttctttctttctttctttctttctttctttccttctttccttcttttcttttctttcttttttttttttttttacttgaggcaggatcttgctctgccacccaggctgagtacagtggtgtgatcatagctcactacagcctggaactcctgggctcaggtgatcctcctacttcagcctctgagtagctgggactataggcatacaccaccacaccctgctatttatctactttttgtagagataaagtcttgagatgttacccaggctgttctcaaactcctagccttaagcaatcctccgcccttggcctcccaaagttctgggattacaggcatgagccactgtactcagcctacatttcccaatactgtgatttaaaataagctgttgaattccaccttactatgacaattttattgaatcattttttaaaaactatctatgaaatccccatcccaacttctgtttctttccataatgctaggatttctgagtaatttaaaatgcagagacatctgatggagctatattttgcttaagactattagaaatatatggtttggaagaataattccaattagtctttttcaaacatttactatatgactgttattgttatataatctattgggtacaaatgaaatgaaagtaaattgtccttcctgtaaggggattatattcattttgaagatgcaaggttatatatataattattagtcaaataagaaatgttagaaactatttgatctatttatatattttatagaaatgtctcctcctataatagtcctactgtttatgacacaacttgagaacactgtaatgcccaataaggtggtaggttgtaagtcaagcaagaaatacaaaaggaattagaattaggagagagacatcgaagcaagtattttcagggaagattacattgagcgggtgggacttaaatgggccttgaatggtcttggtatttgtgcaaatattaaattagcatctccctattctgagcccacccttctacactcttctctaacatattagagttacaactctacaaacctattcttccttttcagctggcttcgtgttaggctctgccaacagggagcattagagggagactaaaaagcttaagaaattattattactatttttatgagacttaatcctaagaatggcaaggattcattggttggcatttgttctgcaaatgaggactcttcacccatgaccctctcctgacagagcatgggacccacctggagatgagttgagccaagtctatggaaggaaagtctggggacaaagaacaggaatggtcatgagaagattaaagggtatggttacacaattggactcattgaaacagaaggtctctattgggaaatgatggaaaatatgcatggatatagaggtagattatcttggaaagtcaggcagaatcgctgccttaacaaacataaccacagtgttacagtaaagaaatgttggggctaggtgcggtccctcatgtctgaaaccccagcactctgagagatcaaagtgggagaatcacttgaggtcaggaggtgtagaccagcctgggcaacatagtgagacctcatctctacaaaaaataaaaaaaaaaaatagccagtcatgatggtgcacacacttccaaactatcaaagcagtgtcagctactttggaggttgaggcaggagaaacacttgagcccaggatttggaggctgcagtgagctatgattgtgccactgcactccagtgcactctggtcagcagagcaagaccttatccctgaaaaaataagataaaagaaatgttggaaacttcagtttctatgtgctcttatttaatattatcctaaggaagtcagcattcctattttaaaggacacactgaatattattggtggatctataatgtttgcttaaattgcttttcacgttattttatttatttaaaaaataattttcttaaggaaaactaatttgatcctgattttacattgtacagcagtgatatgaataaatggtagattgaagatcacaaatgacctaggcagccagtagtgaacgagaagagctggatttactactattgttagacttttcaaggctcaccttgaagaaatgtagcacagctgcaaaaagctggaaaatgatgtatatttttcagaaatggcagacaataatgaggacaagtgagactgccctatttaaagaactgtaaagttgtacacggcatggactgatccaggtgtagcacaatgctaggcacagaaagagaatagctaacatgtattaaacagtccctaagcaccaggcaatatgttaagtatattgtatggtctatttgatttaatccttgtaaccctatgagagagatggtatcattgtcctcacatcacagaagctggaaaagaggctttgaaatttagtaatatctatattcaaaaccaactggactccaaaggtcacacttaactagtgcatttacctagaaaaaacttaattaataggtagtgaataattaactgaattaatctgtgcagaaagagtaatcttgctcttcaccatcataatgtgtattttataccatctgccatagatattgaacataccatcagcacaattctactcaaaaacaaacagaaaacataatgcttataataaaaaggacttccaaaatcaaccgaaggcctgaaacctggtaagcacagtctataagaagtgccagtatattgtcttaattttcaataagtagcacagcgcaaaggtattgcaagccatatggattttgacaaccgtgctttaataactttggaaaagccttactacttgttaaaaaaaggaaaaaaaggttttagttggcttcttacaattaaccaccctaaaggacttttctcccaaaacggaacagttgattccacaattcatgcaatctaaaaatcaaagtatctctatacatgagatatataaccttcatacacgtattcgtgtgcatgggcctgcacacacacatacacaacacacacagactcagaatgttggagctaagaaggtcccctgggatcctcaagtccatccccccaacacccaggtttgcgtatttcacccagttcatagctcaaggctgatattcagatggtctgcaccagtttgtacgtaccagttaataaaatgagaaaatgattcagaggcagctggtaaacaactatagtcatttcctctagtctcccagggtcttaactccacctctgcaattaagttttcctgattcctaccctgaaacacctagggaccttttcctgatctagcaaccaaagagtgaacccatggggcagcaggaagcctcctcaatgttcctgcatgcaggttgatcaatatttttaatgtcaacgctaagaactgactagaatccagagcttcagtcccaattccagagttctatcttgtctaaccacctgcctttcttaagtgttagtattttattgcaatcaaatgaatttctttatttttactgcaaaacactagtcctagatatttaaaggtaacctttccctttccattcaaacttaattccttttgttttgtttatgttttaccattttctccaactcattgtgcagtttattgatgccactgtgaatccaatcacattactgttctctttcaatgctttttttctcttctgtatttagccaaatttttttagctattgccctttcttctttttttatgacacatttttacccaacaaatatgtagtgatctaggaatgatctagctgaatgtcttgcatgtctaaaccatttttccttttctgtatattatttcaaatattcattgaaactgtaaaaattaactaacagtgaatcaataagaattgacttgatatataatgataaagttttgtgtacagggcttaggctcttagaattttttgcacagcgcttagaaagtaagagctcactatttattatgttacacatttgagtgaattcatgcagcttccaaaaatgatgagagctgactaaatttcagttggctcacttaattttcacatcactcatttacttagccaacaattcagtttttttctttttcttctctctaatatccaacaatgtaacagtcatacttcctgggaaatgttcagataaggataaagaaattcagggctggtccctctaactacctgcttattttaatctgctatagtacaacatctccatgctatatatgctattgcaaattcatagaagttttagaaaaggaagggaaacctctaaagtctcataatcaatgtttccctttattgagtcactattacataccaggcataggtctaagagttgcatgggtcactcaatgttctgtacatattttctagtttgattctcatgctagccctttgggatgtgaattattattatctccattttgcagaaggcatgaagaagttcaataattgttctgtatccacactgaaagcaatggagatattttgactcctgaatctgaaccctttagttagtacattgtacatctaatacttgccaaaaccttgtgaaacaggtagtgtatcaaatttttatggaagaggaaactgagctcatatgattttatgggtttaagtgtgtccttaaacatacaaatgtatgtttaagttttaaccacccccaacccatacccctgaatgtgaccttatttggaaacagggtcattgcagctgtaattcgttaggataaggtcatactggagtagatatgggcccttattcccatataaggcccatttaaaaggtaaatttggacacaggaaggaagagaagactatgcgaagactcagacacagagggaaggtggccacatgaagacagagacagaaattaaaattatgctgacacaaaccaaagaatgcctggggctaccagaggctggaaaaggcaagaaagaatcctctgctagagtcttggcagaagtagcatgccatgtcatgcactcctggcccgtagaactgtaaaagaataagttttttgttgctttaagccccccattttatggtactttgttactgcagccctcagaaaggaggagagtgtttagcgtttttgctaaaggccatgatttagtaagtggcaggtacaaaattattgatgtggatgaataaattcaattcttgatatatctgaattttccaaagacatggaattaagcattttctaaatgcctgataattgcttcctgtacttgtcctcagcctttccccactacacctaacaacttctgcatcatttgtcccacaaataaactatgtgtgctaccattgaaggccaatctacgcactatcccaggccatcttgcctactcaagactccaatatttctccccttctccttctacatcatttgcctactctctattggctcactcagcatataaggctgctgttattttttctcatttttaaaatcaacaaacacacacactgcttttgactccactgcttgtatcagctactgccccatcccttcgttgttttgcagcaaaatggtgcaaaagagttatgtatcatatacactgttttggattcttctgccattttaccttaaaaccactttggtatcactccactgaaacttccctagggaggacaacaatgacctccatgtcactcaagccagtgatcacttctggttgcttatctaagttgactaattgtcacggtgatgacacatatatacaaaatgtttcacctgaagttcaagatagactttctttacaaggcttccaaaatatcaaagtgtgttttcctcctatgtctgtagttgcttcttggcctcttttgctactctttcctcttctttacctcttcaggttgaaaagcctcaggacttaaatatcagtgcttttcaccactttgtctaaactgctcccttcctgagttaatctgtatgcctctgactcccaaattgatatctcaaattgatatctccattctcaaatcctccgctagacttcagattaatacaaatgcaccactgttttcttcgagtctatgttcaacacagtagccagagtgatccttttaaaacctaaaagctggatcatgccactgctctgcacagagctctgcaatgtgttccatctttaacatctttgaaatggcctacacatccctccattctctgagcttttctaccagtttttcccccatccttcatttactctgatcctgcacacaagcctactcgttgttccttggatgagtccttcatactcccaacgcagagcagccctcaggctctttcctaagcctagagtgctcttttctcagatatttgcttggctaattccaattctcacacacccatcacaactccactcagacctcaccgactctgtgagtctttctctggacatcctactgaacattgcaagctgccggccccaccctgtctccaccctagcacccctgcccctgatttcctgattcatgcttcctttttgccataataatttaatctactatacaatttaattatttattaagttctaatttttatactgtcttcctatggtagaatgtaagctctccaagggcaatgttcccaaactgttttgcccattggtatcccagaggatgcccagagcctggcatatactaactgtacagaaaacatttgttgaatgacagaactataatcagtgataacttaatcactatacattggcactgtggtaagatgcttctttttggttcatatataagagtgaagaatcttctaagaaatattggcatttccagagcttatacttgcctactttcttatatcacttagatgaaaataattattggaaaaggaatataatatttatagatttttaataaatagttcttgttttatattattctcttgattctcttggaatgaatgaaagtttttctcttgggtcatttttctgtgatccagtaaaaaataaaagacagctgttctatttttgcactgtattccttactgcagttcatagcacaatcaatactgatttacattaatgcaaaacttattgcctctaccaaataagcttccaaaagggtcttctgaataaattgaaaaaatggtgctaaaagttcagcaaatctcaaatcataattggatagctgtgccctcagctggtaaaaaattgtatgaggtgctgagtgtaattttatttattgatttccttcgttctagagttggtgaagggcaataaaaggaatagttaaatcaaaatgttgaaatgttgtgatttattaatagaaagaatgtgtcacatctctctgcacacctacaaaattgcttattttgtccttaatgtattttcagacagtgtttttatttgggaaaccaaaatgaccaccaggtcacttttcaataatgtctttcttctttgaatctctcagtaagaaaagtttcatttactttatgtgttatgattcatggtaaattatttatgatacgatcaggtaattggaagtatctcatgattccctccaatctttattttcatagattttaatttttcaggtagaacaattcagtcatggacaaggttggcagaaaaaaaaaaaagcattccaatttgagtggacaggtgcagtattagacatccaaaaaggcatttaggcaggtgtttttccaagtggttataaactatggtatgtacaatttactttttcggcattttcaatttggagacagaaatatatttatatgtttttcttagtaactttgtttcatgggaattttcttgaattcatataatcctagatttaaaaattcatatcctataagggatctgaattaatagatgtttagaaatctagagaatttagagaagtttagaatacagtcagccattagtgaaatgtagagcatgatcagcctttagtgaaaatcaaagtgaaatctccagataacgaaatcatgtcatacttctatccagggatccatccagataagttttagtttaaggcctctgaataatgtgtccaatcaaccctcaggcttattctatgaaaagtgtgttttataataaaatattcctttatgctaatttgccttttgcagcatttacttgcatctggatgccataataatttttttagtgaattaaagatataactgcaatactataagtgatggcagcagctcctcaagcaccagtagttccttagactgcacctatctgatatccagtcgaattggagcttcaacacaatgtaaactgtcttggtccattccagatgctaaaacaaaatatcataaactgggtaacttatgaacaaaataaatgtattttcacacttctggaggctgtgaatgggaagtcccagatcaagacacttcctcgttcatagaaatggcaccctctcgctgtgttctaacatggcagaaggagcaaggcagtttcctgaggcctcttttgcaaaggcactaattgcattcatgtggtgttcacccttatgccccagtcacctctcaaaggccccacatcccgataccatcacatagaggagtaggttttcaacacatgaatttgcagtggacatgaacattcagaccatagcaaatatgtatgtattgaacagaaatatatataatctgtgtctaagcttgaagccgtctacatttgagagaaccttcccaacttccactgttatacctacttgttaaaaacctgctggataggctttctctgtcacttataagcaaccgcgtcatcgtatgaccaggtagcacactgtgtgtcctgtgtatgtatctttcatggagcgctgaataaactaccgtgaatttgataccttaaacataaaaactggagaggtatttgaaatgttcacccaagcagagaatgtgttcttgtacttttctattaggagaaaatggaaaaatattattaagcaacttgattaataaggtagaatatttcttccaactgtaaaatgcctgaatttgtgtagtatttagagaaagtatattttccaaatagtacattctatttattttaactatatcaaacaaacataaatatggcttaagagacttttttttttttttttttttgagacagagtcttgctctgtcgcccaggctagagtgcagtggcacgatctcggctcactgcaagctccgcctcccgggttcacgccattcccctgcctcagcctcctgagctgggactacaggcgcccgccaccacgcccggctaatttcttttttgtatttttactagagatggggtttcactgtgttagccaggatggtctcaataatatggcttaagagactttaaaagatacatgtgtaaagcagagagagagagagagcactcctaaaatattattaaatattaaataaatattatttaatatttaaaaatattataaaaactagggtgaagtaggaggctggcattgacagacctgcctatctatagaagataaaaaagcaaataaaatttaggataatgtaagaaggaacattctagggaatagtttgtgtatagtagatttgattatctttcttgcgttataagaagtttagacaggcttcaggcttagacacagataatgtatatttctgttcagtacatacacatttgctatgatctgaatgttgtgtccacggcaaatttatatgttgaaaacctactcccagaaattcactcagaagcaacacatggtaagatggtaaaagacttaactggctggctgtgctcactctcccaccttaacctcacttttctctgcctatgatgaacaacagatctcagggaaggtcaaattccatgctgtgatttgtaattcatctaataacaaaacaggagagtaaacaattacatttattttattaattttaaatttggatgcttgttgtaggctgtgtctctttgaaaatcagatacatactgaggaggaaacacaattgactctttaacgctgtaaaaaaatcagaggtgatttttttcccatcaaagttttctattggagaaatagaatatgcagtagaaaaaaaacaggaagaaatgcatggccttagtggaaacaaacttctgcattattttttctattcattgttctggctttagatatcagcccagaagataatgacctggaggtagtggctgcctgttgggtagaggcactctttgtacctgtggagttcattccaaaagaggcagatgcccttagaatcagcttttctaattaccattactacaatctacagattcaatgcaattcctgtcaaattacgaatgtcatttttcacagaattagaaaaaaaaaatcctaaaatttatatgggaccaaacaagagcccaaatagccaaagcaatcctaagcaaaaagaacaaagttggaggcatcacattacctaactttgtttgctacaaggctgtagtaaccaaacagcatggactcgtgtaaaagtagacacttagaccagtggaacagagtagagaacaccaaaataaagccaaatacctacagccagctgctctttgacaaagcagacaaaacatgcactagggaaagggcactctattcaacaaatggtgttaggaaaattggatagacataggcagaagaattaaactggatccatttctctcaccatagacaaattaactcaaggtggattaaagacttacatgtaaggctggaaaccataaaaattctaggagaaaccctaggaaacactattctggacataggcctaggcaaagagtttatgactgagaccttgaaagaaaatgcaacaaaaacaaaaatgaataaatgagataaactaaaaagcttccgcacagcaaaataaataatcaacagagtaaatagacaatgtacagagtgagataaaatatttatgaactatacttctgaaaaaagactaatatccagaacctataaggaactcaaacaaatcagcaacaataacaacaaaaaacagataatctcattaaaagtaggcaaacatcatgaacagacagttctcaaaagaagatgtacaaatggccaacaaacatgtgaaaaaatgctcaacatcactagttatcagggaaatgtaaattaaaaccacagtgagataccaccttaccctagtcagaatagtcatttttttaaaagtcagaaaacaaatagatgttggtgtggatgtggtgaaaaagaatacctatacactgctggtgggaatgtgaattagtacagcctctatggaaagccatgtggagatttctcaaagaactaaaagtagctctactgttccatccgggaatcccactactaagtatctacccagaagaaagtaattcactgtattaaaaaaagacacctgcactcatgtgtttatcacagcacaattcacaattgcacatatatggagtcaacctaagtgcccatcaacagatgaatgaataaagacaatgagatgtgtgtatacatacacacacacacacacttcattgttttataaatatatgcacacatacaccatggaatactactcagttattaaaaaagaatgaaataatgtattttgcagcaacttggatggaaatggaggaggttttcctaagtgaagtaaccagaaacagaatgttctcacttgcaaacaggagctaagctatgggcacacaaaggtatacacagtggtgtaatggacattgcagactcagaaagagagagtgtgggagggaaacaaaggattaaaaaatcacctgttaggtataatgcacaccatttgggtgatgggtacactgaaaccccagacttcaccacaatacaatctatccatgtaacaaaaacccacttgaaccccaaaagctattgaagtaaaaggaaaaagaatcagcttttctcgcttcatgtgtttgtcgatgacccactttaacaaaatacaactaaaaatctgaatcttattagagagttaagttatgaagtgtttgtgtgctttttataagtaacacaggattttcttatagctatcaagctccatagagtttgataaaactatttaacctgcaaaatgttggtttactgattctcttatcagagacacatgtcataaatagaggcactcatagcaaaacacccctcatttttattacctgttgacaattctagccagaggattgcccatttttttacttaatcatcactcgtggccaggctgggtacagtggctaatgcctataaccttgggtctttcaaagaccgaggcaggaaaattccttgaggccaggagttcaagactatgtctctacaaaatgttttttttttaaattagtcagatgtggtggcacatatctatagtcccaactacttgagaagctgagacaggaggatccggattacttcagcctaggagttcgaggttgccatgagtcatgatcacaccactgtactccagcctaggcaacagggcgaggccctgtctcaaaaaagaaaaaaaaaaagtcataactcgtggtctctttagtggcctctggtctttttaactaatgtaaattctgacttcatttagacttaaagctattgctcattttaaagctgttcttatcttattagacctatgctcaaatcctttaatagttgaaatcaattgagctattatttattaagtaactacgatgtaaaagacaaaatactagggatcatacagataaaaagggatgagtgaaatagaaacctcattctaaagtcactggtttttttgtagagcattagttagcagctgccgtacaataaatcatgccaaaatccagtggcttaaaatagtaagaatgtattattgttcatgagtttcttggtcagctaaacagtatttctggtatctactggtctcatttatttgtttgtggtcagatgtggattaggcaggcaacttgctgagttggttgactctatcacatgttctgggagactggctagctgtagttcaagttggccttggcataatacccaggctttcctccatgtgatctcatgtcctccactagactagcctaggaaggggtgcatgaaaaaggatcaaagcacacaatgccccttgggcctggactctcggaagtggcaaattgacatttttgccatatttattggtcaaagcaagtcacaacgtgtccaaaattggtgggttcttggtctcactgacttcaagaatgaagccgtggactatcgcggtgagtgttacagttcttaaaggtggtgtgtccggagtttgttacttctgatgtttggacgtgttcggagtttcttccttctggtgggttcgtggtcttgctggcttcaggagtgaagctgcagaccttcacgatgagtgttacagctcttaaggcagccagtcgggagttgttccttcctcccgacccgagttgttcattcctcccggtgggtttgtggtctcgcaggcctcaggagtgaagctgcagaccttcatggtgagtgttacagctcataaaggcagtgcggacccaaagagtgagcaccagcaagacgtattgcaaagagcaaaagagcaaagcttccacagtgtggaaggggaccagggttgtctctgtgggcttgggcagcctgcttttagtcccttatctgaccccacccacatcctgctgattggcctattttacagagagctgattggtccattttacagagagctgattggttcgttttacagagagctgattggtccattttgacagggtgctgattggtgtgtttacaatccctgagctagacacagagtgctgattggtatatttacaatcgtctagctagacataaaagttctccaagtccccactagattagctagaggcagagcactgattggtgcatccacgaaccctgagctagacacagagtgctgattggtacatatataatcttcccgctagacataaaagttctccaagtccccacccaactcaggagcccagctggctctgactaatggatcctgtttcaggggaatgggcagaactgcctgccagtccaacacagtacctgcactcctcagcccttgggcagtggatgggactgagcgtcagggagcagggggcagtgcccgtcggggaggctcgggctgccaggagcccaccgcagggggctcagacatggtgggctgcaagccccaccccaccgggaggcagctgaggccaggtgagaattcgagcgcagcgcaggtggcccagcagtgctgggggacccggcgccccctccacagctgctggcccgggtgctaagcccctcactgcccagggccggtggcgccggccagccactcagagggcaggacctgccgagcccacacccacccggaactcgcgctggcccaggagcgcttcatgcagccctgattcccacctgcgcctctccctccacacctccccgcaagcagagggagctggctccagcctccgacagcccagagaggggctcccacattacagcaacgggctgaagggctcctcaagcgtggccagagcggatgccgagcccaaggaggcgctgagagcgagagagggccaccagcacgttgtcacttctcatcaagttagggccagattcaaggatgaggaaataggctttacaaattgatgggaagagttgtaatgtcatactgcaaagggcagtgttaaaagaaggcactcatcaagtacatgaatgcactcaatccaccaccaggagaacaacgcaagtaaaaacaattatatactctaagatattctagaaaaatgccacaagttaaatacactagactctcaacatttaggattaacttttcttttcagtttttggtaatttgtatgctgcagaaacatgagatagtttgacactttgttaggaaatacttctttatttggcaatgccttcatcattcatcttttccactgaaatttaagctccaccaagaatgtcgtcctaatcattactgtatcttaagtgtctgcaaagtacccagcacaaagtaaaaacctggcaaatacttattgaatgaattaattcatttataaaaactctaaagatatcattttacatttttaatttataatttctattacaaatttttctgctttgtaaaatggggatactttaagtacaatttcgtaggattaaatgagtttatgtatatatatatatgaagcattcaaaggagaggacaattgaaaaattgcaaatattacatatgtgtttgtgtgtataatacactaatcacttttataatatttaatgtttaattttgcatggaaaattacttactaaatgtcttggagtctggggatttgtgggttttttggagcacttactcaagtatataattccataaaccaatatagaggtttcaaaagaggcagaggtcaggggaggggataagggaagctttcacaagcaagataatacctgagatgaaactttgaaggagaagtagaattttgtgagtgcagtaggttttcaggaaaagagaacattgtgaagggagtgcagaggggtgaaaatcggcagtagaagagtaatgtatagtctgatttccaaatatactgggggaataatggaaagcaaatctggacacgtatataaagagttcagcataaatgagtctttgtagtggcctttgtgattcactagactatcaataattatccacaatcttttcagcaacagtgatttctactctgagatgaaaaaaattcatttgcagcagtgtctaaactattaaaagtgaaaaacaatagaaaattgaacgaactgggagaagactgtgagtgtttaattattaatgttttttgaagtcttgagtgaaatgacggcagtgactgaaaagagaaggaaggatgtaagaaatatttggtaacttaagatacaagggggagagtcaaaaataagtgaaatgactgcaacctacaacatccagtcggaagacatcaggggacattaagtgaaattgagaagttaggaaaaaaagaatcttttgagactagaaaggtggatgaaaataaataaattagaaatgaagatataaataatgtaaggggcagcagaatttctaactggatatctttaagggacaataaggaatatgagtttagagctcagacagcagagatgtgtatttcgtaggatcttcaccgaaggaaaagtttaatctttgggtttgtgggggtctctaaggaagaaagaggcagatgaaaattatttcagggacagctgtagaagaaggagaacatactccttgttttgaaacagattccttttcatattacttagcttaataaacacttgtgctagatttttgatctgctatgtaaaagattttagatagtctcgcaccagattagaaatactcataatagtctgtattagatccacaaatattgtccattcacgacaacaaaaaacaatgtgactagattttaggaaaatatattctgtggttgtgatctgttttcctgagaaacagaccacttttataatatttaatgtttaatataatagcacctgtttggaattacagtaaagatatcagtgtaacaggaagtatatttagggagtgattaatgatgtgctattgactgaaagtgctggttggaaacattggtggtgctgttgattccgactgaaagcgctggttggaaacattggtggtgctgttgattattatttaatgattttttttctggattgctgaataattgacactgatgagaaggtgactcagcattgattttatgtttcccagactgggtttttgaaatgtcaatagcagtagcaccttattaagtgcatcacagacagaagtaaatgtttctagtagagacttctctaaaggtttattagtgattaaatatgttagttccttataaaaatagtagaaattactattctccatttacacacaaaacagaagaataagatttttctcttaaggtatttttagatagtgacagaattagaaataggactcaatataaccttgttttggaggaaaagcataattatgctttaaatttgtgtcatatgaaaacatagttttaaaggctgtgttttattaatgaatttatcttttaaattaactcgtgttactttaaataggatctgcatttttaatataaagagcataattgggaaagaaatatagaattgattttatttcattagtatttttatttaataaaataagtagattgtaacaaatgatagtcccagtaataataaaaacattgtggggcacatatgcaaatggagaaacaagtatcttaatttgttctacttaaaacaatgaggataactttagattaccgtattgtctctagttttctaccccattttttttcaggtaacctatatttcatccttactctattcaacaactggtgtttgtgtaccacatagaatattcaaattgcagatcctgaaagagacagacgataaacagttcaattttgtgatttgtgacaagtgttttaaaaatgaaataataagctataatgagatagaataccagagtacatctcgcataatgttactatacaatactataatgtattgttttataaaacgtctgttttatgtatgttttatatatgttttacacatctaagtatatgttctgggtcgcaatgtaacgcatattttagatcaaatggaggagctactgatctattcagagatctaccctgtaaattattcctctatcacaaattagtttttaattaattaatcaaatatttattatgtgcctgctgtgtctgtgaaaattaaccacaaaaatataatttacatcatactataaatgagttgacatttggagtaagatatgttccaaataaaaaagagaactggcaaaatgaatatgtcctggggcattgttttgcagtactagcatttcatttctttgacatcttgaaactataatatacactattataatttactttcatgtgagaaatggttctaaatgtttttatgttgtaaaagtaaggtttgtaaacagtaaagggatgtgcgttgaaggtctgctgtagtatgtctgttttgcaccaacgggacaatttctatctcagagcatgtaaaccatctatggatggctcagcaatgcttcttatattcaccattgactaaagtttatttccatttttaaacaaatattttgcagcaattaccaagtgacaggtagcatctaaactgctcagagtacaatgatcaagatatgatgtgcgctggagattttagtctaatagtagacactgaaatattttaattttttattctgtgtgtttcactttggtctataaggaataaaaagaaggctcccagcaacaagggaaaaattagctaatatatagaatcattttgtcacatttctgcagatcagtgtgtgagaaactgattgatttgaagaagatagaaagtgtcgaccctaagaatacagggatataaagtcaaagaaagttgttgggtctctattagcctccagataatttattaagcttcctagagagatgagctatgtggaaactgttggctgaaatatgtttgggtataaatatgaaatggaaaaactatacttatatcactccacatcttattttcaagttctttaaaaccacttccaattttgttgtcttgagtggaaggataaagtggggcattagaaatgttcataaatgccagtctcattagaaactgtcattccacagacaatgttagattgcttccagtttcagcctagatcaccattatgatgaccttgtagacaagtgtgcatttcttttggaatctgctagactgattttgcatttaaaacagctaaagaattctacgcatatttcctctgtcatgcacaatctgtcctttaatagccttctgctttcctgttgagaacctgctgaaatgctcttatgcataaaaacagatgccccaaaattccctctcacaaccgtttttacatttatgaaagtagatttcactttcttgaagtaaattcaagatgctcaaagataaacaaaatacctcaatacagtaaaacttgcttcaagctgactaaatcaatatgttcagatacaagtattcttcagattggcaaatgtataaatcacctatttcattaaataaattataaaatttgtacaatgctatctatatacttgtaacttaatgcaattgagcagcaaggtctgactgcaaacctaagaagctcaatctgggctaagtaataaattttcaaataaaagttcaagagtaattcaagtataataaaaaaaacaagaataaatacaaaagaacgtagtagaagataaaagtgaaaatcttcattttctttctttctttctttctccttccttccttccttccttcctgtctttctttctttcttccttccttccttcctttcctctttctttctttccttctttccttctgtctttctttctttctttctttctttctttctttctttctttctttctttctttctttccttctttccttcttttcttttcttttcttttcttttctttctttttctttcttgtctcactctgtcgcccaggctggagtacagtggtgtgatcttggctcactgcctacctccaccacccgggttcaagcgattctcttgccttagcctctcgagtagctgggactacaggtgtgggccaccacatctagctaattctttgtatttttagtagagacggagtttcaccacattgcccaggctgttctggaactcctgacctcaggtgatctgcccgcctcagcctcccaaagtgctgggattacaggtgtgagccaccacacccgaccatgttttgtttttcttaatttagtgacctactttgtggcagttcattcctcaatgcataaagaataaactattcaatatattagtaaattgaaacagagaacctatgtaacaaatatgataaatacctctaaggtcactgttacctggaaggtgttcatgtctcaaccctacatgatcataagttcctcttccttaagttttggagaattaggtgctaccatagaattatttttaaaatgcagcagagaatagagcaaggctgccatatataggcattttctcccgcttattccaaaatcattatctttaattattattttgaataatgataatggtgcatactattattgtactctcaagttgtcatgaaaattcacatttggaacttaagactactggagagtcatagactaaacccgtggaggtgtctaggggccttctcagtgtagctacctcactagaacatttcaggacttgtcttagcaaatgaactcattgtgccttgttacagacttagaagagataagtttcattaaacaaagactagtgtgtttctgattactactgctccagaacaggcctcctctaacttatttgattatgctcatggattttgtgaatcagaaacgcagatagggcctagtaaagatggcttcccctgctacgtgatggccagggcctcacctgggaagatggtgtctaggggtaaatagataactagaggatgaattcatttgcagagatctttactcatacatctgcgggtagctgctggccattagccggagcatataagcatggcttgtccccatgacctcgcttcatactgtagaaagcccagcacagtaagacagcttacctggcagctcaggaatccaaaggcaggtgacccaagaaactaggaagaagctgcatggccttcattttagtacccactaaagctaaatagtatcactttcttgtattctattgcttgaagataacctgtatagttattatatgacctagattcaattcagtgagaagggacatagacctccaacacttgatagaagcgtcaaagaatttacagacagatttcagaaccccaccacagtgggtaagcactccgtagctgagatgccagagaactgcgaaggcagtcctggggtgggggtggggggtgggtactagttctgtggatggaaaggaagaggcagcactctgttcacaagattatatgcttaggacatgatctagcaacactggcatttctgaatatccctaatgtcctatccattccattcgtctactcaagacaacagaattacaaatacctgcaaagaatttgaaaataaaatgtgaaatgatgtgtaactttgccagttcgcatttatactcaagcataccttattataccaagtagtttctttgtctcttactctctgggacactctctgtccttctctaattaatctcaatgccagtattacagatacctggaaagtcatccagagaaaattatcattcaattgtcccacttctatagtataattctccaaaacaattgaaattaccattgagtcatacacatgcgcacgcacgcagacacacacacacgctcagatatatgaaaagaaaaacattagcaaacccataaacaaatagtgagataatagttttcaaggaaaaaataagctttcgaactttagaaaagaaaaattgaaattagttctaaattgatttacgcatgtgtatgtaaatatgtatgttatatatattctacatataataaacacataggtgattgaaatgatagaggtacatatgcctgaatagttatgatatgtgtattatatgtatgtgtttatacgcacagagcaataaatatgactaggcaaaatttaaaaaattaatactagtgtcattatctgttaatttgtatgttttcttattcattgtcatagaattcctggcattatttttctaaatgtataatatgggactaaacctaatgaatactctttcaatgcaaaggcacacctacatactctaagtggttgctattcaaccaggaatatgttggcagagaagaattaaaatcactgccattttacggctaacacacactgattttctggatggaacatttggttacactatactttcattaaataatatagtaattatcacttttgcaagatgttattctattcatttgcatgtactttaccatgctacatattggatacaaaataattagatactgaaaaagaggagttaaaatgtgggtaaaaaatctgctgtggcttccaacataggcaactagtagagacagatggaactgtgttcttgggatgtttaaggacttttagagtactttgcatcagcagcatctagagaccaattactgaatactctctgcaggagtcttgcctcagggtttttaaatggatgaataatatataaactccatggtttcccactgagagagactgaagcagcatcagaaagagtctatttgagttgaactaaaaatgaaataatttgaaatttgacctgaagtcttttgtgtttacatatgtagttggttgtaaggttgcaatgcaggggcataataaatagaaaaaaaatgctataagctttttccttttctgagtctgggtaaaaatgaatgagaatggagaattaatctttcaattcataccccaaaaatagtttataaaataatttctaatatgttactggaagaaattttctgcatttttaaagccctaaagtatcttggagcaccttatagattgtttatttcaaactcttcatattacatattagtttctagacacctgagaagcttaatgaatacacagttattaacagagatggcacaatatttggatgctcatgctactctatctcacttctgagatcacattatataataactacaaaataataatatcttcaacaataacaatacaatgaaatattcatttacattgtctcattttaacaacaacactctgtggtgtgccagtattaatcattttaatagtgagaaagataagagaagcagacccaagaatctgtaccaggcctgagagttcaatgtctttgctgaaacttataaaatctacctgtgcatgttttctgaaagagtcagattgtaccgcaaggtcagtaagatgcataaagtcacgttgaagacttcgatagcccgttcattcatttattcatttataagtatttatgaagcacatatctctcccatatgccaagcaaggagatggggctagggataaatcagtgaacaagacacaggtagtccttggcccatgtagtcaggaccttatgttgtcaaaaacaaagacaaaaaaaaaactgccttgggaaattaaccaagctgctgttatggcattttacatgtgagaaaacagtagtaacattagcatggacaaattctaacctaggtctcgtaatttctagaatgagttagtgttcccacaccagtaatcaaattattattacttaataagaataatcatcatttaattcaaattaaataattaagagcttggttggcttcaatttaggtgtgtaaataaattttatgaattatccatggtctgcctttccatttttccttgcttttttttattatttatttagtgggtaaaaacaaacaaaaacaaaaggtgaggtaaatactgatgtagaaaattttaaataattacattttgatgactagttgtggtttcttttaaaagaatcatttggagtaatatggactgtgtgttattactcatccaagttctggctcgtattgacaatttgagtaataaaagtttgtgagactaggagtgaaaaatctggactggaagggaagacctctgcctactctcttgagtatgaagtttaccaggatggttgctctctagacaaaactcataagcaatgcattcaaagagaatatgtgtagactaggagataaaataggctggaaagataaggtttatcttgtaaacactgaatttattttgcttttgatatttcctaccttaaggactttttaaaaattatctcttttttatttcaactatcttcagattgttaaggaaaaagttctatgtcaacacttgtaccaataacaaaagtgattacagaggcaatatgatgatggcattggtgttcctcaaaagaaatatggaaattgaaagatgaatatctaagcattttaatgttagagcattcttacacaaatgtgaggaagcaggttttattttataatggaaggctgaaatttcattcattcatttatttccaaatatccattgagtggttctaacctgccaggtactatgttaggctatagggtcataacaatggggaacacggaagcggtctattcactcataaagtcagcatcacagctatcaccttacacagcttaggttaggttaagaaaaaattgcgtattattttttcttaactaacaaacccttttatcaaatgacttttatgtagatccccaaaatataaaatccattagtgtgatatttacttttatagatattatatctaagtgcacatttctaatattggcttatagaggtgttcaataaaaccaatgagattttttgaaggaaaaaaattgaaaatggagatcataaatgataactcagaaactcacacttctgtcagcttcaaaatccaatttatctctatattttagtttggctgcactgtcactcagagtaagcagtctgaatcctgacatgtacaatagtattcaatattacttttttattttaaaaaatgttggcaatttgaagaaactttttaattaatttcttaatacacctgaaagattagtgggaagaaatttttgtttcaaatccaaatagatctaacacatgctcgcagtataatagttcagagtttagcatttgaggtgaaaaactttgtctttatttctaattggcatcttactgaatgtgcagtcatgggaaaactacttaactggcctatgattcagtttccctaattctaaaatggagatggtaataccagagttgcctgaagaattacataaaaaatatgtaaaactacttgggtcatactaaatgtttaatataacatgcttaggttttaatcttatttattaaataaaagtcatggttggggaagtacgtttatcccagtgtctgaaatccagcatagttcaagtcaccaaatttgtttaacaactgtgtgtctgcatgcgcaaagaggtggtaacagtaacaaagaggctgccaagtcccatgcttggtgggagaattcagtcaaagacacatatctaacttactattatgcttttaatcttagacttgctagtaagaactaataaacatcaaaatgttatatatgtaacatttaagagaacatcaaatacactattttttaaatatcaaatatacccatacataataataattttattatctttccttggcttaaattctggtaaatttccaaaaagaaaaatcaagtgtttttcaacagtgttttgaattaaaacttgattatttttgcaagacattttttgtttcccactaactcaaatgtaaataatattttgagagtttcaatgggttgctaccactaacagaaagagcaattttaaaagtttaaacagacactgtcttggaacttcggctaaggaaaattactaaaaactaaaagatattcacttttatgtcagaaatagattatgtcaaacagaaaaagtacttttactaggaaggacaattacattgcatgaccaaattcatgaaggttacagattcgtttcctgaactgctaactcaggataaccaatatttccaacacttacttggtaccaggtttaaccgacaaaaatgtgatacatatgatatgtagctagagattattcataaccttaactgacctttaaaaaaaactttctgaaataggtctctaacctcttctcagaggaggcttatcagcaagtttagctaaataggcagtgagttccgtgctgcattttgataagaatgccccctgtttagaaagcttcatggaagtattgccagaaatgcaattatttgattaatgttagaacctatattaagggcattaatagctttttagtccatgagtcctcaattaaaattcagactctgagtaaagccttgtttcctcataccctccccttccaagctcaatcctcttgacaaatattcactctccttttaagattcggttgctatttggatcaccttaaactctctccctccaaaattcttcccagctagaatgtaggtctctctgtgtttttttaacctatatattttacctgtacatacttctagtacagctctttaagaaagaaaatgtgtcaattatcttttatcccacagaaccaagcactatattctttgtatatagcaacataattgtatttgtatgaaagaagtgggcaaccaaaataaaatgtattcactgccttatttttgtcaggcactgtacaaagctcttgaaataagagctctttaagatacgtaatattacgattccttcatgaagatattgtcagccttgctatatagaagtaacgactggggattaaataagttaaatataaaacccaagtttttgattcacagcatcaggatacaaatccaaatttctttctcatactctcatgacattttcttttgagaacctgatactgagataattaaccaagtcttttctcagcattctctccatatgccctctattggtcagggttctgcagagggacagaactaacaggatagatgaatatatgaaggggagtttattgagtattgactcacatggtcgcaaggtgaagtcccacaataggccttctgcaaactggggagcagggaagccagtccgagtcccaaaaccacaaaagttgagaagtcaacagtgcagccttcagtctgtggccaaaagcccaagagctcctgacaaaccactggcataagtccaagagagcaaaagctgaagaacttggagtctgatgttcaagggtaggaagcatccagcatgggagaaagatgaaggtcagaagactcagcaagtccagtccatccatgctcttctgcctgctttattctagccgcactggcagctgattaggtggtgcccacccgtattgagggtgggtctgcctttcccagtccactgactcaaatgttagtctcctttggcaacaccctcacagacacacccaggaacaatactttgcatcatttgcaatcaagttgacactcaatgttaaccatcatacaccctcactgaacacctcatggaggcgcctggtagctagctagacagcaagggagtgactgtaatatgaagacagaattcaggaatcctaggaaaggtagctaaagggaaagagagcaatcagagtggatgcctggcaggtttttacagtataacaaattaagcatgctcacatgctgaagggtaagactcacaagttgagaaaaggctaaaatataggcaaaaggtgaggtaaccataggacaaatctatgacaaagcaagaagaaaagagactcaaagaagagttccaagtaccatcggtcaagaggcagggcagtcgcttgcagggaacttggcaaagatgagaaggtgtcactccagctctacactcctgactgctgaagcgaggaggcttaatgtatccagcacagtcttactattagctggttaacactttctaggccagtaaatttaattgtatccttatctgtggccaccaaattctctcctgtcctctctcccctctgctgtgtcttttggcccttgaaaccttagactcctcccgcttttgtcctccagaggacaatggtgtcctgtgtgattggtccagcactctatatactatacggttctgctgctggacagaaacagagcttcagcctctaaaggtggaggagggatggtgggaaaatgcctttagtactttgcttttcaatcatcaatgtgtagatgggagtctaattaaaatgcagattctgattctctgggtctgaattggaacctgtgagtctgcatttctaataagcttctattgatgttaaggttgctcatctgcaaaccacattttgagtagcaagactagagtttcaaatctaagggaaaaaaattaaagatggttctacttctaattcaaaatgtggtggtgaaatatcctctccctttttagttggcctcatagaggtgactatcccttatcaaaacactctgagaacctcaaagcttgccaagaattgcataaaacatctaaaagtaataaactataccgtttgtgcgtttttgtatgttatgacaactaatagaaatttgactcagtgtgtaacttccacggatctgaatctctgtcatcactgctgcattttttagactgatttttaatctctcatacaaaagtgtagatggaaatgtgaaaaaacaattgtaatccaaatattctgtactcccaattccttcttaaacaactgttattctactcacttccagtatgtactttgaccttacaaattttgcaaaaggtccatagaatgtactacaagagtaccaaattttacaaaatagatgaatttatgagaattggctaaagagtcaatttctgtctcttggatttctagaaataagttatatttttcttttaaattttattaataaattatagttgtggccaggtgcagtggctcacgcctgtaatcccagcactttgggaggctgaggtgggagaatcgcttgggaccaggagttcaacacaaacctgggcaacatagtgagatatcatagctacaaaataaaaaataaaaaaattaggcaaacacctgtagttccagctactcaggaagctgaggtggggggatcacttgaacccaggagttcgaggctgcagtgagttatgatcaggccactccactccagcctgggcaacagagtaagaccttatctcaaaaaataattaattagttgtacttagtgatacagaaatattttaaatatttaatttaaaatggtaacaatgtagtagcgatactggtgaactcttagtagagatttagatctaaattctatctcagccactgctagtgctaagattttgggaaaataacttatttgcacctcagttccctcatgtgcaaaagattaaacttatattacatgattcctttcagtgttatcattatgtgattatttaaacatgaaaaataattctcaaagcatgttcagttagttttcaatttgaaactgtagtttgaaaataaaatgtaaaatcacagtgacttcctaaaagataatagctaagctaaaaaataaagtgcctttcaatcagtctaaaattctctcctgcaggatactgtatcttttaatttctaatcagtttattgaagctgctgattcatttataggttggtcattgtaagagggatttatagtagaaacttacagaatctgaagtctgaaatgcagcagtcaatgaataagtatttaagcacaattattgaattcaatgaagagtaaattaatgaatagtaatggttcgattataagtttctgccagaactcctgaaactgcataatgatttccctccctgatttataatgataagcatatgcttattatgttcttataaaatgaggcaaattctttgcacatcaaaattacctgatgatttttctaaaaatacagctactggatccacccctgtgggaactgattgaatgtgaaaaacaacaaagcttgaaaaaccctctaatacatcatttaatcagtcatacctaacaccagctttcatgattcatccacagtgtgtgacttgaagcatcagaagtgtcagtcttattattaggtccctgttcagcatctttctgtcatacagagcagatgtagtattgggcttagtgtctatgaaatagttatgtaacaattattcaaaaaatccctgggcatatcagaagttactttcttataatcctcatttttctctgaagctgaagaatcactgtggtcattatttttagatattctctggtagtgcagaaaaatacgaaaggaaagggtgattaccatgttctaagttgtcactttcctgttttatgaagacaaactcataagaagacataggttctagtggtaaattttggtaagaaaatgccaggagaatttataaacatctccatccccaacagccaaaatatattcacttctataaagatctgcttttatcaagagtaacagactttggggaatgtcacatttcttttttttttgtttttttgagatggagtcttgctctgtcgccaggctggagtgcagtgacgcaatctcagctcactgtaacctccgcctcccaggttccagcgactctcctgcctcagcctcctgagtagctgggactacaggcacgcaccaccacacccggctaatttttgtacttttagtagagacagggtttcaccttgttgccaggatggtctctatctcttgacctcgtgatccatctgcctcaacctcccaaagtgctgggattataggcatgagccaccgcacccagctgaatgtcacatttcattctggttttagtaatatctatattagttagagtaaactgcttgttttaatgttgtgttggcctccaaatatatttacaaaggtggtcatttaaaaaaattttatactaaaataaatgtgtactctatagtataaattttttacacatttatactctaatattatgcaaacattcattttcagtaatttttatatgtatgttattaattttgtgggttacaaagagaaatatatccatttgggagggaaggcattgggtgatacatctaatttttattttgagtctcagagtaaatacgagttttaaatctcctaagcaactacttataaattcaggttaactgaaaagctataaaataagtgcagatgagaatcacataattacattatataaggttgtagcttaatggaactatatcgactgagctgcatttttagagcttagttctatgatcaactcgatgtatgatgaacaggttttcaaggctatatgcctcaaaatttttaacacagaatgggcagctctttatgaaaaaaaattattcataagtaaatcactgtgtgatatctattttgctccaaagttttgttatagttatggctgccttctaaaatgacattgaagtaacataatgcacatttgcaagacaatttctaaatgtaaaaaccttacttagtctggcataaataagacttgatgaagccatgcaaggtggggctagtcagtattgcactccttcttccaccaaacccgcccacctatctagtcctccactatatctcaaccaggagatggctaagaataaaataaataatacaatacataataaaaataaaagattaaacgttcctatggactgcaagtttgcatgtctccaaaattcatatgttgaagcttcaatccctatggtgatgatggcaactggaggtggtgctttggggaggtaattcagtcatacagatggagctcctatgacaggattagcaccttataagaggagactcaagagagatgatctctctccaccatgtcaagatacagcaaaaagtcagccatctgcaaagcaggaggaaggccctcacaagactgaatctgccagcaccttcgtcttagatttcccagcctccagagctgtcggaaataaatgtttgttacttaagctacacagtctatggcattttgttatagcaccctgaattaactaaaacaaataagatccagagtttcataatataatatccaaaatatccaggacagaataaaaagttactcatcataccataaagcaggaaagtaacttgaatgagaaaagagaatcaacagaagctaataatcagaaggtggaattagctgaaaaagattcaaagcattgtacaaatgcttcacctaacagtaaagagttctcatgcaacaaatgaaaatacagaaaatctcaccaaagaaatagaagctatttacaacgagtagaaatactaaaaccaaattttaaaactcactgcatggtctcaatgggatagaatcagtgaacttgaggataggtcactctatctgaaaaacagagaaaatacactgaaaagaaatgaacgtaggcatagggaactacgtaagagtagccaaaagagctaataattcttaccatcagaataattcttacctctcttacagaaagagaggacagagggaatacaaccaaaaaaaatttggagtaaaaatagctgaaaaatttataaatgggtcaaaatatataaacttacaggaagctgagtaaatcccaaatataataaattcaaagaaatgtatgtcaagacatatcattgttaaacttctgaaagctaagccaggcatggtggctcatgcctataatccaagcactttgggaagctgagacaggaggatcacctgagctcaggagtgcgagaccagcctgagcaacataatgagaccttgtatctatgaaaaatagaaaaattagccaggtatggtgatgtacacctgtagtgccagctactccaaaggctgagacaggaggatggcttgagcctggaagatcgaggctgtagtgagccataatagcatcactacactccagcctgggtgacagagagggcccccatctcagagcaaaacaaaacctctgaaaactaaaaacaaagaattgtcttgaaagcaggaagtgaggaatgacacatcctgtaaaggagaacaccaatataagtctctcacctgaaactatggaggccagaaggaagtagcacaatatttttcaaataatttttttaaaatctaccaactgtgagttccatgtctagcaaaaataatgttcaggaaaaaaaaatcaagcaaatctaccattacagagcagcttaaggaagtttttttttttgttttttgtttttttaaagaaaggaaatgataacttaagacggcttggaacttcagaaaggaaaaaagtacatctgcatgaggcaaaaataggagtaaatagaatatccttatgagtgtcttaaatcatatttgacggttgaagcaaagattaaaatgtcatctgatgcggtgctcaatgtatgtagaggaaatagttaattatagtgttaacatggggaggttaaagagacctaaatagaagtaagttccctatgtttcacaaatagtggtaaattgtcaaaaccagtagactactatacaagagatccttgtgatgaaactgtcctatatcttgactgtgacagtagtcacatgactctacacatgtgataaaattggtagaactaaatatacatgcacacacttccacaaatgagtacatgcataactggtgaaatctgtattaggtcaatggattgtaacaatgtgatttcctgactgtgatattgtactgcacttatgcaagatgttaccatttggagaaactgggtaaagggtatgtgaaatttctgtattatttcttacaactgcaagtgaatctacaattacctcaaaataaaaaggcaacatttttaaaaaccttatttagttatcaaatgcagctttattaatcaaaaatttcaaacataaaggatatttctcataactcatacatgccaagattttttgctagacttattgtggatatgtaaaatggacccccaaatcttaaagcttagtaaagtaaataaaatctttgaaatacacaaagaaacactaaaaaaatcagtcttaaagcagttcagagaaagaaaaattcatcatcagtcagaatgagagagaaatactctctttcacaaaacactgaagttgctaagtatgtacttacaggagacatatctagatccctatttcatcaattgtccgtgaatttctattgaaattctctaaatgagagaccacaatatacttggatgccatctcagcatatagaccttgtagctgtagtccacataaatatgatccaggtgttactaataagatagagttgccttatttaaaaaaattaaactatcttcccaaaatatgtataagcctcctatagttgactatagttggtgagactattttaccatattatttcattataatggtgcatctgaacacaggtacaattgtagtttcgataaaaattgcagtcactaaagaattagcattttaatacacagtagataatataaatggccttagtttccaaatgattagcaagcatacatttcctactgcaaagaattttactcattaaaatacactttatgggagtaatagatatgtactatgtgtttgttagcgaccacaaatataatgtactgaacaccttgtcaacaaatcgcatacatactccttccagctatttacactatcgacttggtaaaactatttgtatcacaaattataactttatataaatcccatgtatcatgggcttctttgtgaagctcagaataatccaaaattcttcacaactccagctagactgttactaaactcatttcattctgatgtgccttttaaaaactccataatattttatgttgccttacaaattcaggagctacaggtcatttattccagtgctctgacagttctcatgaactatctctttactatttgaattacagtttagtcaacttcaagttataactatggtgaacattgattaaaattagtcatttttcaaatcacaacattcaactcatagatgtgagcactttggctcatctatttgatccttcattcaagggatgatgaaacagattggaagtatgcctctaagaaactgagcttcagagcaaaacaaactctctaccccaaagcatcattaatgtgtcctaaactgtgtatattaaagaatgaaaagtccttagatttttaagcaccatgactttccaaaaatcaagttagtttaataaggcaaaaactacctttagtaaagacataaagaagtattgagcacttacactgtattctagaagaacacaacatcatgtggggtagattaaacgttagcatcaaatgttacagactgaaactcaggcagaggttaagtcacttgctcccaaccacagcaggagttctgtcacggtcaagagcagcatggccttcttacactttcagtccaggcccaagattaatctttcaagaggaaaggatttaatggagaaagcttgtaaatattcatgaagtaatagcaaactaaatattacagaaatctcggataacgtttaaatgctcaaaattgccacctacataaatggaaccaagattctcaaaagaatgtaaaacatgagagtttgtgtaattaaaagttaaagaagcaaaaagactcctgagtcacattgtcgtgatgtggcattaaagtacttgtgtgggaagggttggtcaaatcctaagattgtcccaagaattgctatttattaaagttcttattactagattaaccacaggaaaacttaattggccattagctttaaagaaaaacatctatggaagcaaaataccttattaaatatttaacaggacatggcctacatattgcttaatttagataatctaattatagcaagctaatgcacttagctcatcatcataatacttgaaattatttacctgaatttggctcatcctgactttggttcctatgttatatttcttatgcaattgttttaccataaaatgtctttacttaaacaatttttcaatacaggatcatgagtgcttaaactatatatatctagtttgaacatgtacatagagtagtatatatatatatatatatatatgtattagttttttgtgaaaagacttgtggttctagttggcacttcatctaacaatttagcatgtaaaattaatacagatacttaaaaaatgtacactactatggaatttacaaaaatgttacagaagtgaattcaacaatgtacagacaggtacactatatggatacatttaaccaaaaaaaaaagtaatattctaaacagaaaacatcagcacagagggcagattaaattaagtgcgagaggcaataaagtttacatcagaatgggcaagtaatgcccaaggaaaatttgatcattaaaagggaaacaggtgtaaggacagagtccaagcacagatcacgcctgtaatcctagcccattgggaggccgaggcagatggatcacgtgaggtcaggagttcaagaccagcctgcccaacatggtgaaatcccgtctgtactaaaaatacaaaaattagcttggcatggtggtgcgtgcctgtaatcccagctacttgggaggctgaggcaggagaagctcttgaactctaggactctaggaggtggaggttgcagtgagccaagatggtacactacactccagcctgggcaacagagcgagactctgtctcaaaaaaaaaaaaaaaaaaaactcacaccttgttgatattggtcctattccaggagataggtaaaatgtacattaattttcaggtagattaatttgtattgttcttacatgtcctattcatcagtttattgttcaactaattctgaattctgcacaattgactcttaatagcacattgccttgcaatagcagcccacacttcctacctgcgaagtcatcagtctcaataacttagtctatggaaggtagttttggagcaaggtgcccatcaagattaggtttcttccctcccagggaaaccaatagataggggtgcttcttccttgatgattacatttcagaaatggttcccagatccttgagaaagatattcctgggtcataaagctaagaggcttatttcacttcaaagagactgaaaattgattcacaagtttgttcttttttaaaagtaaatgctctaaaaaaaaaaaaaaaaagaagtaatggggggatggagtctctccccttattttcaacagggaggacgaggcctcttattttccatttgtctttgcctgtacagtcttcaccatacagcacataactcaaagcttcacatacacaagtcaaataacatctattaaaatgagattttatcccatcttacgtgccttgtaaatgtgtatattcttcagaaaatacagacattttggaaacacatttgtgtaagtttaatgatttaatttatgtttctttattttcactttttttaaactgaaaggtcttgctaaatgagaactggcataaattactgtctcaggactgtgctgagaattaggttctgggaatgataagaaaggaaatttttttctaagtgattataatgtcattttcaagttatgcatttcaggtaaattcaattacttttttcccatatctcaaatttatgagtaatttttcaaataattatattaacatgaaaattctgttaaaacagacaatttgtacttttcagaacagacaatttcggagtggcaactgcatatttcagttgttaattcacaacaatgtatatgtgattatccatagtgatggtgagatttgggttccaacacttcaaggaaactcttgcatagattcatttatttgctttacaaggaggaatgactcaaacacagtcctttggagctagaatcagtctatcaaaaagtcatttctccatagaccagggatgttttaaccaatgccacttcacagagagggactttggaaaaagtagtacataagtgcacacattgctcagaaatatttccagagatttcagtattgatgcgtgaatgttgggtatgtgctggcctatcaaaacaatggcctttcttgattttataactatttcctatttaacattcttcaaggcttaaatatattttcctctggtaatgagcagaggaaaggatattttcctctggtaatgagcaggccatggaatctttaaaatactttgtggcccagtgagctttatatttcttttactgttttcctctaatccagaattagagtccctatacacactgactatatttcagtataattttaactacaaggaaaaagctgtgggtctggactttcagagcttggactctgaaaataacaagctaatagaggaccaggtaagtgcacacttcctccccagcaaggcagacagggtaagtgctcacattaaggattaaacaaatgtctgactcagacatttgagggccttagaaacacaatgaaagtttagttgggagtaaaaccatccctataaactttaagcaataaatccggaaagaagagagggaaagaaacaaaaatacaccaagctcgcagcacattcagcattatcattaggtcagcatactctccggcatgcttcctcacagtcatttggagcctattgtcccagagtcatgtggaccctagattatagttccccttaactgctatatggataacaacctgaacattacgagacattaagttttccctctgagatattcattcagcacctgcataccagtgaaactactgatgtcagctgatatgaatgtctccatgaagagctgtctcaacaaagaatgcagtttccacatcctgatgattccatcctcctcacctcaaccaagcaatgacctcaactttccagccactcaccctccatgatcctcataaaaaccgactcaaactcattggagagatggagttgagggtgtcctcttatcaacaccctcagctgtcctacgatcattaaactctttctctgctgaaaactctgctgtctcagtatattggtatgttactgcactaccacataggaacctgttggtcctataacagaagtgacaagtttagagctgtgctctaaaatgaccttatcagcatctcctaaatatctctaaatggtctctccattatccccaccactgtgtctcctctctaccactcttaccacgccaacccatgtctctattctgaatgactcagcagatttctggtcaatctctgcttccccttgcctttctccagtcagttctccatacagcaaccagaatcatgctttaaaaaaaatcttactatgcatttccctgcttacagtaattcaataacttcccactgcattaaaaacccaagctgtcatcctggcctctgagccactcaccactactcatgagtacacaggccaaggcccttggcttcctgaagtttcgctgaaaaattaactcacaaaaggcgggttaattggagaaaaaaatacaaatttatttaatgtgtatacacaggagccttcagaatgaagacccaaacatataggagaaatggtttatgtttatgcttaggctcaacaaagtacaaatcgctatgcagaaatatgattgaacaaaaagggtacgatctaatgctaacaaactaagggggaaaaaacagcaaggcctatctgtctagattttacttgacctctctgggcatgcatttcttccttctgggtgtgggaaaggaccctcttggaaatgaggatcttatgacctacagtcaaacaagataagtcagataatttctttatagccaaattttacaaaggatctggggaaaattagagtaatatttttaggtattgtggttggctttggggaaataggttctggtttctgtgaccagcattggggaaagggattctaatttctatggctagcctttgggaagaatgagactgggaggcagaagggcagaagaaggtcgggaaaaaacctctgaggctgtttatgaggccttcattttgaggtattgttttctgagtccccacataagccttctggttcctcctcctacatgccaagttcattcattctctagggcctttgcatagagctgtctcctcttccagaaatgctcttctctgcaaaacatggctcgattctattcatttagatctcagcttatctatcacatcccaaaagagatcaactctattcaccacaaggagtcactaagtcactttccatcacctacttgcaattttattttttagtgttttggtgacctataagccttctgaccaaaatttaagttccatggaagcagtatcattgtctgtcttgttcagtattatttctccagcaccagcaaattgcttggtacataataggccctcaataaatattttttaaatgagtgaacatacaatagccttatttgaagagttgaaaagcaaaactataaataaggaagcaattactgagataccattactgagatactcctggaagaagtaatgaaagtttgatgtagaattatgatagaaaaggaaaaagtgaactgatgtgagagttgttttgtaggaacagcggtacatggaaaacgttttagcatggggataaagactttcctttaaatagatatacgttaaacaggaaagtatagagggtgcatcatactaaagattatagagaaatgataaaaaagcgtttgtgttaaataaataatcaattgatcattggtggtctcagagactatattttcagcagactgaagaataatcaggactgatatgtaaccaatacacattagtatgacctatatattttaaaattactcctagctacaagcatgatttctactggtgaagaaatgtttttaaaaaatttaagcagcaggcatagaaaaaccatttttcaagaagttcgatgatgacatacagcatggttttctgtgaaatattgtatgagtggccagggatgacttttttcattatttcagtaggttttttgggaaacaggtgtttggttgtgtggataacttctttagtggtgatttctgagattttggtgcacccatcaactgagcagtgtacactgtacccactgtacccagcaattatcttttgccccccttctccctgagtccccaaatttcactgtacaattttaatgcctttgcatcctcatagcttagccaccacttataagtgagaacatacgacatttggttttccattcctgagttacttcacttagaataatggtttccaattccatccagtttgctgtgaatgccattatttcatttcctttttatgtctgagtagtattccatggtgtatatataccacatttttttttaatcaactcattgattgatgggcatttgggctggctccatattttgcaattgtgaattgtgctgctataaacatgtgtgtgtgtcttttttgtataatgactttttttcctctgagtacatacccagtagtgggattgctggatcaacagtagattttctattagttttccatactagatccatactagtagaattgctagatcaagtggcagatctactattggttctccacactgctttctgtagtggttgtactagtttacattcctaccagcagtacctactagtttacattcctaccaccacatccatgagaacatctattatttttttattatggtcattcttgcaggagtaacgtggtattccattgtggttttgatttgcatttccctcataattagtgatattgagcattttttaatatgtgtgttggccatttgtatatcttcttttgagaattgtctattcatgtctttagcccactttttgatgggattctttgggtttttttcttgctgatttgtttgagttcactgtagattctggctattagtactttgctgaatgcatagttttagaagactttctcccactctgtgggttgtctgtttactctgatgattatttcttttgctgtgcagaagcttttgagttttaagtctcatctgtttatctttgtttttgttgcatttgcttgtgggttcttggccatgaagtctttgcctaagccaatgtctcaaagcattttccaatgttctagaatctttatggttttaggtcttagatttaagtctttgatccatcttgaattgatttgtgtataaggtgagagatgaggatccagtttctttcttctacatgtggctagccaatcatcccagcaccatttgttgagtagggtgtcctttctgcacttaatgtttttatttgctttgtcacaaatcaattggctgtaagcatttggcattatttctgggctctattctgttccattcatctatgtgcccattttgatgccagtaccatgctgttttggtgactatagccttgtagtatagtttggggtaaggtaatgtgatgcctccagatttgttctgtttccttagtcttgctttggctatgtgggctcttttttggttttatatgaatttgagaattgatttttctagttatgtgaagaatgatgacagtattttgatgggaattgcattgaatttgtagatcccgtttggcagtatggtccttttcacaatattgattcttcccatccatgagcatgggatgtgtttccatttgtttgtgttgtctatgatttctttcagcagtgttttgtagttttccttgtagaggtctttcacttcattggttaggtattcttaagtattttattttacttttgcaactagtataaaaaggggttgagttcttgaattgattatcagtgtggttactgttggtatataacagtactactgatttgtgtatatgaattttgtatcctgaaactttactgaatgcatttatcagtactaggagctttgtggatgagtctttagagttttctaggtatacgatcttctactccatgatcagtgacagtttgatttcttctttgctgatttggatgtcattatttctttctcttgtctgactgctgttcctagggcttccagtactatgttgaatagaagtagtgaaagtgtgcatccttgtcttgttccagttctcatggagaatgcattcagcttttccccattctgtataatgctggctgtgggtttgtcatagatggcttttattaccttaagtatgtcctttctatgccaattttgttgagcattttaatgataaagggatactggattttgtcaaatatttattctgggtctattgagatgatcatgtgattttttgtttttaattctgtttatgtggtatattattatttattgccttgcatatgttaaactatctctgcatccctaggatgaaacccacttgatcacggtgaattatctttttgatatgctgttagatttgcttagctagttattttattgaggatttttgcatctatgttcttcagggatattggtctgtagttttctttttttgttatgtcttttcctggtttttgtattagggtgatacttgcttcatagaatgatttagggaggattccctctttctcttatcttttggaatagtgtcagtagaattgctaccaattcttctttgaatgtctaatataattcagctgtgaatccagctggtcctgaactttttttgttgataacttttttaattgccatttcaatctcactgcattattggtctcttcagagtttctatttcttcctgatttaatctaggagagttggatatttacagaaatttatccatctcctctaggttttctagtttgtgcacataaatatattcatagtagccttcaatgatcttttgtgtttctgtggtatcagctgtaatatctcctatttcatttccagttgcgcttatttggatcttctcttttctttcgttggttaatctcactaacggtctatcaatttgatttatcttttcaaagaaccagctttttaatttatcttttgtatttcttttgtttcaatttcatttagttctgctctgatctttgctatttcttttcttctgctgggtttgggtttagtttgttcttgtttctccagttccttgatgtgtgaccttagattgtctatttgtgctctttcagactttttgatgtaggaatttcatcctgtgaacttcctcatagcatgacttttgctgtatcccagaggttttgataggttgtatcactattatcattaagttcaaggaatttttttatttccatctttatttcattgttgacccaacaaacattctggagcagattatttaattttcatggacttgcatggttttgaggattccttttggagttgttttccaattttattccactgtggtctgagagagtacttgatataattttggctctcttaaatttattgaaacttgtgttgtagtctatcatatagtctatcttggagaatgttccatgagctgataaatgagtatatattctgcagttgctgggtagaatgttctggaaatatctgtgaagtccatttgttctagggtacagtttaagtccattgttctttgcagactttctgtgttggtgacccttctagtgctgtcagtggagtattgtagtcccccactactattgtgttgccatgtatctcatttcttatgtctagtagtaattgttgtataaatttgggagctccagtgttaggtagatatatagttagaattgtgatattttcttgttggactagatcttttatcattatataacgtcatcctttatcttttttttactgttggtgctttaaagtctattttgtctgagatagaaatagctactcctgctcacttttgctgtccatctgcatggaatatctttttccacccccttaccttaagtttatatgagtctttatgtgttagatgagtttcttgaagacaatagatacttgtttggtgaattcttatccattctgccattctgtatcttttaagtggagcatttaggccatttacattcagctgtagtattgagatgtgaggtactattctattcatcatgctagttgttgcttgaatactctttttttttccattgtgttattattttatatgtcctgtgaggtttatgctctaagaaggttctattttggtgtattttgaggttttgtttcaagatgtagagctcctttttaacagttcttgtagtgctggcttggtagtggcaagttctctcatcatttgtttgtctgaaaaagactgtatctttccttcatttataagactttgtttagctggataccaaactcttggccaacaattgttttgtttaaggaggctaaacatagtacccccatctcttctagcttgcagggtttctgctgagaaatctgccgttaatctgataggttttcctttataggttacctgatgcttttgcctcacagctgttaagattctttcattctttctttcatcttcattttagttaacttgatggctatttgtctagttggttatctttttgcaatgaatttcctgggtgttttttgagcttcttgtatttggatgcctaaatctccagcaaggcaagggaaatttattgagggaattagtccctcaaatttggtttccaaacttttagatgcatcttctttctcgggcatagcaattgttcttaggtttggttaacaaaatcccagccttcttggtagctttgttcatattttttttaattcttctttctttgtctttgtcagatgaaattaattgaaaagccttgtcttcaagctctgaagttctttcttctacttgtttgattctattgctgagaccttccagtgcattttgcatttctctaagtatgtcctttatttccagaagttgtgattgttttttatttacctgtagcattttaaaatttctttatgttgatatttacctttctctggttcctctctgagtagcttaataatcgaacttctgaattctttttctggcaattcagatatttattcttggtttggatccattcctggtgagctagggtgatcttttgggggtgttaaagagccctttttgtcatattatcagaattgtttttctgattccttctcatttgagtagactatgtcagaggaaagatctgggactcaaaaactgctcttcagattcttttgtcccacagggtactcccttgatgtggtgcttcccctagggatggggcttcctgagagccagattgcagcaattgatatttctcttctgggtctagccaaccagcggagctgcctggctctaggctgctactagggagtgtctacaaagagccccatgaggttatcatcctcgggtctctcagctgtggataccagcacctgctctgttggaggtaggagtggagtgaggtggactctgtgtgggaccttgactttcgttttgtttagtgcacttgttttctcgtatgctggttgtgctggcagtaaagttgtcatgtagacatactgaggatctctggttagacaagatgttacaggtggtaaagttagctgttgtttttctcctttgtggggcagggttgttcttttatgagttgctgtaatggcttgagttggttggcctccagccaagaggtgatgctttcaagacagcatcagctgtggtagtatagaagggatacaagcttgccctaaggtcacctggataagtactcaggtttctcaggtggtgggtgtggccacagagctcccaagagattatgtcttttgtcttctactatcagggtgggtactgaaaaaccatcaggtgagggcagggttaggaatgcctgaactcagactctccttgggcagggcttttggggtgtggttctcaggcctatggagttatgttcccagggggattatgactgcctctgctgcatcctacaggtcaccagtgaagtgggggaaagctggcagtgccaggcctcacccagctcccatacagccagaaaggccagtctcctgctgtgcccctccagcagcactgagtttatatccaggcagccagcgagcagggctgggactttgccgcaagctaccagtctctctgccgagaaatcaagcagggctttcagcttcacctctccctactatggcttctgtgctcatatctgcacttcccatttgccctccacccccagattctgccctgaaaaattttcactcagttgaaattactacaaagttcagctgaaagtttccttcttcctgtagtctttccccagttccactggcaacgctccccaagggcccctgtgagatacggtctggaatgggtccctgagcttccctgaggaccaggagtgcctacagggctcttccctgctgctgcttctacttttatattttactcagctctctaaatttatttcagctctaggtaaggttaaatccttctcccatgatctggattttcaggcttcctagtaaggatgtgtgttcactggcagactttccccctctcacaccttggacactcccagttttttggctatctctcagaatttgcagtggcaaaccacttctttcaaagggtctgaattcttttggttttcctagtatgtccctctggtatttcttggagcaaaagttcacagtgtaagtctccatacactgttctgtccagcttcagggatgatttttaagcagctatgagatgtagatgtacaaagttgtaattatttctttacagttgcacccaacttagttcacaagtgtttgtttgtactgatggagaaaagtgcatcttatcaatttaaaggaattcagttacttctgattttcaaaaatggttcatgtagggatttaaacagttaaaggtttcccacctcccagggatgatgcatagtcttagcttgctgacactgggtgaaggatatctgttcgcatcctgtacttgacccaccagcccactgagcagagctgcgctcctctcccttgggcttgtgtgtgatgacagtggatggtctgtggtcttgagatttacacagtccggattctccgaatatttaggcttctctgtggttattttatgatgtcttaggtcaggttgcctagaaacagactcagattcatttgcgttcaatttaacagggaatgccctaaagatcaatccccatgtgaagtagtgcaggaaagaggattgaacactgggtgtgataacaatagaggcctcaggggagttctgcagctgtcctgaattaaccccctttcgggcaaggtggagaggcctttataaccagcacctcctattggctggctactggaacagagttgggctcagggcaattccagagagacactcagcaaggagagccctcaaacaccaatactcccagcacctaaaaaatttagggcctcagttctgaaggagaactcaggatggcacagcacggcattcattgcagttagactcaattcatcagaactgtgcctttgcactctgctcgaacccttcaccaccctcagacccaaaccagggctaaggagctcttagcattcaggaattagtaactctatatgcatatctatctttatatgttacattaagtcttcttcactaagactgataaattcatgaggacaaatatttttgtttaaatcactttcaagtacccagtacctttatacattttactggtagcacataatagatttttattaaatatttaatctattaatacagaaatcttgttttcaatgttagctatgtaaatgctagtcagtggtgaggcagcactcaaattacctagcactttgtaaaaaacatctatttctgaatcctaaactagacctactgaaccagaatttccagggctgatcttagaaaaacaggtatatttgtaacaagctacctatttgagctacagtgcagcattgacccaagaaatttctactgggtttcagctttcatgactcctcacatattggaaataataattttcaattattgaatcgagtaatattcaattattcaaataaaggaaccaaagttcctttttatatcattgtcctccaaacaaaataatctttttcttagttttcttatttggttttctagttgtcgttccaacgtaaaagatttttttaaatgtaagaaaaaaatacataggtaaaaccgtatgggtgttccttaaatatgtatataattatatttgtcaattttacctcaatagtgctgaaaaaattaattactgagtgactagcaattttacttctatgtatatacatccaaaagaattgaaagcaggatctcaaaaagatttgtatatccatgtttatagcatcattagtcataatagccaagagggggaagcaatccaagtgtccatcagcagatgaatatgtaaataaaatgtggtatatacataaatgtaatatcattcagccttaaaaggaaggaaattctgtcgtctactacaacatggataaaccttaaagactttatttaagtgaaataaaccagccacaaaaagacaaatactacatgattccacttatgtgaggtatctacagcagtcacattcatataaagagaagggagaatggtgggtgtcaggaactggggggaagaggaaatgaagggttgatatttaatggatactgagtttcaagttttacaagatggaaatgttctggagattgcacaaccatgtgaacatgctaaacactactaaacttttacacttcagagggttaacatggtatattttaagttatgtgtattttaacaatataatttttttgaaattatgtaaagaaaatacaacccatattttagtttctgggcctgaaacctatttctgatggccaggtagtggctcacaagaaatagagggagtttgagccatgcattcaaactggatacatcacaagagcaatacaggttcaacacatcttcactaacattttgactaagattttaatctcttaggaatgacttgtcatctgtaagtagaagcaaacagagcccatatctgcaagaaggtggaggtcgtatactgatcattaaactcattaaaacgtggagtagctggaaagtagttataaaatgacttcctgggagccatgatttattctgcatcagtggtttctattgtcagtaagtgcttttaccaccagctcaacctggaatttaaaaagaaaactcctctaccttttagtttttaaactatatcctttctattgtcagaacattgacaattgtgtggataagatcagaatgagtcatctcagctcttctagttgaaatgactacaccaccataagagtttgttttttaacacttgatgctgagatttaaaatttctgagggaccaaatagagtacaaaaaatgtgtaatagcattttttattaacaatacaatcaatttccaggctaaattaaaagagcatgaaaaaattaaattcatagcttatccaaacctaattttgatattcatttcaaccattctattgatctaaaaatatagcaagttctggttgattcttttaaaaagatgcatagtcataggttcaataggtgattcctaaaggcaagcacagttattgaattttccaaaacagtctcaatgtcacatattctgccccagtatgctcacaaaggcttttaagactataaatcgtgctttctttttttttcaaattataaagttagagtcaccaaagggatcctggctatttattatacagtttctggactacaggaacatgaagtcttagagaaataatgataaataggaattcttgataatataattttttcatctatttttcttcttaattttgggggaaatgtttgagaaatgtctaaaaattagcaagccaaaatcaagaagttgaaggaaaagattctggataaataatttagcctaaaaataatgtgtggtcctgatttaattaattcttaagtatattgtttttaaggagaacagtacatattgtagattgaaggcttattcatttcacatttgtactagaactgttacatatgatgcaaactcttcctcatttttttagaatttagagaacggtgaagatgatgataggatttatgtgccatttctgcagagtataaaacattctcttattttaaattaaaatgatttaatttatttttggaacatctttttgattctttggtctcccaatattcaggtcagagatttagccataaaaatcaattttcgaattaataactcattataacttcttaatcgataacatttcaaattacctaaacaacttttgaaatctttagaaagtgacctaaatatgcatacatagaaaaataaatgcaattactgttcaatagtagaatataatggtagattatgtaattaaggtatagttattctgatatgattatcatgtttcagaaatattatttcattatcttagaagtcaatttgagtgtaggaaataaagacactaaggtttcattttctaaactattttcctatctgcaaaccaatgatgctgtgagggaaaggatattggaaagcatttacaatgcatggagaagagcacatagttacgaaactcagtgttgactatcatgaataaaagcaagtctcagggccattcacaacttaaattttattgttcgaagaatgtattttagaacttatatgtatatacacacacacacacacatacacccacacattgtcaactcctgcaaatatatatatataaatatgtttaaatataaatacaagtaatgtataaatatatattactttgtaaatatgcaagagagatatatatgtaagatatatttaagatatttatatatgatatatttaaaaattaatggtcactttccttgcagcagtgataaataagcatagaataatagaaattctattaaagcaaaaaagcaacagggctcaaaacaaagtcccatgtaactaactaccttgccttatctagtagttgaccaaccctcttcaccatcaatatggacactttattgccaaatgattgcttgtgtcatctcacatgaaaatcaattacctgaatgttttctttttctctttccttctttctttttttttttttaatttactttccaagggttgggggaggagtagggcatagttgcctatggattgcatggtttcttccactgacaaagacactttgtatctctgtcttgctctacattttacttaattgaaataggatagcagtatttaaagtaattttttataagtactgagcgaaatagattgaactgagttgatttgggttccttgccaatcttgactattcagacatcttttctttttgccttgcctctgcttttcttccttcctggtcaagtgaattttatatggttcagttcttgatgacctgtgaaacaaactaataaatctaatagctttagaaaatgtcacatgtagaaaatagaaacttcactctaatagtcctcctaaattatgatgctatcataaaaaaaaatagggcaagacttctccttgggccaaacttttcagtaaaaggattagctgataattatagtgcaaactcataaaagaaaaattatggcacttttcaggaatattttatttttaaagttattcattattaatagtaatatgtcgtacatgtatgagtgttataaatctaaagcaatttcagaaccattgtctcatttaaactgtacaacaacccactgtggcaggctttattattcttattttaaggaacccaatactaaagaagttaatgtcggtgtcaatactgcagcaaggacctgaacacaaatctcctgatacataatctattgttcattatagggctctgctgcattcttagtagcactgtgtcttacatttctgaaataattgtaatgtacaaaggataagttgttttattttattttatttttatacacagttctcactagacaactgttaatggaaattattccacataccaataaactttgcatcaatgtttatatccatttaaaatcatatatactgttattttgtgaacaagttgttttttgtttgctcatttattcattcattctttttttactcccttgggtacagcattttgagtcagtcttttcgttttttttttcaactggattaaaaatatttgaatacctatagaaagttgtttccattgaaaacatttcttattttcctctgtgaagaatgttgatgaataatcagagcttcatgttattagtaatatttatttcaaaattaaactgttttcttagggaggacaagtattttggtggctaaatgtttgagattcttatctgaaaactcaactaacatattctcatatctggtcatgttacatacagatccatttactatttcctttattgttaagtagtcaaagttactgttgaatgaatatattttgtagatgttctatttatctatatttacaaaaataaaacacacactaaagcagcaaagttgcaactttcaaaatgtcactttgagtaaatgttgcatcaagaacttgttagtcaaaaatagatttttccctaaataggtgtaaacaattaaaattgtgggagtttagaggaaaaagtgaaaagatgttttctttatttgcaagaatgtatattttctcagaattcatgtaatttcaagatagatattgctaaaaataaatattgatgataatatctgtaataatactatctacaaatggcacagactggagtataaataggttgcacattccattagtcattcactatttaaaatgagaatactaaactttaagacagtatctgttttgtcctacactgccattttttcattccttaaagacaatttgcaaatagcctttcagcacttgactgacagaaaaattcttctgacagttggtataaaacattttaccacaaacagaactttggcatctctagcacattgcagacatctgttacaatatgccataatttttagcacctcatcataaaggcaaatccagaactatgatctaaatataactagcatattttatatgggctttcctgctgtggactgccaattacgaagcatgagtaatgaaagaaggtaccctttagagcagccaattctcagaagcattagttttctttaatattctactttcattccaggaatgggcaagacaataagtaagacatttcatgtcacttcaggataatatcatgtaattttagggtaataaagaattcataagtgatcagataggagaaagttcatttacattctctccagagacttttatctcttcagatgtgaccttgtacaattaaatctatttcaaatatccagagaaatggcagctaagcagacaatggaatgcttcattttatgttggactgaaataaagtgaaattaaattatatgaaaacagtcaaatgtaataggagataaaaggttccactgaaattcttgctatctaatcttattcattagaattttctagaaggatgattatattgtgtgctacgtaacttgattttaaaactggcatttcattaatatccccccaaaaggactgaaattaagtgtcccagagagtcatttgtaaatgctattttaattcagataatttatataagcagttggactcaatatagagaatgtgtccttttaaaataaaacaggcttttaagaaaaaaatattttaagtctttgtgtcacaattgaaattttgattaaatctttaagaaagataattaaaaccatatctaatgtgtttttttaaagaaaactatttaaagggataccaagtgaattatataagaattacttttcacaataaaagtaattattaaaaggcacaaatgtaattttatcaggatacttttatatttgcattctcttagttgattattatctttaaacatttaacttctcttccattctctggttaccagcgataaaaagtgtattttaggccgggcttgtggcttacacgtgtaatcccagcactttgggaggctgaagggggcggatcacctgaggttgggatttcgagattagccttaccaacatagagaaaccctgtctctactaaaaatacaaaattagccaggtgtggtggcagatgcctgtaatcccagctactcaggaggctgaagcaggagaatcgcttgaacccaggaggcggagtttgcagtgagctgagattgcaccatcggactccagcctgggtaacgagtgaaactcagtcccccccccccccaaaaaaaaagtgtattttactgtaatcaatctaattatgaggatgagggttttcattcaatgttgatttattaccacgccatttgtcatttaaaaggtgttttcttaattcattgcattatttgacttttcttatgatatctaatacatacatagaaaagcatagaaattttgttctgtgtgcaactgagtaatttattacaaaccaaatgttcctgtaactactacctaggtcaggaaaatgatcacagtagcaccctaagtccctctcttgattgctctcaatagccaattcctgtcttccatcgtaaggtaaccactatcctgatgtttatcgtaataaattttgcttttatttataatttcaacacctaagcacacatctctaaacattttgtctctttgttggatttgcataaatagaattatatattactcttgttaagcattatgttgagggactcaggatgtactttgtttcattaatcttggttgttgtataatgttcgacaatatgaatatatcacaatgcatttatgcattctactgttcagtaacatccttaaacctgagcagacactcagacctggctgtgttttaaatgacaccactctgtctttccccaggctccccaaagactggaggaccaagataaaaggacagaatatacatttttagcactttatttatctatttatttattttgagacagagtctcactctgtcatctaggctggagtgcagtggctcgatctcggctcattgcaacctccacctcctgggctcaagttatcctcccacctcagcctcctgagtagctggaactacaggtgcacaccacctcacccagctgatttttgtattttttgtagagacatggttttgccatgttgcccaggctggtctcaaactcctggactcaagtgatctgcccgcctcagcctcccaaaatgctgggattacagtcatgagccactgcacattgcctgttttattgcattatttgtctttttctcattgatttttaaaaactctgtataggctggattgaagccttctgtaaactcttaagtgtcacaattatcttctcatgctccatttcttctctacactctcttaatggggtatttattttgcctatctttaaaaaaattgtcattgcaatgtataacatacctacacataacacacatacaaaagatatataactcaataatttattacaaaaagaactatcaggtaaacaacccaggtcaagaaatgggatattagtgcttcgaaggccctctcttgactgcttcaaaccattgactgttcctccctcaaaacaaccaccagtataagttctatggtaattgtatcctgaatatgtttatagttttactacgtaagcacatatgtctataatctatcatttagttttgtcttttttaaaactttatataaatgaagttcagtaaacattctattctgtggacacttttgctcagcatatgtttgtgaagtttatcattgcttttgtgagtagctatatttctttatttttatttttattttttgctcatttatttatttatttatttatttttgagacagagtctcactctgtcgcccaggctggagtgcagtggtgcagtcttggctcaccgcaacctccgcctccctagttcaagcgattctcctgcttcagcctcccgagtagctgggattacaggtatgcgccaccatgcccggctaatgtttttgtatttttagtaaagacagggtttcaccatattggccaggctggaagtgagtagctatatttcattctcattactgcatagcattccattgcatgaatacaacgcaacttagttgtcctttcttctgttcatagacacttgaatatcccggttcgtgaacgttataactagtgctgctaggaacatactcgtataagtctcagtacacacatgcacacatttcttcatgggaatcattacattttctgaatataagcctttgttaaatatatacggtgctaatatcttcttccagttttgtcttttttgacattctcttaacagtatcatttggtgacaaccaaaaaataaagttctaaaattgcaatgtggttaaataactaccttttcctctatggttagtatggttttatttgttctttttattaatctttctctacctgaaattcaggaaaataatttctatgttatgctttataagctttctggttttaccttacatatttatatccactatctagctgtcattgactttcaagtatgatatgaggtaggaatcaagtgctatattttttagtatggatatataattttttggaaccattgcttaaaagcctattaattcctattgctttgcagttacataaatcaattgtctatttctaaattctttattatattttgttgttatatttgtcttcctttgtaccaaaagcacacttataattgtcaaagctttataagaaatattgctgttggataggcaaatcctctcatttcttttcatggttaaaaaatatgttagctataaatggataatttgcattttcacacaaatgttttaggataagcttgtcaagtttcacaaaacctgtttggggagaattgacatctttgcaacattgaaccttctactcagtaaaagtggtattcctctatgcttatatcgtctttatcttttctcaacaatttttttttaaatttgtgtgtagagttcttgtacttcttttgctggatttgatggtattataaatggcgtggttttaaactttttttaatttcttaattatttgtctgtgaaatacaaacagacaatgaatttttatatattgagcttatatccagcatattacctccaatgattataatttatctatgggtcgggcacagtgactaacacttacaatcccagagctttgagaggccaaggcaggaggaccgtttgagcccagaagttcaaaactagcttgggcaaaaagtgagaccctcattatacaaaaaatcaaaaaattaggccgggtgtgctggcacgcacctgtggtcccagctacttgagaggctgaggtgggaggatggcttaagcccagaagttcaaggctgcagtgagccacgttcatgcctctgcactccagcctgggtgacagagcaagaccctgtcccaaaaaaataaaaataaacagaatgatggattgtttgagatttactggttatataaccatgccacctatgaataatgaaaatatattttatttctttattttaagttcttacatatttcatttatttttcctattcttattcacactgcccaggatctctagtgcaatgatgaattgaagtttaccttaatggtctgttgtgtgtgaattagtgatagttctctgcctgatgaaaattagaaattcaataactgattattttaaataataagtcctagtataaccttaaatgaatagcaaatgtccacttatagcttcctatttatatatttaagaggtatggaacaactttgagttgtaaaatatgtcatatttacttttcacttttgtttctaaataaaatcctggtgacctcactaaaaccattgattgtttcagcatcgctcactggagcttcttctctatcctcacggcttacagacaggacttttaacagccccattttataattgaagcccaactgacaaaattgagactcaggtaaatttaaaaatatctgcaaggtcacagatacgagtagcagagctcaagtcaagccctggcagtcaactccagtctttacttttcaatattatgacttgtttaatctccgactttatatttaaatatagcatctatatattcacataaaagtattagctaagcctgttagtatttctttagtggtttttaatctgtcttttcttttggctttcatgaaaagttcttaaccaaactccacacgatcatatggtgagataagagctgccagcagtgtgaaagtcaagcagaattgttatgtaatgttattaatcagaatcgtacttcttagatcctttacctgcctttgtcatattcatggaagtttatttcctcaccaccttcactttcttctttctaatccctatccttccacccaagaaaatctcccaccccccctgccctgaccttatccatgtgtactggttatgattttcataagctggcctgacaaggagtgacatttggcttcgctttagtgtaaaatgtcaccagaaaccagagctggtgctgcactatgttgataatgatggcccctggatgatacagtcactagagacagggttcattattttattttagttattttataagaattttgatggatatctagccctttttgctactgtgtaattacatacagtataaccacagatctggagtctagcattgtaagaacaacatgcaaggtaaatcaggtaattttaaagtaatttctttgcacctgaggtaaaggaagaatcataataagatcctaacaaagataacttttgcaactgaagtagatttgattttgctggtgatacatctcatatagaattctcatcctaccaagagccttacccttcatctgatggaatggctgattgtagacactgaccctaggttacagagaaaagagaattgctgattgccaccaacatattgaccagtttgtttaaaattattgtaagttataatgatataaatgacctggtaaagtctgaaatacccgtaaaagatatgtagctatggccaggagaagactgtagatgcttacttagcaaagtgaatggcgatatcttcatgatgattctgaatgccctctgtgaaatagcccttcttcctttccataggatggattgtctatgcagtgtctgccaacacattataccactttgcatataaccaggtttcacgttgcttttaggaaccctcttgcccttaagagcctattgcagtgctttagtcttggacacataagatcaatgcacttacaagtatgatttaataagatactgtggcaaacccaaagcagaattcactgcctctcttcctttaacttatcccttttttgtgtgtttgaatgagtttcaggcttttccatgaggttgaaacattatatatttttgttatgttccacacattatatgtgtgaacccattatgtgttgggaatgatatctctatcattaatagtttagcttggaactcaatgttcatagatttctagttactttaaaaaagctgctagttattaaaatttacaacttttatcaactatagttatatataattttatttattgaagttaacttaaaactaaaattgtacttattaattaaagaatttacagatagtaacttaattctgaaagtacagagtattcaatcaactacaatattctgaggtctggttcatcattactagaaatcttttaatttcacagttcaaaaagaataaaacattttctgatctttgacttctagaccaacactaagaaaattgaatttgaacttgctataatttctagaattcagctcctagttgctggcatgagaatgtggggaagtataaaagatgacacaatatcaaaatacatttggcttgctagaaataaaatatatatatatatatatatatatatatatatatatatatatatatggttattttttagatagagccttgctctgtcacccaggctggagtgcagtggcatgatctcggctcactgcaacctctgcctcccaggttcaagtgattctcctgcctcagcctcccaagtagctgggactacaggcacctgccaccacgcccggctaattttttatatttttataacaccatgttagccaggatggtctcgatctcctgaccttgtgatccgcccaccttggcatcccaaagtctgggattacaggcatgagccactgcacctggccttatattttttagttaaataatttgctaagcaatcaacaacttttagaagcttaaatgtttctagaattagaaacacttttttgacttttaagacattttttacccttaatcaaacaatattttgtttcataagattattgtgttcttcatcataaggattagtataaatcatattatgttcaatgtactatgccaggcacttttgcatacattatatttttcatcacaaggatccttcctgtacatattctcttattcctattgtgcagatgaggaaactgcttcagagactttgttttcccaaaggcatatatatatatgtgtgtgtatatttatacatatgtgtgtatatatatatatatacacacacacacacacatatatatatatatcaagtagcagtacaagcaggatctgaacccatattttaaattttaagtctaatgagctttcaactatattatatttggatattaatgtaaataactggtaaacaagcatttctttagtgcctactgggtgataatgtcttgattaaggaaatagaaagttaaattatattctagctgaaaatataatctaaagaaacagccttgcaaattgaaagattttttttaaaaactggtaatacattttactggtttaatttagatatttattaatgacattttctgtgttaattgattggccaatattacatttattttctatactactttaggtcttgaaactgctaaatagtaatcagtaatgtaatattgatggcatcgtactcttcctttccactctgtgtgatgcttactagttttatttttttaataaatgaggtgggtgtgtgtatgtgtgcaatatcatagaatgttttgatagcatttttttcctgcagaatatatcctccagtaattaactttctaaaataaacacctgtaccataagaaatttaagaatttctcatgtttttgtcttatgtgtattatatctgcaggaagatgtagcataaatgcaaagttggagtacctaatttgtttgttgttgttgttgttgttgttgttgttgttgagatggagtcttgctcttgtcacccaggatggagtgtaatggtgtgatctcagctcactgcaatgtctgcctcttgggctcaagtgattctcctgcctcagcctcccaagtagctgggattacaggcgtgcaccaccacatctggctaatttatttttattttatttatttatttatttatttatttatttatttatctatttatttattgtatttttagtagagacaggatttcaccatgctggcaaggctggtcttgaactcctgacctcaggtgatccacccatctcaacctcccaaagtgctgggattacaggcatgagccaccacgcctggccccctaattcattttatatcctgaattattgagttagagaagctagaaggacatctggatttcccattttaaattcttctataagcctagagctcactgaaaactcgaagctaccaacctttatgactgtctacttcccttacccacattgatattccaaaattaaaagcaccttcccaagctaagatacctagtcgataatttgtctcttccttaaattaatttttaaacactcagcccttttcagatcatctacacatgaaatgcttctttctttttagcaaaatattctatatagagactaaagggaaatgctactcgcctaccttctctgttcctggatattctgattccatgtcaagtattcagatataatcttatttttattaatattaatctacacaattaagcagttcttggcttttgaataagacaaactaatgttttacatgctactctacctcttgttatccctaaattctttaagaggttactttacctctctgaaccacagctgtcttgttaatcaggatagtagtgttccctcacagagggtcagaagattgaatattcaaggcacacttaaattattttgattataagcatcagtagttccttgtggttgataataattttgcatatgtgaatgatcttatatttgtttatttttcttctctaaggaaaagtgatacaatggaaatacaagaaataaaaaatatttgataactttagtacatacaaatagaaataacattggtgattttatggaaaaatgttttttattgtcacaataatttttagcttgtcaaaggaaaataagatgtcagacaacttacagaattattctgattgtaaacaatgttcacagacagtctagacgtctataattgtactcgccgtgtgttataagcaagaatcacctgaatgtagattttataatgaaaaaaattatcacaatttctgatacaggaagctcttggtttgtctgcatcaagcacttaaattggtttgtatttagatcacaccaattaccactaatagagttaaaatactggaagagcccagaaatggcagaagaccttgataggtttttagaaagtccattatatttcagtgagaattctgtttctcggggaaactacttactgcagctgtctgagactaattcattcttcatctctgtgtggagctacagtgtgcagcaaaaagtggctcatgcaagagtaaatgaaaaggcttaaaacaatttgcatgggctgtctcaaaagaactgaaaaggtgatgggcagaattaaaaactagaattttctccaagctttttaaccattgagagaaatgcctaaaagcaggacattttatatcacttgtcctacccagtgcaaatggaaaatgcagtacttcttgttcaaacagctgacacgtcccctgaccgcgtttccttcccagctgtcagctgctggattgattcactgggacccagccagtggggtcttctcttcccacagttcaccactggaaaccactacacatggacaaccctcaaaaattgcaacctcttctccaggatgctcttaatacctgcatctggagtgggcaagaggtttgtccctgccaagtcgaccacaaaatgcatggtaatgctgctggctgaggggagagagggtggccactgccatgcttcactctgagctgccatggggcgtgcacactctactccacacctttccatgcctaggctcagcagtagttgctgggcaagggtgtggagggtaaggccaggtgggagaaggggtgagagagctggctgctgaaaacccatcaagggtatttatcaggaggtgccccacgcatggtccaagacaccaaagtgttcacccaagcttctcttacaaaacataaattcaaagataaagttattaagagtttctggacagcaaccacagagcattaaactccaagaatgggtgggagtaggtttcttctgagatggattcttgtgcggctgacgtgggtagattcccttggagccagccatgaccagaagggtccatttgcatgtgcaaatgattgacaggttatgtatgagttggattgatacactgaagtccaaacacccagtactcgtgaatgtaacctttggaaataggatctttgcagatgtaatacagttaagaagaggttactaaggtgggtcctaatgtacttataaggactggtatccttataagaagagagacagacacacaggacaaattccatgtgatgatagaagcagagattgactagacacaagccaaggagtaccaaggattgccagcaacagcagaagcaaagaaaaaggcatggaatagattttcctaaagacttcaaaaagagtatggccctgctgacaccttgagtttggagttctagtctccagaattgtgagacaatcataagtctctgttcttctaagccatccagtttttagtaatttgttactgcagccacaggaaaactagtacaggtaatattttctctatcaatcattcttttccacaaataatcatgtatttttggtttagattcatattaacctttcttggagttaatccttaaaggcaaatttgaagtttcaagtagttacttcatgtttgaacttaattatttatagtcacttttgtgagttttaggtagtggacttatgttcagaaacataaggaaatgtaaatatatacagtatatctccatggctttgtttttgtgttttggcatcttatttacaccacaagtggcagagtggttaattgcactagataagttgaactcttaacggacagacttaaattatggactacttaaaaagaaaaggggaagagattgcataatattgttattcaagccaaaaagaaaaaacagtcttgaaagcaagagtgaatgaaaaagctgaaatgaattgaatatcactgtttaaaaacattacatttttgtagaattttttttttttttttgagatggagtcttgctgtgttgccaggcttcaatgcagtggtatgatctcggcttaccacaacctccacctcctgggttcaagcaattctcctgcctcagcctcctgagtagcagggattacaggcacacaccaccatgcctggctaattttttgtattttcagtagagatggggttttaccatgttggccaggctggtcttgaactcctgacctcaggtgatccacccacgtcagcatcccaaagtgctgagattacaggcgtgagccgccgtgcccggccagaattttttttttttttttttttttttttgagatggagtctcgctctgtcgcccaggctggagtgcagtggtgtgatcttggcttactgcaacctccgcctccccagttcaagcgattcttctgcctcagcctcctgagtagctgggactacaggtgaacgccaccacgcctggctaaattttgtatttttagtagagacagggtttcaccatattggtcaggctggtcttgaactccttacttcatgatccacccgcctcagcctccaagtgtgctgggattacaggcttgaaccaccacactcgccagtaataaattgttttagatgtctttattttaaagaataaattaaggctcagagtttaagcacaaggcccaagtcacagactaaactataagttaggtcatcaggtgcctggttgaagctttttctatttcctcatggaaatgatgttataggaaaaattccaagatcccaagagattataactaacatgacttcatgtatatattcaaaatggaataatgtaaaatattaatttctaccacactgagaattacctgagattcattctaccttcattttgtagattcaaaatatggtgattttgcagtgatcttggtcttaatttgtgttcttccagaaacagatcctgagacaagaatttaaatgtaattagtttagatgggagatataggaaatactagtagggctgtggaagaagtgattccaaggaggcaggctacaaataaagggtataatgtgaagccagccaccacggggaaatgattggaacgtttcctgtgaggaactgcaaaaacagagctcagagttctcttcacccaatgggtgcgaagctgggattgttaaacaccaactcccagcaagtattactggaagctgctggggcagaagtgttaatgtctcagcacttcaggcctctcctgcttatagaaagagtggccttctacattgctagaaaatcccttacacacagtcatgcagatactcacagttgaaagtccacagaagcaatcatattttaagattccaggaatatgtgtgggcactgtcagaatctgcctcatcttgaaattttattttctgtgaaagcagcaaatctggaaagcaactaaaaacatgctactcaaagaaattgactctatttagaataagtggtatgtcttttttctgtaatgaatatattaaacattatcatttgagatgaaatatgtaattctcaattttacctaaatgagaaatttttttttttgacggagtctcactctattgcctaggttggagttcagtggcatgatcttggctcactgcaacctccgcctcctgggttcaaacaattctcctgcctcagcctcctgagtagctgggattacaggtgtgcaccaccatgccggctaatttttttagttttagtagaaacagggtttcaccatgctggtcaggctggtctcgaactcctgacttcttgatctgcccacctcggcctcccaaagtactgggattacaggcgtgagccaccgtgcctggcctctaaatgacagatttgaagatttacaaacctgaaaataattgtagaaattcagtctaatactcacacttaatagatgaagaaatggagattgaaaaaagtgaagtgatttgtataaggccatctatatagtcagtggagttcatgggtttaaagttttagaagacaagagctaaacacgacattcaagggcaatttatatctgaaaaacaacttccatgtttagactcacattttaataaattaatcaattcatttctgtttcctacattaaaacatttttcacagtaaggaaggttaatagacctgaaacaatagtattaaaatcaaaaccatatgatggaggaatatatggactcaaatttataagcttatgtcttcataaatataataatggatgcattatgatgaagaatcatctttgcattggtaatagaaaaacagtttattcattccagtgattctgccagtcagaattcatctttggaactagcccaaaatttctgcaataaataaataaataaatgaactcattgcttcagagccacaccatgtttttcactgagaaaattgcattagccaggttgaacatctattttccagcgacttaacaacgaattacttttagttgtggccaaaattccaatctatttcaaaagattatttttcatcactgacaatattaaaaagaatatgcctttgaacaataaccacatcattacattaaaccacagttccccgaagtaactattttagagaagataatacacaatacacattaagatatgtacatctcagtacattcatttttaaatgtgtcactgtatactaatagattatgatagaccataatagataggtctaggaaaggagtagctcaaggagaaattcacagaatgttcttggaaagcttcaacatccatggaatattcatagaaggctttatggacaggtggctttcaggttgggccctacaagtgtaatagattttgatttatcaatgaggttatatatattttggtttactactgatatggtttggttgtgtccccacccaaatttcatcttgaactctagttcccataaacccaagtgtcatgggaaggacccagtgggtggtaattaaatcatggtggtggttaccttcatgctgttctcatgatagtgagttctcatgagatctgatggttttataaggagcttttctcccgcttcgctctgcacttctctcttgccttttgcaatgtaagacatgtcttgttccttttcaccttctcccattactatgatgcctccccagctatgtggatctgagtccactaaacctctttttcattataaattacccagtctctggtatgttcttatagcagcatgagaacaaactaataaagtaaattggaccaggtagtggggtgctgctgtaaagatacccaaaaatgtgcaagcaactttggaattaggtaacaatcagaggttggaacagtttggagggctcagaagacagaaagatgtgggaaagtttggaacttcctagagacttgtttaatggctttgaccaaaatgctgatagtgatataaacaataaagtctgggctgaggtgatatcagatggagatgaggaatgttttgggaagtggaataaaggtgactcttgctatgttttagcaaagagaatagcagcattttgcccctgtcctagagatctgtggaactttgaacttgggagacatgatttagggtatctggcagaagaaatttctaagcagcaaagcattcaagaggtaacttgggtgcttttaaaagcatttacttttattcattcacaaagatatggttggaattggaacttatgtttaaaagggaagcaaaacacaacagtttgaaaaatttgcagcctgatgatgtgatagaaaagaaaaacctattttctggggagaaattcaagccagcagcagaaatttgcataattaatgaggagccaaatgctaatcaccaagacaatggggaaaatgtcagtgtgacctggatgtgagacatggagtcaaaggagatcatttggaattttaagatttaatgactgccctattgaatttcagacttgcatgggacttgtagcccctttgttttggccaatttctcccatttggaatgggtgcatttacccaatgcttgtacccccattatatttgggaagtaactggcttgcttttggttttacaggctaataggtggaagggacttgcctcatctcaaatgagagtttgtatttggacttttgagttaatgctggaatgaatgagactttggaggactgttgggaaggcacgattgtgttttgaaatgtgaggacatgagatttcggaggggccagggtggaatgatacagtttggctgtgtccctacccaaatctcatcttgaactgtagttctcataattcccacatgttgtgggagggaactggtgggaggttattgaatcatgggagtggttacctccatgctgttctcatgatagtgagtgagtttcacaaggtctgatggttttataaggggctcccccaagctttggtgtgcacttctctcttgcctgccaccaggtaacatgtgcctttgctccttcttcaccttccaccatgattgtgaggcctccctggcccagccatgtagaactgtgagtcctctaaagctctttttctttataaattatctagtcttgggtgtgtccttatagcagcatgagaacagactaatacaattagtgatatattgtgtgtttgtctaagtttttttttatatttgtgttattatataagatttgagatttgtagtaaaccacatgcatagaagagttctaaaaaaagaagaaaagaataaaaacagtctgaatatataaagggtgttgcagcctagagaataatggaaatcaaagtatataaatctagtgaaaccaagataacagaagattttgacaactactcagaagtaatcaggcataagcgataaagtgccattgaacacattagagaatattttacagaatgcctcagcgaaacacttggttaggaaatgctctatgaacttatttggaggtgaggagaatagtcacctccccaagactgttggggttacaagactgttgcaggggtacagattattaagcaccaaggtgagggttgcagcaatagagatgagagtagaaaaaatatgaaagaccatatactttcaaggagaaatgattaagatttcatcattggctgtatatacacagacatcagagaagaggtaaaatgaacttcaagatttcaaaccatggccaggcatggtggctcaggcctgtaatcccagcactttgggagactgaggtgggcagatcatgaggtcaggagatcgagaccatcctggctaacatggtgaaaccctgtctatactaaaaatacaaaaaaattagccaggcgtggtggcggtgcctgtagtcccatctactagggaggctgaggcaggagaatggcgtgaacccaggaagcagagcttgcaaagagccaagattgcgccactgcactccagcctgggtgacagagtgagactccatctcaaaaaaacaaaacaaaacaaaacaaaaaaatagatttcaaaccataatgagaagaggccactttccctgatggagaacaacatgaagcaatgaatgctgggtgggagaaaacatctctttaatgtaatttagaaatatcagtgaaataatttaaagaataggtatttaataccattggtttctgctcaaagttccaaaaagatatagatgaaaaaaacttcaaatagatgagagtaaggtccagaactcaaagtataaatagaagtataacattttacttctaagaatgggactaaaaataaaggcattctagaaacttgctgaattttggggagactataatttatataaatgacataaagagtcatagaagtgacaaacagccagagatatcgttatatgaacagaaaccaatgaaagccctctcagaggcaacacaagatgaagtagaattagaagtgtaatccaaggagaaatttaaaatttaaagggaaaggactcaaaagaaaaagaaactgaacattagctgaacaattagatgccaacctccttatattcactggaagaatgtcatcagagtcagtaaaataatatgatggaagaaaaaatataagatttgtttttcctagttggagaatcttgggctaggataaatggcctgggaatctccaactaggaaaaatgtacatgaattttttttgtgttcttttcctagggtacttttttatcattgcaacatatccccatcaacttcaccatcatctatgaatatgtgtgatcattattagcatcaccgttagcgttgtgatcacttagaagacattgtggttgtcatcagcagcagcaataaatttatttctatagtcctgttactaaatttacataaactattgttaccaggcaataaagtaaggtggagctgaatgaattttttatgtttcaactttctgtttctcatcactcagtataattcttcctgccaatcttggaaagacctttccctccactgaaggggggaagatatgtctctctttttctatttccacattttcaactgtgtatcagtttgtaacaataaaactgcagggggaatggaatgcatagctggggagaactggacagggagtgaaaagaccatattagcccaactcagccaaattgcataacctttcttaaatcatttaacttttcagattgttaggaaatcagacctttcaatctctagagttctttctaattcttaaattttatgaagctagttgaactggcttgtcatgggcagaattatatatattgtttggtatgattgccataatattgataatgaagccatatcatgctaacaatattccagacattggttaatgtgccacatatatatatgagatttcatatatatatgattatacatatgattatatatatatatatatatatatatatatataaaaaatctcatttaattttcatgatgtccttataagctaggctgtcagtgtccccattatagacatgaataaacttggggttagaaactttaggtgacctgtcaaaggtcatacagctagcagtgacagagctttctttctttcttttttttttttttttttgagagagtgtcttgctctgtcaccaggctggaatgcaatagtgcgatctcagcccactgcaacctctgcctcccaggttcaagtgattcccctgcctcagcctcccgagtagctgggactacaggcgtatgccaccaggcctggctaattttttgtattttagtagacacggggtttcaccattttggcctcgatctcctgacctcattatccgcccacctgggcctcccagagtgctgggatttcaggcatgagccactgcacccggcctggagctttcatttaaactcagtcagctgagcacctgtgcatgatagtaaacactgtgctgttgttgggtaaagatgattaaaaacaaaatcttctcctattaatgcaaaaaataaaaataaataaataaataaaaaatattgtaaagaggtttattctgagccaatatgagcaactgcatcctggagaaaaatacaaatccaagaagccttgactaagtggccccgaggtggttgggttacagttttggttttatatattttagggagacaggatttacaggcaaagacataaatcgatacatggaaggtatacattgggttcagcccaaaaaggtgccacatctggaactggacacttacaagtcataggtgggttttaaggattctttatttgaaaattggttgggagagttaagctattatctaaagacctgaagtcaatagaaaggaatgcttgagctaagataaagggattatgggagccaaggcccttgttatatagatgaagcctcataggaagcggaccagcagaaagaataaacagaaaatgtctgtttttagagtttgaaaggtatgagattctcaaataatgtctcctagatctaggaaaggcctagaaacggaaggcctggctacattaatggagattctcaacagatgcaaatttccctcacaaaagacagctttgcagggtcatttcaaaatctgtcaaagaaagatattttggcctaaaatattttgatgtccttcagggtctactgtctgtcttttgatgctataccagtcagtttggaaggtaagccatattataccaggttaattttttgaaaaccctgtttaatgagattttatagtttgtagggtacaacttaaacctggccttgcatagccttaggtcttgtttataatttggtaccttaatgccacaaatcatatgttttgttagtcttatgatctctattttactattaatgctgctcagttgtgcttaaactcaaaaagggagggagtataactattattggcagaacatatgagagtcacgcagcacctaaataggttcctggtggtgaatctgtatgggtctgcagaaacctcaatccttgcctcctcagaagaaagaattcaactagggcataagacagagtgagagatcacggcaagttttaaagcaggagtgaaagtttatcagaaagctttacagcagaaaagaaagtaagataaacttggaagagggctgagtaggcaacttgagaggccaagtaaggcaacttgagggatcaagtgcacatttggaccttttgacttaaggttttatacgtagatatgcttcttcccttggggtggactgtccgcatgagcggtggccctgctaggatttgagagggccacatgagcagtgtgtttaccgaagttgtatgcatgctcacttgaggcattcttcccttgccagttgaatgctccttgaaggtcatatacctgttaaactccaccattttgccttttagtgcacatgcttgagcccactcgcccaaatcctgagaccttatcaggaagctgctgattaccagtttcagattattttctactgggagactgctcttccctggctctggctgggaccaattattattagtgaagcagctacattgtctgaggtatataccctggggttcgttgtcccagtcaggaaaatgtaggacatggacacacaggaggagtttaggagtagagctttaacagggagaagagaagagaaagagaaacagctttatagagaaagggatctccaagcagaaaggaccggctggcggcagatgtgccaaattttatagtcaggtttgaggaggcggtgtcttatttaagtagagctcacatattggttcaatcaggtatgacgtttacatagcgcccggggaaggctggtcgccccattctaatcttattatgcacacaggctttccagttgatcgctgccatcttcaaaatgtctaggccctagttcctgccggcattcacccgtgcaagctcccagcttgcttgtctgtctgcagcttgactttacagggcgttctttgttagaaaatgatttggggctgcttttcattaaagagaaaagacttaccgaggactcctatacccttaccatctgcctaagtgatttcttcttaactcttgtatcatcaggaccgcctgaccaccatctgatgatcgcttgacattcctggtgggggaggggagccctctgctaccctgctcatgcctgactagctacatactctaacataatgaggcatttcagacctccctgcctatcatggcgagaactttgtttttcgggtttctctggggtccccttggccaaggtgggggttctgttcagtcagttgtgggacttaggattttgttttcagttacattcccaacccagaaaacttttccacaaaggtagaaagaaacagctgtgctggccgggcgcagtggctcacacctgtaatcccagcactttgggaggcgcaggcgggtggatcacaaggtcatgagttagagaccagcctggccaatgtggtgaaaccctgtctctactaaaaaaaaaaatacaaaaattagccgggcgtggtggcacgtgcctgtaatctcagctactcgggaggctgagacagaagaattgtttgaacccgggaggcggaggttgcagtgagctgagattgtgccactgcactccagcctggtgacagagcgagactccatcgcaaaagaaaaggaacagctgtgctatataaaaatcattaaaccggaatgcgatttgcatcacagggaattctttaaaaagatttcaaagtcaacaagaaatcccacccttttctatagccagcaaacacaaccaattacgtgcacatgctcaggataaaaaataagtggtcctcaagaagacttgacagcacaatttgtcacacatagttcatcctaaatttacctgctgattgggttgtaagctaattggctttatccaaaagctaagtaaacttttcattgtttctgtcatagaaggtggttttggtgcccaacattttaggctcctgtgcgcccatgcaaactggaagataggggcgctgtcttccttgatgactgcattttaaagagctggctcccaggcccttgataagtcattcctgagttttaaagcttcctgggtcgtagagacttagctttagcttttaaaatgatttaaataaatttcaaagcgacagagaaagaactcagaatcacaagttttcaaaagtaaatggtttgagaaaacagagacagggtaagatgagggtagtttcaagggagtctcttttcttcaacagggagaattaagtgaactgtttttcatctgcatttgcccttccgctatctgtactgccaatactggaaatgcagaaattatataggagtatgctacctctttgcctttctgttaaaaggatcttctaatgaagatgttgaagatgaagataatgcaatgcttgcacaatactattactttacattctggagtgttattcaggtatcaaagggctagtttgtataaaaatttattggctcctcacaacaaccctatgaaatagatacaactaccttccctttgatatcatttgtacccattatgatgcaaaaatagagaagtaaagacatgcccgagaggtggagccaggagttcaactcaaggagatcgatttcttagttccaataagctgcttccacagttgccagtttctctggtggctacagaaagctgttgtgccacttggctcacaggaccagatcctggtataggtttttttcctcaacagcctgtatctgtggagtatatgaagccagatttagatccatttccatgtctccttgcctctttcccttcctgtcttctctggttttcctggtctcaggaaacacaatatactaatttcatgccatgattttacttacacaagattggcttcgtggttccacatctctgctatgagttgtggttctcaagggtcctgtttatcttctttgactctcccaatccaaacttcctacccattataaatattctcatctgccacctgctacagtcctcatccaaactctcctgttaacctgcacagtggggaggtatgctggaagaaaagaacaattaaataaacaaatagggtcactttttaagcagcagtttacattccttccttctcctttcatacatatatattatttgtcttcctcttcttctaaggagaagagggcttaaggaaaatacaattactttttttctctagaggattcttttggtatttaaaataaagttctggtatttcaaatgaagtgggaatacttttgctttcctagcatgaacagttcttaatgactcttcaaacatttcacctctaccatatgtacagtatgaaggtaagagataactgtggaattgtatgtgtgaagaaataaaatctcaattgcatatacatagagacctgtgaaatctaactagccatctgtttcatactactcaagagattctagagtttcttacattcctcagattttgatttatgtttattgaatcatgaattatacttctgcaaattatcccaggtttttcccaatgcttatatcagtgaatatatagtcacagagggaaactagagatttatgcatgcttgtatggtctactgttaagatatatgtgacatcttaaactttgctactttgctcctccagtggataattttaaaaattcttgcatattggtaacatgatttataataattttagttctaagaaataagtatttaatggacaacacagacattactaaatgtataatggggtgggggggtaactaaggccccagaggtaatatgatatggctacagcagttcagagttcccgaagctagaaaattgccttatttctctactttataatttctttcactctgtaagagctgtgaagaaaaaaggtgaagatccgtgggtaagagaacgtgagtgaatttcagtgttgctaactatagcaccagaaaatagacatttgaaaagctcagccactcctcacttcaatccaccttccacacggttaccaaattatcttcctgattaaccaccgtggttctgttgcatcccagaatccttgtgtggatttctatagcctgtacaatgaggtcctaagcaagcatggaatggcaagccttctaaaattcttcccttatccttctggcacttaaaacactgccttttcactgtaatcatttgccctctgtttatttcccctgtttagtttaaacacttgggaagcaggacctgctcagatccagcatggtgccagcacgttgtaggcctttgctaaaagcatggtgaatggatgaatgaataaatcagtgagtcgatttatatactgacttttattaactatgacagatgtataataaaagctttttccctaaactgtttaaggagatgcctgtggcctatatattgagtgacagaagggccaacctttttggtaacaaactaggcaaaagaatgagacaagatatgcaacttactcgtttagaataggcttattacaatagcaatcatgaaaaaaataatagtgcttacttactatttattaagtgcctacaatgtgctaaggtgttattttgaatgttttaaatacatgtgtatatataaatatgtatgtatacacagacttctgcacacacatgtacataatgccacaacactatggggaaagaggtatagtctgcattttatggatgacaaaaccgagtctcccagaagttaaataacttactcacccattaccactcgggagagaagaaatttttaatgtgataaaattagtaagttcacatgccataacagagctgtgttttaccagaggacagatttacttatctatttaacaacttttattgaggtcctacagtattctagcagctatgctagttgaagggatatgatgttgacaaaatagtgatcaaatttctacctgcacaatgttgactattcccatgatagttatactaaaagtccagactctaccactatgcaatatatgcaagaaatctgcacttataccctctaaatctataaaaaataataaataaatacacaagtttaaaaaaaaaaaagactgctatacctgcaaaaatcactgggacttagagtagccatgattgtttcttcttgccttccaaccatgataagtagacctggaaaaggactgtcttctaggagtagatgccatccgtatctctctttcttttccatttcctttacacatgccacttctttgctaagttaaacaagatgtgatttgcaaaaccgagtcccttagattcaagtgtgttagaagcaggaggcttcattttggactcagggccttattagagtttttcaactccgctttatatatatatacgtatatatacgtatatatatacgtatatgtataattgtaaaatatacacaacattaaatgtatcttctcaataatttttaagcgtacagttcagtggcattaagcacactcacattgttgtgcagtcatcacccatccgtgaccagagctcttttcatgttgtgaaactgaaactctatgcgttcaacaatagctccccaagctcactttcccccagctcctggcagccaccattctaccctcggtctctaagaatttgactactctacttatcaacaaaactattataggaaagtcatctgtcagtgaacactagtggtttatttggctgttgtcaaatctttgagatgtttcccattgggaatcagttgcctcaaaggggtgggaggtgtgagcagtggttagaatgcaggccttgaaggtgggtccctgcctataatgccatcatcatagcaccagaatggaaactctgattccataccaatattgatagaattggtttcagacctatcagactgatgcaagccagggcttgagtcaatataaagttgtcttcttttggggtgctcatctattttgagcagatttttcttgaataagcccaatttgatcttcaaaagaccaacccttctgccactctctgtgggccacaggcacactcccaaagaatatatagctgggggagggaagcatattttaattatgaagtcgacccaaagcatatatatgcattgattcattgatttcttttttatacctgcaacaccatgtgaaaagttcatgagtaactcagcaacctttagatcattttttttcctcctgaagacaatctcacttacttcctcttattctctagaactaatgatgtgacctgatctctttatgacattttttattaaatttaactataaaaatttcaaatgttaatggctgtgaccctgtagatttttctctccttcacaacgctgatagaaatgtaacttttcattcagggaatctatatttctgctctgcctctcagtgtttaagccagctgcccactgtgctaagtcaaccttcccagaagctaatctgtcattctcaagtggccttgcttctgaaattggtttgatgctctagcagtaaagagccccagtggtagtgcaagctgtacagtttaacaaccacttggggtggggcttgtccgattgccatggaaactatgactttgtatgtctgctctggagacaagaaagacaaatgacttgtgtattaatctattgaggatgtgaggatcccagataaaatgagtcctacagaacacggagaaggttctataaattaatggtgtgggtttttgggttttggttttaggttttaatatgtcgatgtcaatgaagggtcaaaagaattatgtctccacctgatagctttcctggagaagtatttgctttatatttttataaaaactctttgattttagccataaatgtaaaagataaacataacattctgcaagaccttcaccactccaggtgatatgtggctgttgaaggaaggtactgcacatttacataacaaaatgaggctattaggggacaagtcacttgtttatttaagagaacgaagggcaggacaattatattaacatgattctcataggaatgcacattgtcaatgttaacaaatggttttaagctaaagcccccggtacatggtatgtggtttaattttagttgtataaacattagagcaatctaaagtttaaattacattttggttatactttagactccattatccaggaaaatgtaattttagcctctataaatatgaacaaaaatcaaatctaatgattgctttcatatttataacatcctttcctaagttcacattgcccagctaagacaacacagtagaacaaatgtaaagagcaactaattagatcttacccattttccagtttatgtttagatttagtcttctaagtgttttcagaaagtagtatcagaaaaatgtaaacaacaaaaaactgaagatctctgcatctttttgtatgtatatgtttttccaataaaatgtaaataataatcaggatttttttcaggccccttttaaaacaatattttatgttataaaatcttaatgttgtttctctattatttcaatcactatttaagtagatactgaagtactaggtaaatgtttttgttttgtttgttatttatattgtattttaatttttaagccaatattattgaaatataattttccctttgagatgtatagttccaggaatttcgaccaatgcccatagtcatgtatccagcaacattaacatatggaatatttgcatggtgccaaaatgtttctttgtgcctctttgtagtcaattccttttcccaactcccagtccctggcaataacttgcatcgtttttatctttggctgttattgaagggagtgttgtggtcagtagattgcaggcctggaaagtagcatataggagagcacataaatgatttttgtatcctacatttttctgacactcttaccacattgtactgcaaagcagtttaaacttcctaaccctagtttctctaggagactgcctactgcctaacgtgtgccttttgacctaacttcacttgtgttaccttacgcatgtcatttaactttgttgtcattatcttatatgagatcaattactaagtgatatctacaatttaaaagtgtttaattttaatttaatgtagaatctaatttttaaaggaaattctaaaagttgtgtaggttgtttttcctctacctaccacaatgcaatttaaaaaaaaaaataacaaaatgttgcttattttctttgtgtcttcatctccaaaatgttctcttcacagtaatgcacacaagctagttctgagtaatcaattttttaaacaatattacaaatctatttttaagtacaaaagtattgtaattgggctaaaaaacaaatagcacactgtaaatgctaaaaatcaaagtgcctgtctcaccctttcttaccttccacccctagacgatacaaatgttaagagttcaacaagcattctgccagcctttccgtttataaataacatttttaaataaaaacaatgcaaaaatgagagagaaatctataaattgctgtttatcacaaatatctttccgtgtcagtaatataacttcctttattctccactggatagttttccacagtaaagtttcatcataattaacattgaagcagtgatgaacatgcagtttgcttcaattttttctcatatgtatatcttgcatatatttatcacaaatatacatatatttttctcatatatacatatatagttgtacaattacatgactatttcttatagtaaagatttcaggaggtaagattgttgggacaaattatctgtgcatttgaaatgttgatagcactatccaattgccatccaaaacgaatattcattatactcccattgatagtgtgagagttcccgctttctcataccctcaccacaaaggatatcatcaattcttttaattatagtcagtctgatagggaaaatatagtgcatcattgttatttaaagttatagtttcctcattagtgagtttgagcatctgtttagaagtttgttagagatttatatttactcttctgtgaaggttcaggatatagtcagtgcctggttatgttgcttgggttgtcagtctttttaccattgatgtgaaggatcactttgcattttaggcaaattagctctaaattttaaactgcaaattgcaatttaaaatttattttattttattttattttagagacaggatcttgctctatcactcaggctggaatgcagtagtgtgattatagttcactgcagcctcaaactcctgggctccagccatcccccagcctcagcctctcatgtaggcagcactacgggtgtgcatcaccatgcccagctcattgcaaatattttctctgaatttacctttatctttaactttattcaagtatcaaagactgaattgttcatgttttttcaagaatagtggttcccaaatcatctacagattaggtttaccaaggagcttttataaaaagactacagtctgagcccccacatatttaggtttaattgactgaggtgacattgaaacatagtcccgcaggagatactaaactgtggacagggttgagaacttcttattgggcatacaaatcacttggggatttggttaaagcacaggtgctagagtgaagactgagagctgatacttctaatttactctaggagatgtgcatgctactgatctatagcacatactttgaatagcaaggatttagagtgtctgattttggtttttgcttaagaagactttccttactttggattataaaacgttttttcttctatgttttgttctagtatgttctatcattttaattgaaattataaatactcactttattttctaagaataaattaggaatctaattctattcttttaaatcaaactccaaccaattacaccccattgattaggtacatgtaaaaattttgatataatttcagagtaacataatatatttgtattgttcttttaaacgtcttcagaaaattcacatattgacaaaagtagaatatttttaaaataatataaataaattttaaaatcataaaattcatctttctgtccatttgatctttaaatttcaaatatgtttatgctaacaatgtaaatacgacttaaaattaaaaaccaaattcctgaaaaagaagaatggaggatgtgatcagtatgttagtttccatctttatcaatgtttgtggacactccataggatacagcaacaacctcagtctgtaacagtaatttggtaggaggaatgctattgtttggaagaatatactaccaacataaactagcttctgctaagctcagggtacaaaatctttcttttaacattgtaataaaacgcctacagaactgaggattttcaaatacctgtatgaggatgttgatgatgttgatatctacaaggtaaacaatgggggtgttttatgcaaagataatttaaggtactcaattcatgcaagaatgtaaagaaaaattcaagtgtgcaagagtttaacccaagctgataagtcaggagtataaaaagaaatgaaaactgaaataagaaagtcttataactttcattaaattatctcactatgtaaatactttttctaaagagataaatgattactgaataaatgagctgtaccccagaataaattttactaatttagcctcgctactttccattatgatatcctagtagaaataaattttcgttgaataatctagcccttgggaactcaatagatacgtatctttttctctgtgaagtcacagctcatttaatgaaattggccaccaacgcccagttacatctttcatgcatttttaatgaaatgtaatttcttgagctagagattcaaagaatctcgttttgcatctaaaattatgttcttcaaagttttggtagctaaatcggaaagttctatagcccaagattcttgttattaaaagaacaatgactttgaattgccagtgcaaatatatattttttctgctgaactagaaatatcattctttaaaaagccatgaaaaataaaagtcaatgctgaaggtattttattatatataacctttagttaataagaaaccaatgtttgttttgctaaaacataaagtccaaatttcgtgattgttttgcttgtttgtttaatagcaaacattgaaagacaaaatacatttttaggatcaaaacatgtctacccgctctatatactaggtcatgcacaaattgtttttctaaaggtatcaattatcccttcttaaaaacttacgtgtgagagttaatcttaaaagtcaatgttaaaagcgttttttttttttaattctatattgctttttcctgtagggttactgataactaatatcaacggagaatatcgttatattaggctggtgcaaaagtaattgcagtaaaaaaaaaaaaaaaaaaaaggtaaaaaccgcaattacttttgcaccaacctaataactctcagatgttcttaaattattaagtaccttttctctcaagttgtcttaggtatggttagattaaatacacatcaccaaagtgtatagctatagtgtattttatatacccaagtgtttgtcttcagagcagtcctcagagaaaactgccatcatctgtattgaacatgtgttctctagtccttccatattggttaatgattatatatttgtgtatataccaagctaaatcatatgaaattgccaatatttggttttctggcctatacaattagaagttgaatatgattcaaacccaatatttatgctttgggtgtgaattaccagtttcttccaagacacttgatcctgggcgatgggaatatgtttagcttcttcaaattgacttgaacagcctcacctgaaataaagcctttcttttctggacatttccaggaaaagccagtcttgctatttcttgaatagagtgaactgttgcaagtaaactggatgagaactgttatctgactctgactcattttagtttaatccagctgccagttgttcataaatgtctcttgggacctatgtagattcttcacttattagattaacactatattttcatgaaaagatagtcttttcacttaaaatgaggagttaaattttgccttaaaatctgaactcctgttagtaatatcatgttcatacatttcctaattgtattctgaatcacaaaaatgaataattctgattcatcataacacaaatgcttatattaacaatattttcctgcacatacaatatattattaaatagaatttacttagtatgggagactttgcaacatatctcttatctcctttccatttgccttattatgatattttgttagaaattttggccggccacagggattcatgcctgtaatctcagtgctttgggaggcaagggtggaaggatctcttgaggccaggagtttgagactatcctggacaacataacaagatcccatctctacaaaaaaattagccaggcatggtggcatgcacctgtatgtagcaggaggatctcttgagcccaggtttctacattacagtgactatgattggatccctgcactccagcctgggcaacaagtgaacctgtctcaaaaaaggaaagaaaagaaaacaaaaagtaccagcttgggctcagcatctgattcttgccttggccttgttccaattgccattgccttcaacaagaggatttatcatttcccaattctaactcccaccccaactgtatattctaactgacccatggattctttcaatattggaaactatgtaagattaagtttacctctttgatatatttctcattaaagcattgcatgcatttcctcacattctcatgaactatattggtgaattggtatggtaagggtgcaaattagttttgcctttttcctttataagtggacattggtttctaaaataattctaccaggagctagaattattggcagactcaaatcataaaactttttgttagtttctcaaattaaaatattttgaaggttttatttaaaattttaattgaagtataacatatgtaaaagactggcaaaattgtaaggattcatctcaatgaattgtcatgtggtaacccatactcaagaaaagagacagaatattagtagctaccatgaggccctactttctcctccccactagaaagagttacttttacttctaacaccagagatcagattttctgattttaagatttatgtagttgaaattacactgtgtaagttcttttattgcatcttttcctcaacattgtggttataagagtcatccgtatcactgggtgcagctgtaatgcctccgttctcattgccctcatacaaatccattgtatggacattgcgcaatttgtccattctactactaatgaaaatctgagtggttcccaggtcttggctcttataaataatgccactatgatcaccatataatttcttttggtgcttatttctggaattactaaaatttaggatatagctatatcaatttagtaggtaacagttaccaacaagttgttaaaaataggtgtcgcaatttacattcacactagcaatgtttgataattgcacctgctccaggtcctcacctcaccttaccagtcttacttaatttagttatctttgcaggtgtacaatagcacatagcttttaatgttgattttgttttattgattatcaataagtgtgaacaactttttaattggccatagcaggaattcatcaatttttaaaaatctatcaacttaatgcctttaaataatgaaatattgtagactcaccaacattgtttcagaagttctaatagtctacctgtagaagtataagaaagtacaatataaaatcttgtatctatacatctggaatattgctatttgagaacactaagaatttctaggtaactctagcatgtgccatgaattactctaagaactttacagaaactaagtggtttaattttcatgagactcacatgagtctaatacaattgttatctcaattctacaaatgaagtaactgaggtacagaaacagggacataacttgcccctgctcacacattaaataagtgacatacaaagtgtccccatgctgtgaggcctctccaagttttatttaaaacattagaaagtagagtagaataatacatattgatgtattttttagaataataattacaaatagagtaagtttgaaataatattgaagatttaccctatatttaacattccctaaatgcaaaaaaaattctgtgttgctgaagcaaaatacaacccaagctgatgatgaatttcataaaagactgagataaacaaatatattttaaaagaatttttaactctaagattgggtaactctttctacattagtgtaatgagaatagtgaacctttgaaatgagtaaaaaatatggaaaatgttaatgatcttgagttgcacatattttgcattatgagcaacatttctggttgctaaatgctaactatattatgcacagtgtacgacgtgggtgagttaatgttgctagggaacttttagtgtctagattgctttgtttttgtgtatttaaatttgcaaactcaacattatgttaggataccttctggcatttaattaggttccattccatgattttaaacttaaatgtgccttaatgtggaagattttgttatttccatcttccattccatttcttgttcctagtagttataatcataatatagtgaaatagggtacttagcgtttcctagtagacctgagtacaaaatatctttagaacatctttaaacatttttgtgaatgtacctttttccttctaggtaggagatcttcctgtttatgggtccatgataatcactctccaggagaggggagttttggatgccatgaaatatccatactaaaaaaaatgaagtccttaaattaacaagagaagggtctctccccatgtgacaggcatacactttagccccctaactagggttgcccaatttagcaaataaataaacaaacaagacatccagttaaatatcaattttgagtaacatttttaagtataatatgttccaaatattgcatgaaacatacttacataaaaaattatgagttggttttcttaaattcaaatgtaactggccattcagtattttatctggtaactctgtaccctgaaagagataatgagaagatcacatgaagtcaactattgctacaattctcctaaaatgttttctgcattatagaaacagcaagaaataaacatcaccatttaggatcagcaatgcctgctagacccacaccaaaaaaaaaaaaaagaagaacaaagaaaaaaaattactgattactagacataaggatggtttaaagggagaatttgagcaataaagagatgataaacccttgaacttgggaacacacagaactatgtaagctctatggaacaccctggcatgcttccaaaatactaggccattggactagactattaggaagtagaatgtcaaatgtctttttctattatagagatttagttaaacccatgaatatttatccagcatgcatttcccaaactgttctccacagaacatgaatgttcagtaagatattaatagatgctccttgaaaaagtatttgaaagtcaaaaacttatgtaaccctttcgttgcattttccctgctgtagcataatcaatgggagcctatcttaggagttgtaaggaaaaattgcatgagttcaagttctggtcaagcaatgtgagacatcaggcaagtcatttaaccatcacgtacctctgtttcttcatctgtcaagtgaaagtacttatagtagtttcctcatacattaaaacattaagccttttagaagaaaacataggagaccttggggctggcaaatgtatctcttagatatgacacagaaaaactaaccaggagagaaaaaaattgatcagttgggcttcctcaagattaaaaatgcctgttcatcagaagttaccattaataaaatgaaatgcaaggcacggactgggagaaaatatttgcaatacttatatccagctgaaaaatttatcctgaatatataaagaattatttcaactcactaataagagggcaaaatacctgaataatgtacaaaagacttgaacagaaacttcataaggaagatatacaaatggtcaataaacatatgaaaaattactcaataccattagtcgtcatgaaatgggaaattaaaaccattatgaaatactactacataaattctagaatggctgacatttaaaaagactttccaataccaattcttgacaatgatatgaaacatctggcaatttcatacattgctgattggagcataaaatgttatagccacattagaaaaagaaatctaggtgttttttttaagatgttaagcatatatctacctatgacccagaaaattaatttctagatatatatcaagaaaaataaaaacatattcacatcaaaaatttgtacaggaatagttatagaagcttaaataataaaacccccaaactggaaacaacccaaatgtccatcaacagaaaaacaggtaagtaaatcacagtatgttcatataatgcaatactactaaacaatataaaataatggaatgatgatatatccagaaacactgatgatacttgtagatattatgatatgcaaaaatgcatttatgtgaaggtccagaacaggcaagaactaaattatgaaggaaaacagaatcattgttgccatttgtgtgggcaagtgtgaaaaatgacaagagaacagcatgaacaaacttcaaacctaccagataaagaaaatatcctatattttgaaaaaggtgtaagttaaatgaggggttatgaactgaattgtgttcctgtaaaattcatatattgaagctctaaaccccactgtgactatatttggagacagggcctttaaaatagtaattatggttaaaggaggtcacaaaagtgagctcttagtccaataagactggtgtccttacaagaagaggaagagacagcagggatgtgtgtgcacagaaaaaagatgatgtgaggatacagagagaaggtggccatctgtaagccagcgagagagacctcagcagaaaccaacactgtgggcaacttgatcttggacttttagcctccagaactgtgaggtaatacatttatgttgtttaagccaccgagtctgtgctatttttgtataaccaccctagcaaactaacatagggagtatatgcttgtcaaaacttatcaagctccatatacaagattggttgtttcagtctatgtaagttatatttcaacattaaaaaaatagaaaagagtggtcattatctcatatgtcggttgccgaaaatataagttgatcaaaactatttcacatctttgggttccctaaaataaagtttaagtttggggaaaaccctgggatggaaatgcttccaaatcccaccctctggtgccatttgtttattcagtgctttttgtcatggagtaaaatcaaacaaattgtttgagattttagaattaaaagatttacataaaatttcctgagatataagtggtaaggatgatgataatgataatggattttttttttttttttttttttttttgagacagagtctcgctctgtcacccaggctggagtgcagtcgcgatctcggctcactgcaacctccacctcccaggttcatgccgttctcctgcctcagcctcccgagtagctgagaccacaggcacccgccaccacgcccagctaattttttgtatttttagtagagacggggtttcaccatgttagccaggatggtcttgatctcctgatctcgtgatccacccacctcggcctcccaaagtgctgggattagatgatggatttaaagcagtttgagaacatgtgataattaagtcatagaattttatggatgcctcttactcccaggtagtagagagtgctacatttccaaatggatgaagagccagataatttttttgccatatcaagaccaggcatttttcagacattatcatgctgaaatgtaactcttctctgaatacatcataatccggattaaaatttctaccatctgtaatcttaccattaggccacatagtttatttgtgatcatgaatactgttcctttgaatcttcactttgcagtgtagtatttttcatatagtaaactctgagttttctaagaagtctgagatctttattcttattgagtctggttcctagtcattgagatatcagcattaggataaaaaatagtggctaaaagtaattattccaagtgactgaaaaattctgcctaaatataatgtgttgaattttaataaacatattatcatggcaatggcaataatttatttcttttctctacccacccctaaaatggccccatgatctatagttgataccaattcatttcttagaaatatgttatgctttacataagaaataaattttgctattcaaacatgataaaatataagacaattaattccaggatcatccaaaatcaacaaatctatgtgttccaattcgtaattaatgttcaacttgcatcctgatatgagcaaaattttgtgtttattaaaataagagagtgaagatgaagtcattaaaagttcagattcaattcagtagatctgttagagattcttaagagatagttcttgcataccctgaaactcttagtttaaaagaagcagaagtgaggtggccaagcgtgatggttcacggctgtagctccagcactttaggaggtttaggcaagatcactggaggccagcagttcaaaaccagcctggtcaccatagggagacctcatctctgcaaaataaaaattaagcaaaaaaaaaagaaaaaaaaaattagcagggcgtgatggtgcacacctatagtcccacctacttgggaaggtaaggcaggaggatcacttgagcccaggagtttaatgagccatgagccaccactgcattccaacttgggtgacgaagtgagactgtctcaaaaaaaaaagcagaaatttttactggcaacatttgcagaaggttgtgggttggatagcataaccagagcacatcagtattaaactcacatgtagccactctatgcatgtagaattcattcacagaatattcttatacttgacattcctgggtaattgaagtctgagattttttgttgttgttgttattttttgttctgtttcatttttctccattaaaaatatgattgtacccatgatagaatcaagtgatagtaaaatgactaataacagtaaaggagttttgttaaatctttatggaaacaaagctgataaaatatttcacatataaataattgaaatgaactgagcacttacatggtcctgcatatgctcctcatcccttctgagccctaacttcttttaatcttttgtgacatagatactattattaacataatttcacagataagaaaatttaagcacataagttaaaaaatattgcccggccgggcgcggtggctcacgcctgtaatcccagcactttgggaggccaaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagagagactccgtctcaaaaaaaaaaaaaaaaaaaaaaaaaatattgcccaagttcacacagctgatgagtggaagaagccagatctgaacctcggcaacctgcttcctaagtctgcgctcctaatccttaccccctgttctttaactgggttaatttttatctgttagagcatacatgtttaagaaggtagaaacaccagtgattaatttactcaaccaacatttcttaggcaatacctgtcacgttttaagtattatttgttttaattatttagtaattatattattaaaaaaccattccaataataccaccccaagtcttctagctaatttgggccacctctccagacagcctggctgtgacactcagtcagaaaaagttttctacgaaagaaatgctatactgtttcctccgtcaatatgttaatgtgctggttctcaaacacttgctgcattttcaggtcacctgggaagcctcttaaaatctcaatgtccaggcttcacaatacaccaattaaaccacaatctcttgaggtgagacccaggcatcactatttttttatagctcctccagagattcattgtacagcaaactttgagaactagtgtgtgaatatatatttttttaattagcaaactgtctgaaattgtctcaagtgcccaattaccaacatgaatagtaataagaagtataggtgttaaatctctagcattgagttcaggcaaactgtgattcagatctggattttgctactttatcgctatgcaacttttggaaaatcaccatttatgaacctaaatttttttattcatagggtgggtatgatgatcacctctctgaatctttgtaagaattaaaaagaagacaaatgtgaagccaaaatattctcctcccagttgaccacctctcctctggtgttctaacaacagcctctccagccagttgggagtatcaacactcattagaaagtggttgcttctgctggcaatctctgcactcacccccaatttggcctccagctcaaagggaagacaagctttccttcttaattcacaatagcatcacacagaagaagccattaccattcagcaagaatgtattgaagcttccaaaatgaagagtgacttacatctgttattagatgttattaggttcagagctcacgggccccattctggccctgggcttcctcaccaggccgcctttctgtataactcccccttagtctccatgcacaagggccagcttaacttgtaccactagaatggattgttcaatgcagagatgtggtgttgtccctcaaaaaatcagaacacatctgtcaaggctgctgaatgtcctatgagaagctgtgctaaattcactcaaacccttatcccggcctcttctctgacataaggtatcgatcttgcctacaagtcattcctgctgctcctgcaaacaatgctcagtgatttgtaatcacggatcattcactgcctctgtctcagtgtgatcttcatttctcttcagctacaaaaacattttgatatacttcaaaatttagagtaaatcacagagtttgctaccaccaccactgtctagatagaatagaaatggaaaggaacaggataaaaatagagaactggggaaagtgtacacatggttgatcttagccttgtttctctaactgttcatgaggctatagttagtatttatctcttccttcttccactgtccattttgtgctcccattgcacacagtgttcctatagctgactggggttaatatcgttgtgggttgacccatacctttatttctaaagaatctgagctttccgtgatcctacctgaattaggttgctcaagtgttttaataaaaagtgtaattagagtatacattccactctgctttctctcttcttccattcagtttaatagtttaattgctagacctgtcaatactaggagacaccccaaaggaccttctgatttccacgcacactcttctttgttcctttgtgtagcagaaaccttctctcccccatgataaccaggattaaacaccctaggaaacaataatccctgttattgcctacaggagccacgatatgaggagcccaaaatgaccaactgtcaatcccgccttcacttcaatgaaaccactgtggtatccctcatgcaagcattaagagacttgaattttcaaatcgaaatgaatttatgcttctcacattttgaaaaatgtcatagctaaaatatccctcaggatattctggttatctataaaatctttaagatttccttttactataattgtgttagttactatactcaaagatgagcatgtgcaatgcatttgatacaccagaaagctagcactgaggttttgaaatacatattttaaacagacagtagttttaatctcaaggcagctttgtatagtaagtcaaggatcactgtaacagtcagacctacattcttcatgctttcaaagaaaatataacttattcaacttatgatttagagttctaggtctgtccattgacaggtgaggttaatggaataatattgcagatatttttggaagaccatttctccaaatatggtttttttaattcaccttatttcttaaacatttaatgctttaacacttgagaggaacttatagttctcaaatgataagagagatgataaaaagcagacccacttgatttcagatttccttaacatttacaaatatgttagtcttgtaattacaatcctgtttttaatattatagtctcatgttattgtctaatgatatttaaattcccttgtgcttaactctgtctcatttagttttattttctattattagatcacattgtgcattaccctctcgtgtcttaaagaactcattacacttttattctttaagaaaattccgtagctctatttcaattatgttgcattctattggtaatctatacaagtaattaatgctaaaataaataatctcatattcataaaaaagtgtcatatttctgagtagttgatttgccctatgcatagtccaatcatgttgagaagaaaaaaggttgagatataaatagcttataaagcacattttcccagctcatctataaagtgtttctagtgggaaaaagattccttatgtgtgactagttgaaaaggaacaaatgtaaatgattacactcaaaataaatgtattttctactgttctgtgcctccaattttttctgaaaaagatattaaggcacattataaggatatttaaaataagcataagtttataaattaaaagctgaatggaagaagagagaaagcagagtggaatgtatactgtaattaccacctttgcccttgctacaggtaaatcctaagtttgacaatgctgtaatggcaaacataaagagaaaccagctcaattatatagttcttggtttaaaggggaaagataaaaacaaactaattgcataggagaacaagtattctttgtactaaatcagaaaggtgatctctagtgggtcctcttgaggagaatccagagagacagagtcaaggaattgagaacatcctcagctttctccgagtagatgaaacaacgagtttcaaggcactcttttattctcatcttcatgtaggcagaggaaagtaaatcaaaggcaattgcattaactaatgttaaatgggtgtcttagtccattcaaactgctataaaaatataccttagattggataattcatgaacaaaatttatttatcttggctgggaagttcaagatcaaggccccagcagattcagtgtctggagagggcccaccctgctccacagatggtgccttgttgctgtgctctcacatggaagaaggggcaaggcaattcctttcaacctcttttataaggccactaatcccatttatgaaggcaaagatctcaaaacttaatcatttcccaaaaggccccacctcttaatactgtcacattgggtattaggttttaacgtactaattttaaggggaaaccaatattcattcttttgtctttttttggatagtttgttgaaagtctttagcatgaaagtgttgttgaaatttgtcaaatgcttttctgtattattgagatgatcatgtgatttttatccttcattctgttaatgtgatgtatcacattactcgatttgtatatgttgaagcaaactcatgtctcattgataaatcccacttggtcgtggtctatgattctcttcatgtgcagtagaatttggtttgatttgctagtattttgttgaggatatttgcatctatgttcatcagaaatattggcatttaggtttcttttcttgtattgtttttgtctggcttcagtatcatggtaatgctggtttcataattgagtttagaagtgcttcctcttcttcagattttttcagtagagtatgagaaagattgccattaattcttcttttaatgtttggtagaattcaccagtgagccatctgatcctgagcttttctttcttgggaggtttatggttattgatgcaatgtccttcttcattattggcttgcttatactctctatttcttcatgattcagtgttggtagattgtatggttctaggaatttatccatgtcatctagagagcaagagtgatgatacttatataagacaaaatagtctttaagcccaaaactgccacaagagacaaagaaggacattatatattaataattatatgaggtttcatttcatcagtaagatataaaaattataaatatatagtcactcaccatcagaacacctaactatataaaataaatactgataaaactgaatggaaaaatcaacagcaataaactgatggtaagagacttaattctctacttacaataatgaatggaacattctgacagaaaatcaacaaagagagagcagccttaaacaacactgtagatttagtacacctaacatacagatacaaaatataccaccaacagtatcagaatacacattcttctcaaaggcacacagaacattatccaagatagatattctcttagttcacaaaataagtcttaacacatttaagattgaaattacaccaagcatcttttcagaccacattggaatgaaactagaaacccacaataggtgaaactccagaaaattgacaaataagtggaaattaaacaacacactcatgaacaaccaatggatcagaaaagaaatcaaaatggaaatttaaaaaataccttgatgtaaataaaaatgaaaacacaacataccaaaacttgtagaatacagcaaaagcaatactgagggaagtttatagcaataaatgcctgcatttaaaaaaatctcaaataaacaacataactttaagtatcaaggaccaagaaaaagaaaaaaactacatccaaagttagtagatagatgggaagaaaaaatattaaagcaggaataaataaaatagagaatagaaaaacaacagaaaaaaataaatggaactaaaaaaattttttaagataacaaaatcagcaaacctttagctagactaggaaaaaaaaagattcaaataaaatcgtaaatgacattggaggtactgcaactgacgccacagaaacaaaaggaatcataagagaccattatgcacaattacacaccaatttcttattaaatatctacttttggtgatctttctttgcttctgactaacaagaaaaagattcattttcaataactagttttttgaaaaaggcttcaacagcacaacttttgacactgtgaagctcctttaaaaaaaaaaaaaagaattctgttgtaatacagaactttttcatacaccttccattcacttgggggtgaggagagttgaggacatagctgtcatcaaagatgtcagatgcagccccctagataagcctgaaaagttcatcttcactcattagtattttttttttctcagaagctcaaatatctttctatatagtctggcttactttggagaactcattttcattgtgagaggcatgcaaatatctgaattccaattgtggactggattcaagtccctcacagagttgatgggccccatgaaataatatcactaaacctatgtcctgcttgtgccctgataggtaagccctgagatagtctatgatggaatactggttgatccagaatatgtaaaatcctctaagaaagaaaaaaaaatcatacataatttcacaaaacagcttgcttatctcagacgagaaccagcaaacatatctttttctaatatgtatcaaaaacaacttttctggtcataaatacttcttgttggccgggtgtggtagctcacgcctgtaatcccagcactttaaaagtctaaggcaggaggatcacttgaggccaggagttggagaacagcctggctaacatggtgaaaccctgtctttattaaaaatacaaaaattaactgggcatggtagcaggtgcctgtaatcccagctacttgagaagctgaggcacaagaattgcttgaagctggtaggtagaggttgcagtaagccaagatagtgccacttcactctaacctgggtgagatagttggagactgtgtctcaaaaaaaaaattgtcaagacattatattttctatgggttgtttattggtgtctccactatgagtgccagaacctgaattgaaattgttagttgggagtcatatgggccagatatcttattacaaaattatttaaacatttccttagttgatatagataactaaaaatacgaattcaggaattcttaattcacacccagaagactcatattcaagtccttgatggttaattacagaataattaatatattgtataaaaatcctattttctgtgcattttttgctcaaaaatggatgtatcttttcttgttaattctgtacaaaccaaaaattttgaaacgagtctcctcagtggcaatttgaagagggaggcaaggatgctaatgtttcttctctagtgatttatctaaatcatggacaaataaactcacatggaatgctttctggaatagaacttggcggctgatttgtctgcatcaagcccaggttttctcctcttctctcccaggctgttatcctagcagcacaaaggcctgaccttggagggcaagtcagcctaattcccggagtcagtgaacgaagccattatctctcactctaaggtctcttttaaactagtttttaaaagtaacaaagatgggccgggcgcggtggctcacgcttgtaatcccagcactttgggaggccgaggcgggcggatcacgaggtcaggagattgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcgccactgcactccagcctgggccacagagcgagactccatctcaaaaaaaaaaaaaaaaaaaaaagtaacaaagatgaacatctacgtcaagcttgtccaacccatgacctgtgggccacatgcagtccagaacggctttgcatgcagcctgacacaacttcgtaaactttcttaaaacattatgagatcttcttgtgatttttttttttagctcattatctactgttagtgttagtgtattttatgtgtggcccaagagaattcttcttccagtgtggcccagggaagccaaaaaattggacgctcttcatctacatcatcctacttttcagttggcacagaactcagttgaagaaagacatgctattcattgggccctggcatagttctctgggaccagtataaccgaaaaccctagactggatggcttataaataacagaaatttgtttctcatagttctggagcctgggaaatctaagaccaaggtgccagcagatttggttactggtgagggcccacctcctggttcatagacagctgtcttcttgcagtgtcttcacatgatggaaagggcaagggagctctcgcaggtctctttaatctggtcactaagcccattcatgagatttccaccctcatgacctaatcaccactgaaaggccccatctccaaatactgtcatattacgttattttggggggacacaaacatttgtctgtagcaggcctcctcaaagcccaagtttaaaaatgtattaattgcaatgcgtgaaaatgatgaggaaaaagattggacaagcaatgatgcttcagcaaacctgtggcatttaccgctctgtcttcctctcctactccaaggagtttactcggcatcaacagcagccttattctaggcctcaattactttttatccttatcccaaccccaacccctgaaataagggaacatcaaaggaaaagctagaagtcataaagggaaaaaaaagatgcagctcagtgtgagcatgttagatatggggtgcttttgagacatccaagagtgtagattcagcagcaaagctatcaaggaaagattaggattggagacctaaacgtgaagaatgtgatgaccctcagcacactgggagccgaggatatgcgagggattatgagctaggttgaggaagaatccatccacagatttaaacagaaaggggccgtggaaggaggacgtagtacgacagatgccaagatgtgaataatatagtaccaggaggaaggaggggctggtggtattttatttctctaataagtccagtcttcactagatgtgataatttggagttcattgatgatctttgtcagatgtattttagctaagtgtttgggaaagatgcccttttgcagaaggtggaagaatacatgggagctgaggcagttaaatcttggacaagctccatgttcaaggaatgggatgagaaggtacggagagagaagacatcatccagacgagcccgggcagcccagtgtggaggggtttttgagagtcctgagtatgtgcatctgctgaaggtagggaaatagagaggtggaggatgggagaaggctggtggtttgcaggaaaaggataaccagtggggctagttccagagaaaattaaaagtgatttgattccctaatacaagtggatgctgttacagtttggattgtgttcctcaaaatgcatatgttgaagtcctagcccctctacttcagactggtgctgtatttggaggtagggtctttaatgagaacacattcatctgtaagctaaggagagagttcttcagaagaaaccagacatcccaacactttgatctcagaattctagcttccagaattgtgagaaaataagttttcattgtttaagccagtggaccccaacctttatggcaccagggaggggccagttttgtggaagaaaactttttcacagaccagtggtgggggtggtgcggggatggtttcaggataattcaaatgcattacatttattgtgcactttatttctattattattatattgtaatatataacgaaataattatacaactcaccctaatgcagaatcagtgggagccctgaggttgttttccttcaactagatggtcccatctgggggtgatgggagacagtgacagatcatcaagcattagatgctcataagaagagcgcaatctagatccctctcttgagcagttcacagtagggtttgtgctcgtatgagcatctaatgccccactgatttgacaggaggtggagctcagaaaggtaatgcaagcaatgggaagcagctgtaaatacagatgaagcttcactcatttgccaactgcttaccccccagtgcgtggcctggttcctaaaaggccacagactggtataggggttggggaccctagtttaagccacccagtctatggtactttgttatggcagccctagcgaactaacacagatcaataatagaacaagaataggaaaaccttattgttcggaagcaggagaaaaagaagcaagccaggctattttattagaacattattcgtgtattaatgtttttatctttttgtgtgaccagacatgctaggtgaagtgacaaatgaaccctgcacagatctttgaatagaaacatctcataggaagacagcaatatatacccaaacctacaaaatatagaacagctatctctttgaataatccaggagtctaactcaaaagttttcaaagggaaatatgttgtgacttaagactgtctagatgttctgaagacaagtttttttaaaaaataccccttaattgaaggcagagacactatcgaacgtatcagaggaataagccagaatgagcagtatcttcttagtatttaaatcccttggccttaaaaggcttccactgagtgcaagaaattcaacataattggggagaaaggtgaaaccatcattattgttgaattgaagacaaaaaaagcacatcccttctttatccttgacaaattatgaagccctactttaagcaatttaggataatatggcaaaattatgtggcagttctctatggtttctaataacatgttttcatggcctatttctccgaagccatgccccaggcattgtagttagcctcagacaccgttttctcactcaaatggttgcaactcctggttttctcattgtgtctctgcctgacataagttgccctgcaggcaaccttcctgatcctccttgaatgtgcttttcccccgtattgtcaaattttctatgtacagtaatcctgttctacaaaatattggccatatctttcaattggcaggcacccatatctccccagactgaaatgatgattgtgacaattattgactattacctcctagcaagtcatcagatcacctaatgctgttctctgcacactcatctcactgctacagtctgtgctctctgtacaatctatgatgcggactgcagtcacagttctgtccacagcatagcctccctgaaatctattccccatactgccttccaagtgtcatttctggaagataatgatgataataactagcatactacacagaagaatctgagctgagaacctcacatggattattatgtttaatcaactctgaaacgtaatgagaaaagagctattactaatcctatttttaaaaataaggaattaggattcagagtcattacataacttactcagagacacacaacaagtaggttaatatatcagacactcaagtctgacctcacacctgcaggctgaacctctgctatacactctcccacttacccctgaaaattgtcatcagttttttacataaataattctgataaaacctttcacatgtgactctaaaagtcttctcagtctcttcatttatgttgcctctgtgtaatctaagttccaaccgtctcaaaccaatttctgtgttccaaatgacctattactttctgtgcctctgtttacttgtacatgttgttatttcatttttccgaatgttccatctgaaaaacatatatgtgttattttagatgctaccatactttactaataggaatgatttaattatattatcaacaaccttgataaagtcaaggttatgttgtacctgttgctttttccctgattatcaagtcctggatttctcaaatttaatcttatttaaatggatttcatgctaaccctggttaaaaagcatgaaaacatgctccaaaacataagtccctttgaccttagtaaatatctagaattattgaagtgggtacatgttttcttcttaccccataatatcactaaatagaacagagtgcaattactattataattactgtaagtgtttacccggctacatgatttgtcaaatttgattcccctttaaaaatggcatcttttacatccaattcaccaagcatcaataaaatataaaaacaattataaattgaatttccatgcaaatgtggccttttccctactctgcatgaatgcacaccatcaaactattatgcttcattgttgacaatgtactggtgaaataaccatgaaatagccatgttctaattgttttgctagttgccaaggtcaagattcatttttccccaagaaattttataaaggtcattacagcttaatgaaagtttgcatcccctattcatcaaaaaactgtagactaattctcataaacattcaattaggcgtttaaaaaatagaatcatatttctatcaactacagacagaaatttctctgaatttctcactcccaaggatttgaagcaatggtggcttttcagagaattgttccagtaatctattataataaaaaaaataagtggtatggtaatgtaaaagaaacattagctaatcttcctattatacttagtcttgatctattcttctccagggtattggcctgaaaagggtttctcagataaagaggtgcatgaagcccttacagagagctcagggcagatactctgaagtggttaacccacagttttcaagcatgaccagggctatatctatacatataatattttcaagaatgtaaaatcttttattcagatgttttactatgattcagcactgtcaaacaaactcaatttcaggacttttgccagtaacacgttttgagggtaaacaaatatgattggtttagatgctattaacattccaattaacatttctcaacttgtttaagtgaccagagtaatacattgccccttgttcactgaaatgtaggtttctcatacttctccactattaacaccacttcttatagtcactgtgcagaattttacaaccctaaccgcaactggctcttgggaaaaacaaaaaaaaaggaaactttccttcttcaagtattgtaattgtttcctgtttcgatttgacttagatttcctgttctggtgatctcagattgtaactattgcttaagaataggtttgtaaccatctgataacctgtgaagtgattgcagaagaaaaacacaaaagcaactaatgcatcagtcttgtagtgtttaaattaattttaaatgtattttgtaaatgtagtcctagcttcaaagtctgaaaaatggattagtagggaatctgtgattggaaattgtcacaggagaggttttgcagtagtatgattatttgactgtaaatctctctcccttaccccacataaataaattgtttattattaaatatttaaaataattattttatttataaaataaaaattttatttttaaaaccaaagccagagtcagagattagataactggcactttctatttattagaaaatttaccacagacaaaaaaagatcctctaataagcaaacagaatatatgaaaataagattggggagaattatgagtatgaaggagaaaaacagctaacaaacaaccagcaacaactaataacaataaatgttaaggccttttaacacaagaaaaaaattgcttcaagtacataatttagatataaattatctaaccacaacaatgaaacacagatataaattatagctgaataccagggataatagggtctaaatatatataattcctttgaattttatctaaaatatataaactatgatatttctggttttactactttgcatttacattttccaacaaataagatatatttttagagaggtgctcacacatgcaagcgtgcatgcatgcatgtgtatacacacgcacacatacacacacacacacacacacacacacgattagaaagtctcctgtgctctccaattagcggtacccataagaggacaggatatttggaaaaaggctccatcacgactgtgtgtacccaaaggtcacttacagcaaatgcagactcaaatgcagggaggaaaaagttatcaggggattcctagccttgccgatacaactctgccttcatgacatgcgtattacatgcattgtgtatacaattcttaactccagaaacagctttgaagttgtaactaaattcagcataatctctactccttttattttccagtctttatttttagggaattttccttactgcaaacattgttatgataatacctagtttttattgttccatcatatgttaagaatttcataatcatgatgaaagtccattgctaactaggaaacatgataagtgcacacatttcatgtagataattcacatacaccagcaacaatcctttatggttattcaatacagccctatttatatagaagggaacccaggtcagaaaagtttgagaaaactgtccttggtcatttgtctagcaagagatagagatattatttaaaaacagatctgatttcaaattctcgctgcctctgctgctgtgagaaggtcttaacctctatgaaatctggatctgtttaaaagtcatatataaaagcttcagcttattattctactttctaatattttgtctgtagcactgacactgttttcaaattttgacttgttatttaaatttgatagttttctgaaatggatttccagctgtgtgtttctctattacagttttttaagtgttagtgtgtcttgccagcttacctcttaaagaggatttggtgtagaaattgcttctgaaatcagtgactcagcacttcagatttttgttgatttacagttttgggatttgctatatgtgtgatgttggttaattatttaattggttttagttataaaatggtgttttaaggcaatgcagtgttgttgactggagctttcacaaaagttactggcatttgtggtctgtactttcagcccttaattctattttattgatcatttcatcagggaaggggttttcttttcttttcatccatctctgcttttctaagtacttcttttatttaaagctgcctctaattatttctaaaaatggtaggtccctaaatttttaactatgttaaaggtggtatcagttggattatctggacactgcccattctaatggccatgaggcacgctcattacagaatgaagtgctctgagcaagatgggaccaggaaccgggggagactgtgctgggtattcatctacacagggacaatccgcttctggttaccttacagtcctctgcacattttatatgtgctatgatatccttcatcataaaaaatccttaaatataaatgacaaaagaatgactcaaaaggcttctgtaatgtacccagccatacatttcataaatgatggaaagagcttgggtctaagggttgtttgaacatggatggtaatgaatagtacagtggaaagaacttgcagtcaggaaagcccatgtggaatcctgtcttttgccatttgttaagctccatgattacaaatcaattacctaacttctgagttgtagccttcttatctgtaaaaggtgattaattatcctgctttgcagaactgttgaggggattgaaataatatagtatatacataaagcactgtgtagagcacctgatacatttgtggtgtatcaggaacttagtaaattagttccactataactactatcactaagaaaaagcctaataaggaaactattgtctcaatagattctgaggacaagttcagggtgaccaacaacacaacaaccataataaaatgtttctatgtagagactgacagtggttggttgtcaatacgggttgtgcaggtcagaaattctctgccatggggatacttatgtgagtgaggcttaggatttgagagcgtaccttgagcaacccagggaatattctgtgtcacaatctgtcagacactggagttcatcctgccaaacggtctccacctctagtcagtggctggaaagaaggacagaaccagagagcccatgaccatagggagccttccttccctggtctccactagagcccattcatactgctgggcagtcgggataaatgcattctcctgggtgaccttaaataattgtttaatgaatattttaatatccctgcccaagcaaatatagcactactgacacagtaaaaataatgttgagtgggtgactttcaccatgagaaagttttttcaaaaggtttctgagaatacattaatgagtcagaaagcctagtgacaaagattcaaaatccaaattatatgaaattacttatcagtttgttcccttcgaatttttatccctctgtgtccagagtaccaacctgttttatacaaatttatttatatttccagaaaattggtcgacataacatcactgtataatatatgaatgctttctctaaactaagaacgccccacaggtcccttgcctttgaatagttcagtattgtaatagctaatgccttcctctcattttccactgtataccacctcagagcactgtgtttgggtctgttaacttggttctcttgtggcagtttctcccggtggctgtttacacaggcccccaaggatcctgcattagatggcacctgttgctttctgtgtgactcaagcagaggtaagcactgctgctttctctgctggtctcaattcacaagaccccatgagaagcacaggcactcagcaactttgttgtcattcatgatttcacccagatggccagcgatatatgacagtcagaaaatgtcacagtcaagatcaatatatacaaactgctccccacaactccccaaaatagtgataatcaccatcatcacaatatggatacgtgagctgagcctatcacaggcaatacactgttttctttgagtctggggaaatgagaaagtagactggggataatgatgacaatcaccaggccttgtgattttatggagctttatacttccaaagtaccctcacatgtaatatcccttggaacacatctttccagaagagactcatattgaaactgagataggcagtactcatgtaaaaaatttcctgcccttattcaatatcatatgtggtaaaaattgttatctgatgccatagaatggcttatttttatctttcattaaaaaaaatttctcacaaaagccaaggatgactttaaatatttccatgttgttgcaaaattatcagctctttcaataattgagtcttttcaccacactgtatttcaaatctgccacactgatttagacatgcagtctttctatgaaataatgtgagagcacacgttcttcagcttaggctttttgtcttcaaagtcagcttatgacatggttaaatgctgatatgtttatttactttgatctttgttaattactggtaattgatatgattagcaaagacacaaaactgaaaaaaatatgtttccaaagaagaggaatgtctccagaaattgtcttaaattcatcccctcagcacttttgcaatagcagtggcctcttgggtgttgtttatatgagaaatatttccacgtgatttattaatttattatgaacaagagctgatttattgaacaatttgatagttcattttcctctgacactccgtggtttcacaaaatccctcaagaatcaaatttttagctagatgtgttaaatctcattgtaaaccagtcttcttacattctcacttagccagtatatatatttcaggagaccgtgtgtttttatctctatggatgtggttattagattagtgacaaagaaattcaaatctgcataagcgtattttcttagcaaaagcaaatgacgtgagtgaggttttgcaacatggtgagtaaagttacctcctggaagaagagagaatggttcacagacccacattaatattcatcagggaggctgctgctgagttgatttacatccaactttagataatcagctgacttgagtggtgacaatctgattttgtgaaaactaacaactggcatcttcccagagacattgattaggaaatataagttttcttcagttcagaatattttaacatcatcaaattacgtactatgcagcgaagacagaattctatgtttgtccactgttgtcaaaaatttttgctgatatttcccatttacaggaaactaacacatttcaagtgcttactttgcactaggtaattttacatgatatagctttggtatataatcaaaattttttcaacgcaacaagtatttttgccctgcatttctagtgatgtgaccaactgacatttcagaaaaatttatgttggtatagaatacctaaaatactggaaaactatatataagtctttatctgtgtatcatggcagatagtaaagtaagccttccacatagtaagactcattctggaggcagagcttgtctcaagggcatttaccaattttggtggtctcggctagactctagaagactagagagcaatgttcctcgaaggaataacaacactccttagctattaaacaagcaaaaatgactccacatgatttcaaacgattccaaacatggaaatagtacccttaactgggaataattgacttagaacctggtttgtaaatagtcctagaaaggccagaagcaattttctaaagctagaaatagcaaggttcaaagtttgagagatttctatacaatttcaggactttcaactggcaacaactttagagtttaaatgaggaaggaaggaaggagggaaggaaggagggaaggaaggagggaaggaaggagggaaggaaggaaagaaagaagggagggagggagggaagctactagtcacataaaagcatattttaaaatctttacttcagctgtgggaggagtagagaaaatgaacagtctcctctgagaatttctaactcaaattcgtagacatatatgacctgaaaaatcctgtcaaaaatttaagattaaaatggcctcaagatgataggacacccaaaaacctagcagaattacttggaataattatatattaaatgaatgctatttaaacagatgcctcaaataaatctgacaaatatttctaagaaagttaatctcacagtataaaattactcaacctgctcagaaaacaagccaacatgaggaaaatcaatgaaaacagcaaagtacaaatcagccccacaaagactataagcattagaatgatcagattcagcacatgaagcaaatatataatatgtttgaagaaatatacttgggaattgaaagccctataaagtaatagtaaattatcaagattgactaaatatatgtcaaaaagaagcaaaacaacttgtatttaaaaaatcaacaaattgaaaattaaaaacccaagtaaaaagtaaatatcagattggacataactcaatacaaccaaagaagttccccagaatgcaagccagagagtaaaacacagaaaaatttatattcttttcttttctgttgctgatgtcaagtgtgcatctggtttttagttctgtaagtgtgcacaccatcttctctatcgttaggaattttcatggaagaggacataatctcatgtttccccttctttgtagccccccagaataattcagcacctactagccttttgattttaagacttttatgacttatcactggggagaaacagaaaaaaatacattatttaactgtaggatttttgttttgttttgttttaatttttttgtttgtttgtttgtttttgagacggagtttcgctctttttgcccagactggagtgcaatggcactatctcggctcaccgcaacctccatctccagggttcaagcctcccgagtagctgggattaaggcatgtgccaccacacccggctaatttttgtatttttagtaaagatggagtttctccctgttggtcaggctggtctcaagctcctgacctcaggtgatccacccacctcagcctcccaaagtgctgggattacaggcgtgagccactgtgcccggctggctgttttctaaaatttatatacaacatcgtttctaaagaaggacttgataaaattagcaaagacacaaaacataacaagataacagaaatggacattggattctcatcataaagccagggtaaagtaaagataaacatatatgccataaagcaaatgtagtacaactatgcaaaatcatctttttcattctcacattggccttcccatccagagtgtgcatgcatactaagtccattctgccttgatggagtcattttggcaccttcctgtgaacctgaatccttggtagtagcttcacttatagactctcctcttcacctgtatgaagttatctgacctgtgttttctctgaagcccagtcttcgagttcatcatggcagcctgcccttgttactccccatgtagacagcccccaggactccacaaaaggcctttctcaatccatcagctcttctcttctacatttacccaatccccctattctattctttccctctgtcccaatatgcttctcttttcagatttgtatatctccttcctggacccaaccacatgtcacccaagtctttcctgttctttttatagaccctccagtgattttccatcctcagcgtggtatcacacctttctccacgcattacctctctgtcctctgagcctcatccttcctgcctgctctctgattggcttgagagatgatctaggaaaattgttcccaacaggtagacataagctttggaatcccacctctcctgtagcctgaagaaataaaggaactgttgcttgccctctgaaggaggtaaaagtctttgatcttcagaccaggtcaggatagatctggaactgggaagacttgcctttttttcttggcttctttgtgacttccctccctgtgatcatatcagcgttttgttcttggatgtctgtactcacatagcactgctgagctacatccataggttgagggagtctgatggtttggtaacatttttcttagaactggctgtcagctagagcatgagctcttgatttagaaaatttgacccagaagtgcacaaaaaggcctgtgtgtggcccttgatgggccttgtgatgacaacacaaggtaagcatcaggggcttgaccgtgggggagcagataccacagtggttaaggacatggaccctgaagcctgaatactggctttcgaatcgtagctatgctcacttaataactatgtggccttgggcaggttatttaaactttctgagccttagtttctccatctgtaaaatggagttaacaataatagtatggctatcccttggtatcttggtatccgaggattggttctaggatccccacagataccataatctgtgaatttcaagtccctcacaggccacccttggtatccatgggttccacatggatggattcaaccaacgatgtcaaatttactgatggggaacctgaagatattaaagctgactgtaattactccatgacccttttataaagattaaaagagttaatatgtataatgcactaaaaacattgcctgcttcatggtaagcattatgtaaagatttactactagtttgtgttgttgttacagatggtgaagataaaaaggcatcactaaattttgcaaaacactctcagagaattccagtactcattgggaaatcacacacacacagacacacacacacacacacacacacacacacactcaacgttctccattcaaattcctttgtttttactttctgactctataattaaggttatgtttatgattgaataccctttcacttttattctgaacatgcattaaaaagtctgcatccttcaaatatctatgtttgatagattatgtctatccctttctctaagaaatcttgtcatcccagtaattagaccttcacttgaaattgagaaagtacagggactacatcaatgccatagagaagttatttattttttaacatcttcttcactgggaaaaacatatcactgggcctgtaatctgtaaaattaattctcctataaggacttcctaacaaaacctccctgcccccaattcacacatacacacacacacaaacacactcacacacattcacacttcctgtaaagaaaacatgtgagaaaatactcactaggtttcagggtacaagaagtacccaagttaaagtggaaccaaaattaaagaaccccaatgtatcttataatatttctacctcttataataaacatgctgattcttagtaatactgtatatttccctttgttaacagaggtatttattttttaataaacattgagcagtttttgtgtaccaggctttgtgctagaaacagatgattcaaaaattaagaaagtatctgacataattttcaggtctctatgaggcagctaatattattccattttaaattttaatatctaaagttacagagctagcaaatttggaagcgtaaatttgaaatcataactctttccaaagtttgtgttttaaccactgctaactcctgtactgaacagtgtaagttctaaaaatatcggatgcggctgggcgaggtggctcacgcctataatcccagcactttgggaggtcgaggcgggtggatcacgatgtcaggagttcgagaccagcctgaccaacatggtgaaaccccatctctactaaaaatacaaaaattatccgggggtggcacacgcctgtaatcccagctactcaggaggctgaggcaggagaaacacttgaacccaggaggtggaggttgcagccgagatcacaccaccgcactccagcctgggccgacagagcgagactctgtctcaaaaaaaaaaaaaaaaaaaaaaaaaaatcagatgctgggcagtagaacgcaatgtaaactgtataggattcaaaatcttctggttcaaaattcattcactcaaccattcatgtattaatttaaagaacattttttgaagatctaatttgtgtaaggcactatggtataagacaaaacaaggcaacaatgatataaaatatagacaaagccaatgaagaacagggacaaataagtaattgcaaaaaaaaaaatggagagtgcaataaaatgtgaaggctctatggaagcacaaccaagacatttcagcttgtttaggggattagaaaagacttcccaaaggaagcagaatgatgtttgagggctagccaagtaaagaggtggaaaagtgtattcctaaggaagtggtaaggtctgagcaaaattacatgtgagagaaagaaggtttaagaaacaaatttatttgaccaaagcatagagatttatttaaaaacaaaacaaaaaatagagatatagctagagagctggcaggggtcagatctcagagagctaataaagtcaggtgacattgattggaatgggcaatgagagacactaaggactcaaggacaagagaatagagactacatttgaagagaaggggatagatagatttaagaaataccaagaaattaaacgttgtgattaaatggacatgcttcttattaggaagacttccaagtttcaggttttaaatagtaggtggttgtggagctatttttattaaaataaggaacatcatagtgaaactgatttgggaggaggaagaatgaattcagttttgaactaattaagattgaggacatccaagtacagtctgtagctggatatatgtggtggtagtgagagggtatatttcggctgtgaatagaggtttgggaattcttctcattgagatttgaatcacgtcataaaagtgaacaacattgtccaggtagagtatgtggagtgaaatgaaagggctgtagagtgaactctgaggaacaccaacatgtaatggttagataagaagaaagatgctactaaatgcctgagcagtactgaattaaaaaggaggcagttatgcaagagaatgtgatgacataaaatgcactgtttctagtactgccaagaagtcagcaagataagtacttaaaagcatctgctgaattgaccaatacggaaatatttcatgaactagaaaaaaaaaacagtctaatgaagtctggtggagaggggatgtgttaaatcttggggtttttaaaaataaatgtattatctgttttatatcctttgggaacttaaagtcttcattgtctctcctactagacttttttttttaaattttactttaagtttcaggatacacgtgcagaacatgcaggtttgttacataggtatacatgtgccatggtggtttgctgcacctatcaacctgtcatctaggttttatgccccgcatgcattaggcatttgtcctaacactctccatccccttgccctccacctcctgacacgccccagtgtgtgatgttcccctccctgtgtccatgtgttctcattgttcaaccccctcttatgagtgagaacatgtggtgtttggttttctgttcctgtattagtttgctgagaatgatggtttccagcttcattcatgtccctgcagaggacataatcccactcttttttatggctgggtagtattccatggtgtatacgtgccacattttctttatccagtctatcattgatgggcatttgagttggttccaagtctttgctattgtaaatagtgctgcaataagcatacatgtgcatgtgtctttatactagaatgattgataatcctttgggtaaaaggtctaatatccagaatctacaaggaacttaaacaaatttacaagaaaaaaacaaagaaccccatcaaaaaatgggcaaaagatatgaacagacacttttccaaagaagacatttatgtgaccaacaaacatatgaaaaaaaagctcatcattacagagcattagagaaatccaaatcaaaacgacaatgagacaccatctcactccagtcagaatggtgattatgaaaaagtcaggaaaaatagatgctggtgaggctatggagaaacactaacacttttacactgttggtaggagtctaaattagttcgaccattgtgaaagacagtgccgtgattccttaaggatctagaaccagaaatactatttgacccagcaatttccaactagactttaaactccttgagaaaatgtgtcttcttattctttatatcccttgccacatattaaaggaattaataaataagtgctaattttcttacctataaaggaaagagaataccttctccttttatatgtcacaggatatttttcaggatcacagtttacatgaaacagttgtaagctgtaaaacctacagaagggatgattgttgctattaattctggattgcaacaattcaagactaaaatagaaaaggtgtccaagacagtttatgatttattgccaatgaaatacttaccaacagtagttgctctgggaattcagaaaaaaaaaaaaaaaaggacatttcaagatgaaagcattacggcatttctcagaattgctaagaaaatatcccgggcggtggggagtgagacatgaacaaaatgtaggctgtggaggactatatctggatgcagggaatggtgaataaaccagtgagattagcacaagaccatcttcaaactttctaattcattctaaattcttggcttagacaagaagaatgcattattaagttttaatgattgttttgaaagagcatttatagtatttgctgttctgcagaatgttttatgatttatgattctaataacagacagtacttgaacgtgaaagctaatttgtcctcctattgtgtaagtaggcttccactttggggagtagagcaagtgttggcctaaaaacgtctcctgattccttgtgccaaacttgaccttctaatttggaaaacagacttcacagcaacttgtgtaaaaattaatgaagtcttttaacagtgtaaggtacagcaaagaaatgtattgattttgatacgctacaaggttattgcttacaagcataaaattattgtaatatccagaagtttagaggttaaggaaatgaatgtgaagaatgcctatgtgtgtgcacatgtgaaaatattggggttctaagaaaattgtgtagaaaaaatgtacgatcccctgttcacctgttctggttagaaagaacactaacagatatgaaggaaaccatagacttctagaccttgtgctgatatgtacagaaaatacatagaaaatgaagtctaaaagacccttgctttggcatgtctacaaagaatagcaaaatggacttgattgctattactgaaagccacattattccccacccattagataatctccctatctccagtttcattttgtcctatccttgctttgcagtgttgctggagggatctttgttcaacatgaacccgatcatgtcaccccttgtcgtatcacatattgtgatggcttgtcttccctttagaataaaatcagaactccttggatttgtaagcagggctttccacagtgtgtctcccaccaacctttccaatgtaatctctcatcaccattcaatatgcaccgtacactcaaacataaaagcattgtttgcatttcctcagtagcctatgattcccctctataccttccacgcctgcttttctgcagctcacagattcttatacatccttccaggatcggctctagcaatgcctcctcccagaagctttttgtgaaccatcaccaccctcaccactagactagtgtgtgtgtctgggtgatgcaagtgcatgtgcagaagtgtgtgtgtctgtgtgtgtgtgcatgtacacacatattcacacatgagctgtgctttactcccaaacaccccaagcccaaggctggccatggcatttatctttgaaaattataattatccaattttctattttcctgcagatcataaactacttgaggctttttcatttcattttgcccatagtaggccctcgaaaaatattcactgactacttaagtgagtaacagaccaactaaggaactgaagatatggttgatattagtagactagcaaattaagcaacgtagcataatgagaatgcttatgggaaaaagaagaaggttttaaagcttcccagcacactatagatccaaatgtaaaacatttgtccacttccccctgaaaaaggaagtttatgtgtattgtagtttttaccatgggtcttaaattatagcacacttttacaattattttatttttaaaaacaaaatatcatgtggcagaagacacattaaaaaagatctcccagacaaggcgtagtggctcatgcctgcaatcccagcactttgagaggccgaagcgagcagatcacttgaggccaggatttcgagaccagcttggccaacatgatgaaaccctgtctcagcaaaaaatacaaaacttagctgagcgtggtggcgtgtacctgttgccccagctacttgggagtctaaggtgcaggaatcacctgagcccggggaccctgtctcaaaaaaaaaaaaaagaaaaaaaaatcctcccaatcgtggatagtgatagatgcctaaaagtggctatttaatactcactcaaaactaagaacatcttggttttggacatctttgtaaatgatcttctcagaggtcactttagaaagcaacatggtaagtggttctaaccacagataaatgctacagaatacagtttaaaagactgaagtccaaatatatgggcatacagtttccagttatgcaatcacatatcgatatgacgtgagcatgctgtatctcaagcaactgaaacagatccgcagctctggaaaaccactggatcactctagaaatagctctaaccataatgaaggcaatggtgcagaaggtttatgtggagaaaaatggcttaaaaatgttcattgggatttagatggggaaaataattatttctaagcaaataaaatattttatgtgctcaaattaattaactacattagtcgattaaatattatatctagacatttggctattgtatctaatttgtaaaagttaaacattttatatggccaattttaagaaaaatatgtatggaacatcagttccataatgggaaaataggagaaacaccttgtgtttgctttgtatttagggatataatgtataataataaagccctactaacctgagaagaaaatgacacatttcttaatcatcaagactagacaagccagcactatttgagtgattaatcccagaaattaagtataacttagaaaaacatgttttcacttacatgtatatatgaattttaccaacacttaaaaactgaaaaacttggagcttctagtttaaaatttctttttgaacttgagaatcttttattgatttatagtcatttcctaggtaaagaagtattggatctcagtttgattcctattacctcttggataccttaccacacctgtaagaagaaggcaagcattaagactaacatgatgaggctctgagaagttaagtaactgagctagccaccaattgatctaatgtcatagtccgtgcttttacctcccgaaaggaacaatggtggatctcactggaaatgtaactgtttattcttgagtctaaattctgcagccttaaaaattaaacacatgccacttttgattcttattgtgtgcaacacagaatattttcctacatctcccagctatttttctaaatatttttcagtcactttaaatgaatggcatagtacaacattatgtgtcctgttctgttttattaactctgaatgactgtgtgttagtgcatgcagtctctctctctctctgtctctctctctgtagttgtactgtcttttttggaaaatttactacttctgagaatgagcataatggaccaattttttactctttgtaactctagatgaaatgtctacagttaatagagcaatcaaatctgccctgctagggaaaatagcattagaggaaggggactcagaggcccatggtacttgtctttactattacttgttaatgcatctttgtacaaaacagatattttattcaaaacctgcctcaactcctgctgcttattctccttcacctcaagtcactctcctctgttttccaaaatatcagttgctttatggggaaaatattataatccagttgtccatgtgttgctttgtaataaggagatagagcattaatattgactgactttcaatctaaaccttttggacaaacttttgttggaatgcaacagggagcaacattagtaggcggggtgttgatggacatgcaaactgggggaacctcaggaaagtgaatcccacttttatttgttctgtcttattacaatttacttgtctgtgatatattcattaggcaattgaaaaaaaaatgccatctcagatatacccaaaccacacctttggaaatcaactgcagttaccacttcatagtttgggatcagtatccagccttccagcagttccttttgtaatctttgtccataaataaacctccccctcaatttaacaaagacaaagctttagatgaactcgcttcagaatgaacatagtataattcacttttcaatttcacacccaaggattctgtaatgggggaatgtaggcggttaagttttcagtcataccaaatgggtttttaatacttaaaatccatctgtttacatacaaagagtaaatgcctggaaatgtggcttctgaaatgcaaatgaagagctacaagacttatttctgcttgggaaaattcaacacttttctgacaaaagggagtaataatagctcctgtaaaatccaataatattataaatgatattagatccaatagtgcatgatatgtgtatggggaaatctatggtctcttgtttgttattactgcgtcgtgaaatgcttcataaatttgaggaaaggaaggatattcaaattagcaaagtactttgcaaatagtcagctataccaattttaggatgccttggcttataggaacaactaacagatttaggaaactaaacaggattttaaaaaagatagtttccattgtaactcatggagcaccaaggtgtaggtaaaattttgctgtaatagctttttgccacaatttagcctcattctgtttttgtttttgttttaactttgagaaattaaagtttacttttaggcaattaattcttctcagttcatgacttcataaaggatcacttacaatgacagaccattctataaattattattaatgtacagagattaaaaattgttaggcctgtaaataaaatgttaagatggatatttcatacaatccgccttcattaaaattactagcattgaaactcaaccagatatgttcccattagtaagtttcttttgaaacgcataattagtatttcacagattttaatttaaagtattgttctacctatttaatagagcaagaccataaaaacctaaccatctttgtttaaataattctcttttagtttctgaaaaatgaatgtgttatttatggtaatattattttactgctatttttaaaattccaaaatggataatggttaaacttttaaaagtttatttctcattcatgaaagtcctaaacaggctttcctgattggtagaaaactcactttcccctggcaaatgtttggcttatgggaactgatgccgcttctgtcttgtgactccatcatcttcatcatctctcatttcgtaaaatctttgccacagaaattaaacaaagcgagttcagtcttattttgccaacaaaataagaaaagtcgtcaaaattgagaagtagttatatgggttcatgtaggtattggtgcaaaatggctggaaaatgtagttttgaccttggctatcaattcctagaaaaaccctacactgcacaaggaggagcaaaactctttggaggccaattagcatagaccactaagagtactgattctccaagtatggtctccatctgcattaaaagcagctgatgagcttgcctactgtcttactccattttgtgttgctttaaagaaatatctaaggctgggtaatttgttttaaaaagaggtttatttagctcacagttctgcggtctgaacaagaagcatggtgccagcatctgctcagcttctagtgaggacttttgtgtggcatcaaaacatggcagagaaggtcaaaggggaagtgggcaaaggaaaagagggaaaacctgaggctttataacaactcgctttcaagggaactaatgtattcccacaagaactaatccagtctcctgagagggagaagccttttactacctgagaaatagcaccaagaaattcttgaggagtttgccaccatgacccaaacatctcccactctcccactaggtcctacctcccaccatccccacactggggatcaaatttcaacatgagatttggtggggataaacaggccatatcaaaaccacaacacctactttcatattctggagccccacatctgatccactaaacctgaatgttagagggaagctccaaggattctgaattttaacaaactcctttgttatttttagcactaaagtttgagagccattttagaagaaataacacattagaatactcaaatctatatctgtctgtctgtctgtctatctatctatctatctatctatctatctatctatctatctatcgagagagactatgagaggatcctgggatcttctcatgccagttttcacctcttccttagctgatacaaaacttcccaaggagctttgtttgctattgagtttgacattttgatatttctttatgattaatgcaaaatgagtatgtatggctaatttcctatgcatttcctcccatataataaatgaatgacaaatggctccagaagcacaattcatttttatggctagcttttttttatcctaggatttgaaatatgagcaccttgagtctaattcaattctaattaaaataatactcattaagtgcttcccccgggttgtgtgacaaatggtactaaattggaaaaaagacaacccaccacccacaggctgtttatattctaaaaaacagagtaatataaaatgcttctccttttcctttcctctgatctttataatggcctgctggatatctccattatctcaacttggatcatttatagacttctcaaacataacttacaatagaactttatgcttttatttctccataatcttgtttgttaccttgtattattttccaaatttgtcagctccatcatgaacacagcctgttctctcatattaaatgctgaatttccctgtactgaggaatatacacatttgttagctcttaggtcaatagtttctttaactggatatattctttgtgctcaccagctgactaatggcatagaatatacaatggacatgttaggatcatcggtaatgctgcctaaattccacctatgacaaatatggagagagaaaattatttcttcaccgaccactctattggtggccaaaattaactatcagtattacatagtatatgtaatgataatgtactgtgagactcttagtggatattaacctatgttatcaatcaaaaggcagaaacactgattactcattaagcatgacttgttttttttttttcaccacacttggaatagatgcttttttgttgtggtggtgggtttttgtttgttttttgtttgttttgttttttgagacggagtttcgctcttgttgcccaggctggagtgtaatagtgtgatctcaactcactgcaacctccgcctcccaggttccagtgattctccttcctcagtctcccaagtagctaggattataggcatgtgccaccacacccagctaattttgtatttttagtagagatagggtatctttaaaggagctgaaaaaattactattccagcttaagcaagtatcccctccattatgccaccaaacagtatattatggaacatctgattttcctccatgagataactttaagtgtttaatgttagaaataagacattttggctgggcgcggtggctcatgcctgtaatctcagcactttgggaggccgaggcgggtggatcacgaggtcaggagttcaagatcagcctggccaagatggtgaaaccccatctctactaaaaatacaaaaaattagccaggcctagtggtgggcgcctgaaatcccagctactcgggaggctgaggcagagaactgcttgaacccaggaggtggaggttgcagtgagccaagatcatgccactgcactccagcctgggtgacagagcgaaactctgtctcaaaaaaagtaaaaagaaatgagacatttcaacttctattaatacccatttctatatctttctccacatttatttgaactcttatgtgataaatgtatccattaaatctgtatcacttttatagtaatatttccataaagtatggaaaattcagctttataattcctttcctttggctcaaaactacagttttttcaatgcaaatgttaaatcatagttatatcttgttttttaaaaaacacatttactctcgacataagttccagaatattatacatttcaattttatgcctttttcacagtcctattttatttagtatatcctcttacatattaaagaataattttaatttgaaaaaggatctcaacacatacttatttttaaaagcatgtttttatattatgttttaatgttgtccaatttagtactgtccgatttttaaaaattgtatttatagtacaaatctaaacatgcctatataattatgcctcttgggaaatatccttattggatgtctcagtctgttctagctgctataacaaagtaccataggctgaatggcttataaacaacagaactgtagttctcacatttttagaggttaagaataagaggtcagggtggccccgtggttgagttctgatgagggccctcttccaggttgcagactaccatcttcttatatccttacatgagaagaagaggagtagagaactttttgggtctcttttataagtgcactaatcccattcatgagagtttcacctccatgatctaattatctcctaaaagctctacctcctaatatcatcacattggaggttaggatttcaacatatgaatttgtgggggagcacaaacatttagttcattgcaactggagtatttgtgggtttgagtaaaaaaaatattacaaggagagtgcttttaaaacatcatagaatagtgttagaaatacctattttaataccttttaagtgagaattttaagagacctgagtcattacgaactaggcttatcttcttcttctaactccaatctctggatatcctgatatcacaataatgctttatactcaggcacatgaatagaagctattgaacccatctagtgttaagagagatcacaataaaaatattttacttaaacactttccacccatatattcctctaatccagagcaatagagggaaacattctaacattgttaatgagagaaatcttacgtattgttatatttaaagtatatcttagggttaatagaataaatgaggggaaggtaacaaagtgaaattcacaaatgccttcggtgatgagtaatttcaatggcaaactattttttttccaatttcatcagagtatcaccttattctaatcagcattattatcttggatataaaagaattaatagataacatgcttctgaaaattacaaataatttatccctggaccagttaacactgaatgacaaacttgggatccaaaaaagccctgacaaattggaacaattgtccaaatcaaatgggagaacacttaagagggacaaatatatctaagtatccaactttgtaagtacagttgcagatcaaataattttaggacctatacttgaaaaataagcatataaacttatataaaacatatacatatataaaaacatataaatatataaacatataagtgttatgcagtttttgaaagaattactattacattttaaatacgacttttctttttactaatttattccttaacattttcttgaatcctggatgatgctatttaagagttatgtaaatataatagaatgtgttaaagagtgtgactggccaggtgtggtggcttatgcctgtaatcccagcactttgggaggttgagacagatgaatcacttgagctcaggagtttgagaccagcctaggcaacatggtgaaaccccatctctacataaaatacaaaaagttagctaggcgtggtggcctgtagtccctgctacttgggaggtgggagaattgcttgagcccgggaggcagaggttgccgtgtgctgtgatcataccaccacgctcctgcctgggcaacagagggagacattgtctctcaaaaaaaaaaaaagaaaaaaaaaaaagtgtgaccaagatcaagaaggggtttcacccaaaagaatgatttatttttctatcctaggagttgtttacacctgaattcaaatgtttattcagagcctgcatgaataatcattgaagactctcaggttctgtgatcctgtgtagttaacagaaaacaacactctctttacaaacactctgtttctctttaattatactaaatttcactctataaaacacttcaattttaaaattgcaatagtttaatctaaggacagtattatttcactttcttgtttgtacaatattgtatatacacatatatacatgtatattttatagacttacacactatcagttttgggaaaagcaaatgaatatatataggatatcattattcaaacttactatgtagaattttttattcacttgagtaattctagacaaggagacatttacatatttatcactgaatcaaggattttaaaatcaggcatattaacactgaaatggttcttttgtaaaaggaaaatacagtaatttgagggaaatgtataaatagcaaaattacattcttttaaccttgcatgaaaactccaaaaattaattggttacataaatcctattatttaacaatataagtgagaatattagctatccaaatattgccagatgtaattaatgtccttaaatattgccccattagcatgcattcttatgagctggagtcacaaaactaatggatttgctacccaggggacatcaattggatatgacactgcctcagttctctgcacgccctattctactgtctttattataacatgattacttttcatttgattctataaattgcattctatcaaattactatagtggagcctgtgatatgatactctcactaattaaaatctttgttttctctacacttgggttaatatagatagttatttttcttgtttcttactaaccactggagaaatacgttaggaaatacttcaggctcagcatcttttgtgtcattaaataatagttatttttgctttgccatatgtagaaaagagtctacattattttgctgtggggagaggtatgtaacaattacagtaaatgctagagtttgagttttctaagaagtgaaattctagtcaggtaggatttgataatctaaatagaccagtgactgacattccatatccttagagacttcataatgagaaaatctctacattcagccaagtttaatttgttgtcaatacattctagcatttagagaggactttgaagactcccagcatatattcagaaaatactggcaacatcaataggattatttgagtgtggggacattaaatcacacaaaaagtatatgcttattcactattgttctaagagtccttcctccacaaaatttgaaaaagccccaggcagacagagtcctagtttgaatgcttctgccttttcatttctttttttttttttaaggtaagatatttggctcagatttcaattgtgaatattagagagaattctgctgcttcagatcttctctatccatggcattttcttccactgtcaaataactggatctgtcacgacatcaccacctttggtatttaggaacctaaggcaaattccctggtcttattgcatgacaaaatgatctctggctgcacaatatataatttgatcaacaacaacttaaaaagcttctttattatacataggccatctgccttttctgtgtgcagtatctgaaaacacagcaaaatcctaaaatacatgatccaaacatattggcagtgattttttttcttggaaaatcaaataagagaacctgtcatttttctttagaagtttgaggcgagtgacctctgcatacctctcataattatttcttgcttcttaaatgccaagtggctcattcataacagcaaaatataatgaggaccttcgagataactgccattagaaacatgtcatgaaatgtatcagtacatgccaggctcttgattacaaccataaatatccagaagaccagttgcagagcccagtgccagtttgacatttccagttgtaagactaatagaaaggagcaattaacaaataaaccctctccctcccacccctcattcatgcctttgctctacaaacatttctaaatttacgtctacagttccatgatggattttaaaagttttaaatcatgcaattttggtacctatcatccaaacacataaacaaattctttttgaaacagtcagaaatgttatgatatttcttctccttgaactcacactttgattccattatccttataaaatattttgtgagacttgacatttattctattatttgcagcataaatgttacccagtaattaatgccactcactttatcaactatatcatcaatatttcaaattgttctttatttctttcttgttcagaaagaacaaactggtacagtttgtaccagaagtttcttctcttccaggaaaatgtatcatagtaagattatggaggaaacgagtctttccttcataaagtaggagaaaggtatgggaaggagaaattggaaaggagagcctgtcagctgcagtacattcctaggcagattgactgaagaaagtaagtacatatagagtttgaagttctagaaattattcctttaaaactattcatgtggtttcttaatcctgtgtacatcaaataaatgcgcatgcaggtctagaaagccagtatgctagttgcaatgaatctgtgactctgtatatgttatcagaccaagtatgtcctgctcctctataaaggcttatagattttatgtaattaatacatatttgaaaacctcattttgtcgttatgtataactgttaaaaatgtacaactatgatcatggggggcatttaaaaaggactctcatatgccaaaaataaagaaaaaaacgacttgattggtctaacttgggaaaaatattttaatgtattgctgagttaagaataaaatctgagaccctacttgccagttgttattaacaaacagccactggttctaataatctaaatattaacccaattacatgatgcccttaacgatttaaaggtatggctttatctttttgagaaaggaaaaaatttcttaccattttcattatttctcttaagtaaaatttgctataactctaccacctggcagttatatattgtgccaaggaggatcattaactctgccggtctcagaagtgctggtgtgctacgtctgagccatgacatcactaagatgtaggttggtgcaaaagtcattgcgttttttgacattaaaagtaaggggaaaaccttcaatgacttttgtaccaacgagtcatagaaaatgctacttagtcacattgcttataatggattcccccactctcatccagattgccagctgatgagagtgtataatgtgcctttaaaaaaacaacagcaaaaaagacaatctcttcttcttttactgtaagaaagaagaaattttttatgaaaatactgggtaacacaatgcaaattttgaaaatgaaacgacaaaaaagttaacaggtaaatttctaaatcctgaccttgttccagtgtcatagtagaggttttaaataatttgaccagtgtaggattcggacactctttttttcattataaaatggtgtataatggggaatagcaaatagttgtaatttttaacgttgaattacatcagctctgtagccatcagagaataactagcaccatatttgccttcctgccattggaaaccaaaacctagaaaacttaaaaaaaaatctttaacaaaagatttcaacaactgaaaactaagcagcatagagctgtgactcctgagaaaaagaaaaatggagtaaggcctatcatccttctctctgcctagagacatatttaaaaccacagtgcaggaacagcaagactcaaacacagcagagaagacttgctgaattgaaaagagataaactcgagttccggaagattatggtgactggtatttgagtagtagaatactggagaggaggtaactatacagagaaaaatctccaaaatctacacagggatccctctaaggattttgcccgatactaagctgatgtgcctggagtaaaactacgtaagtctaggcagagagatactactggaggatagtaggctgaataatttccaagagtatagagacatttgagtttcctcagctggagtgaacagacctcattaaaaatttgggcagtcagtaagccctagaagtatcaaatttgagagtaaagaccattctagacctacacaaacaaaacttgaaaaccagcctggaaaggtcaagatgatcctaaagtaacctaaatactggccataacaaaagttgctactctataatagaagataacaaaaatccagaccttgaaaacatgaaatacatcatatctagtgtccaataaaaacataaaagtgtgaagaggcagaaaaatctgaaccataacccaaaaacaaaaacaaaaaaaaatcaataggaacaaaaccagaaatgattggaagatgaaattggcaaagaactttcaggcagctattaaaaatatgctgaaggacttacagaaaatatgaatataatgaggagagaaataaaatgtattttttaaaaactaagtgagaagtatagtgttgaaatattaaatatttgaaataaaaactcactagatgaacctaataccagattagacaatgcagatggaaaggtcaacttaacaacatagcaatagaaactaatctgaagttcagagaaaatgaacataagctcagttactatggtagtttgtttcctttgaaactcatgttgaaatttgatcactaatgtggtagtgttgggaggtagggcctagtggaaggtatttgggtaatggggcagatcactcatccatacattaatgccctcctgctgcagtaagtgcttgctctcacatgactggataaatcactgaaaataggttgttataaaaggcagttcggcttcctagaccctctcttgcttcctctctcacgatggatcactttgtatgtgccaactggcttttctgctttctcacagtggttttgacccagcatatgcccctctccagaagccatccagatgcagctctatgctcttgaacttcccagactgcagaattatgaatttaataaacattttttctttataaactacccagtttcaggtattcttttataacaacacaaaatgaactaatacattagagacctctgaaacaacagcaagcagtctaatacgcttatagagtcccagaaaagggggttaagatctataggaaaaatattcaaagaaatagtggctgaaatttaccaaatttaatgaaaacctgttaaagcaaaaatccaagaagcaaaaagtactacaaatatgataagcacaaagaaaattactcaaaagaacttaatagccaaattaataggaaaaatgtttttaatcactctggggctgggggacacttcttataagtggggcaagaaggatagaagacgtcatcagaaaaaaccaatactgaagacaataaaatgaaacttctaatataaagaaaagagaaaatattcataacttaggattttatatctagtgagaatatattttaaatatgaatgcaaaataaaaatattttcagacaaaagaaacaaagagtgttcatcactagcatttcactgcaagaaattttaatggaaattctttaggatgggtgaaaatgacaccatacagtaatctacatctacagaaagaagtgaagaagatagggaatcgtagctatgtggataaacataacagatgacttttttctcatttttcatctgtaaaacaaaactttaaaacaaaaatattagtacatattatggggtttattgcataatatgtataacagtactataaaggtaaaggagggaaagtgaaaatatactgttataaatgtcttaccttataggtagtgtaaaacattatttaaattaggtttaaattattttaaaccttaaaacaactgtcacaaaacaaagtggaagagtttataagtcaacagaggagataaaatggaatatgaaaatgctcagttaatccaaaagaagatagaaaaaaagaattctcatacattgaccattcgaatattaaatttttcagccacttgggggaaaagattggcagcttctttaaatatatgcttgctttgtgacataccaattaaacttacaggtatttacccaagaaatatgaaaatgtatatacacaaatgcttatacattaatgtttatcacagctttgttcataatagcctcaaactggagacaatccaatggcctatcaagatgtgagaaaaacaaattatattcatacaataggccactagtcagtaataaaaaggaacaaactgctgatacacagaacaatatgggtgaataccaaaaaaagattatgccattgtgctgagcaaaaggagttactcataatgtttcattccatttagataagattctaaatagacagaactaatatggtgtcagaaagcataccagtggttgtcaagtgtcaggaatgttgaaccaggggtcagaggcaggattgttgatggcaaagggcacagggatttttctagaatgatggaaatgtttatcatctttgtttgacagtagttatacaggctttcatttaaaatggggaacaattcatcgtatgcaaattatacttaaatagagttgattttaaaaatgttatgtgtatacataaatacacatatcctaagctttcacttgttaacaagtctaaacaaaattctttagctcttacaagttcaaatatttttgtatggcaagccagctaacagaagcagcatgtcacatgtgaggccataccgtcccacaggcaggccattttaccaaggccattggccaagtgcatttgcccaaaccagtaaatagtcattgttaaaaccaatcattttcttttgaacaacactgcagttgttaagatctctgtaatatcacaaataaataagcaataataaaaacaaatatgaaaatactaaatgggaaatttcacttcaggaacaaaaaaaatcttaatgaaaccatagattaaaaaataaataaataaaacttaatggtatctataggattttgtcttcctgtgcactagaagacaaaacctttaaaactttccttctttttcattttactgtgaatgcatcatttataacatttaactgatttctatatgtcaatgcttgattccatggcaggcaggttaatcttagtggcatgactcattattcatctctttctaattagcacacactatggtgacttagattgcctatgagaacaaaccaggaacatgaataaagttaagaggcagtcttcagatattttgcaccagctagtttttctgtgttccacagcctcagaaagcatcccaaactcactgaaaatcttgtaaatatatgccattctttacaagaataagcagatattgtagacggtcagtataagtgcgttattagtactataaatagaagcaaaactcttgccctgctgagcggtgcattagtaacatcatgctatgtcaagaaagattttcataatatgattttttatcattctttatgctgctatgtgatgaaaagtgtgtaaactggagaagagaagatcgatgggagataggatacatttctgtcaaaattccagagacagagggaaaagagcagactagctgtaagttgcttcaatatatgtacttatgagtatatattacatatctaggtgtctctgttatatgcttgtatatgacaaaatgaatttttttaaaaagatgcagaagtatcaaagaggaatattctggcttagtattaaaaaactaaatactagtgagagctgtccagagagcaaatagacttggttaggctaatggaacaaacttcataatctcaaaagactttaagcaccagtgtgatagacatttgtcaaaatgcataaagaaaaattatgttctgtataaaatggcgatctcaaagtctttgaaacttgaaaatgttttattgaatgataacaactagattttaaatttaaaggtaacaaaattaaaatatgattaaacactagctgcatataccatcacctttgaaaataagaacgattttctaaacagttcttaatatttcctaggtaacattttccttatcttctctacactctagtttaacagtttagtatcttttgtcaaatctttagcatttgtgagtccttggaagcttcagtggccatgtgaatgaatagctgtagttgttaagatatttgaaagttgaaatagcatttccaccatggacttcatacatcagtcttcactagtgatttctgagaagcaaacagattttgctctttctgaagggctcccagtgtgaccacagagcagttgctcttttatccctttgtttccaaataattctcctcaggaaactcactgacattgaaggagcacctcagacacttttgtaactgtgaaagcacagatattagcatttgaaataaaaaatagaagataccacggacgaattggagaaaattggctaaaagcattttatagacaaaatgaattacatcaaagccactgacagtaacctcaatatctgtgggttagtcttcagcagttgcctttcttgtttctatgcctggtgaacttaaacataggtctgtaaagtgtgctgctaaaatataggaaaagtatgaggatttcatccctctacgattttctattcttgtatctccctaaacccacatcaatacccaaaaatctttattaactctctgactggtgctgtgcatggtgataatcattttgggttcataacaaagaagaaaaagtcacaatcttgatgaggaatcagattaatgggggagatagacatggggagataagtgggcatatacatattttcaacagaatgaaatggtgccataataaaagataacaacaaaatgatataggaaatctgaacagtttggggagaaataatttaaacatattaagaacttctaggaggtctctagatatgaaagagaatccaggacattccaggcagaggaaacaacatgtacaaagccacagggcatgaacagggagacagggttcaggaaaaagtatgcggtttggtatggctagaatataagatataaatgatgcagattttttcaccccatagttcagataaaatctgggttcttatctcacaaccagaaaacattaggcatgtggacacattgaagagtgaggaggctggatttaatacgtgaagcaaatgaggatggatttattaagtgaaaaaaaaagctctcagcacagaaagaggggatcctgcaaataggataccatctcacagatcgaataccaggccaccatacaggagctgaagaggccaggctcctccccttgcataaggtgtgaattcctggtggctccaccccattctcccagtgtgtatgtgggcccccagtccattgtgggcagtcctagccaagaccctgtgcaggttcccttatctgccttctgcgtctatcataaagggaaatgagaattcaggcaatgagactgagaaagaccagattgtgaagagccttgtgagccataatatatgtttgaacatataatagcactataaaggatgagaaattaatacaattttaaggtaaaaatgataattttagcaattttagaggtcgggagttccagaccggcctgaccaacatggagaaaccccgtctctactaaaaatacaaaattagatgggcatggtggcgcatgcctgtaatcccagctactcaggaggctgaggcaggagaatcgcttgaacccaggaggcagaggttgtggtgagccaaaatcgcgccattgcattccagcgtgggcaacaggagcgaaactctgtctcaaaacaaaaaaaaaacaaagaaaacaaaaaaaaatagctaataagagtacagaaggtaaaatgagtgagcagaacatggatataagaaggaagtgtatatatatatatatacatatacatagtatatgtatatatatacacatatatacatatatacatatatagtatatatatactatatatatactatatatatagtatatatatactatatatatatactatatatatagtatatatatatagtgtgtatatatatagtatatatatatactactattgcagtagtgaagaatggtgaatgatggcaaggatctgaactaattggcaatcttgctgatgggagaggagtatcgagcttcagaagatattgtaattgaattgatcagtcttagaagttggaagaggaatttaccttggtcagcagcatgattacgatgctattaattcctttaggaaatgtcagtggaggggcagatttaaatagagtgccattttgtctacattgagatgaagaaactgtggttactctgctgcaggtgtctagtagtcagtgggaatgtatgggtctgtaactaaagaggaacgtcatgagtagatatttggacttgagaaatattgatgtataaatgatatttgaagtcttggaagtatttctggtcaccccccaaaaaaaataagagaaaaaagtaaacaatttgtcaaaatataaacaacccatttatggacctatactttaatccctctactctcatgagggtttggtgtacagattattttatcacccaggtaataagcacagtatctgatagatagtttttccaatcctcaccttcctccaacctccaccctcaagtagaccctggtgtctatttttccgttctttgtgttcatgtgtactcaatgtttagctcccacatataagtgaaaacatacggtatttggttttctattcctgtgttagttcacttaggatgatggcccccagctgcatccaggttgctgcaaggacatgatttcattctttttatggctgtgtagtattcctatgggcatctaggttgattccatgccttcaccattgtgaatggtggtgcattgaacatacatgtgcatgtgtctttatggtagaatgatttctattcctttgggtgtatagccaataatggggttgttgacctgaatggtggtcctaagttctttcagaaatttccaaactactttccacagtggctgaactaatttacattcccaccagcagtgtgtaaatgttccctttcctttatagcctcatcagcatctgttatttttttactttttaaaaatagccattctaactggtgtgagatggtatctcactgtggttttgatttgcatttctccaatgattagtgatgttgagcatttttttcatatgcttgttggccacatgtatgtcttcttttgaaaagtgagtgtctatgtctttccccactttataatggtgtcatttgttctttgcatgtgaatttggtgtataaatgatatttattaattttttcaaaaaatcaacttgtaagttccttctggatcctagatattagatctttgtttaataaatagtttgcaaataatttctcccattctgttctatttactcttttgatgtttcttttgctgtgcagaaactctctagtttaattaggtcccatttctcgattttcatttgtgttgcaattgcttttggcatcttcatcatgaactcttttccaaggcttatgtccagaatggtattttctaggttttcttcttggactttttatgattttaggttttacatttaggtcactatgcaccttgagttatttttttatatggtaaaagaaaagggtcaaatttcaatcttgggcctatggctagccagttatccccgtatcatttattgaatagagaattcttttcccattgattgtttttgtcaactttgtcaaagatcaggtggttgtaggtgagttgctttgttcttgggttctctattctgttccattggtctatatgtctgtttttgtaccattgccatgctgttttagttactgtagctttatagtatagtttaaagttaggtaatgtgatgcctctagtttatttctttttgattaagattgctttggctatttgggatttttctcttttttttggttttatatgaattttggaatagtttttttctaattctgtgaaaaatgtcattgtttgtttgataggaatagcactgaattggtagattgctttgggccttgaggccattttaataatactgatttagcatggaatatttttccatttgtttgtgttgtctctgatttctttcagcagtgttttgtaattcttgctgtagaaatctttcaactccctgcttagatgtattcctacatattttattttttgtagctagtatagatgagattgcattcttaatttggctctcagcttggatgttgttggtgtatagaaatgctactaatttttgtatgttaattttgtatcctgaaactctgctgaagtttcagatcaggaagtttatcagatcaaggagcttttgtgcagagactctggagtttcctaggtatgaaattaaatcatctgcaaacaaatagtttgacttgctgtcttcctattttgttgcctttttatttctttctcttgcctgattgctcgggctagaatttctagtactattattcatgttgaataggagtagtgagagtgggcatccttgtcttgttccagttctcatagggaatatttctagattttgcccattcattatgatgttaactgtaggtttgtcatagatggctcttattattctgaagcaaatttcttcaatgcctactttgttgagaattttagacatgtagtatgttgaattttatcaaaagccttttctgcatctattgagataatcatgtggttttggttttagttttgtttatgagatgaatcacatttattgatttgcatatgtagaaccgaacttgcatcccagggataaaacctacttgatcatggcgcagaagccttttgatgtgctgccagattcagtttgccagtgttttattgaggatttttgcctggatgttcatcaaggatattggcctgaagttttctctctctctctctctctctctctgtgtgtgtgtgtgtgtgtgtgtgtgtgtgtgtgtgtgtgtctgccaggttttggtatcaggatatgatgctggcctcatggaataagttaaggaggtgttcctcctcttcaaattttttggaataatttcagtaggaattataccagctcttctttgtacacctggtagaatttgtctatgaatccgtctggtcctggattttttttttggttgtagaatatttattattgattcaattttgcagcttgttattggtctgttcagggattcaatttttttcctggctcaatcttgggagggtgaatgtgtccaggaatttatcaatttattctagattttatggtttgtgtgcatagaggtattcataatattctcttatggttagttgtatttctttgaggtcagtggtaatgtccccttcgtcatttctaattgtgtttatttggatcttttctctttccttcttcattagtctatctagcagtctattctattaattttttcaaaaaaccaacttctgagttcattgattttttgtgtggtttttcatgtcttaatctccagttcagctctgattttgattatttcttgtcttctgctagctttggagttggtctgctgttgtttatctaggtcctctaggaacacctagagtgtgatgttaggttgttaaattgggatctttctacctttttgatatgggcacttagtgctataaacttttctcttaacactgcttacctgtgacctagagattctggtatgttgtatcttagttttaattagtttcaaataatttctgccttaattgcattatttacccaaaagtcattaggagcaggttacttaatttccatacaattgtataattttgagtgaccttcttggtatttgtttctatttttattgttctgtggcttgagagtgtgcttggtatgattttgattttattgaactgttgggaattgctttatggctgagcatatggtcaattttagattatgtatatgcaggtgattagactgtatattctgttgttgttgagtgaagtgttctttagatgtctgtcaggtccatttggtcaagtgttgagtttatgtcctgaatatctttgttaatattctgcattgatgatctgtctaatactgtcaatgaggtggtgaagtctcccactattattgtgtgggagtctaaggctttttataggtctctaagaacttgttttatgaatctggatgttcctgtgttgtgtgcatatatatgtaggatagttgggtattcttgttgaattaaaccctttacaattatgtaatggccttgtctttttggatcattgttcatttaaagtctgttttgtctgaaattagaatagcaatccctgcttctttctgtttttcatttgcttggtagatttttctccatccctttactttgagcctatggatgtcattccatgagctaggactattgaaaacagcatatcattgcatctcgtttttttatccatattgccactctgtgcctattaagtggggcatttagcatgtttacattcaagattaatattgatatgtgcagatttgatcttgtcattatgatgttagctggttataatgcagacttgattgcataggtgctttatagtatcagtggtctatgtacttaagtgtgttttgtggtggcaagtaatggtctttcatttccacagttagcattaccttaaggacctctcataagaaagtaatgaatactcttactatttgcttatctggaaagggatagtttttctcctttgcttaggaagcttagtttggctggatatgaaattcttggtttcagtttcttctctttaagaatgctgaatataggctctcaatctcttctggcttgtagggttctgccaaaaggtccactgttcacctgttggagttttctttgtaggtaatctgcctcttctctctagttatctttgaaattttttctttcatgttgaccttgaggaatctgatgactatgtatcctgaggctggtcatctgctacagtatctcacaggggttctctgcatttcctgaatttgaatattagcctctctagtgagtttggggaaattttcatgtaatcagtctactcttatctcatgaaggcgttttgccatcttttattccctgtgaagttttcaagggtatatatcaagaagatggagattctgattgtttacacataatgcagacaattgtagttcatattaatgcctcatgatttataaggcacaggaagttaaatgtaaagtgcatgtatttaggtcccagaccaacaggattttaaaccttgacttcttctatttatcaacagagctattttggtaaaattgcataatcccattgtctcagtctcgtcatctattttttgaaaaagtaggaggaagataaagcataaaggtataggataaatcataaaggataaggatccagaatgtatgtaaaatgcctggctaataatagtctctcatgaatgatggtgatgttatgggaagatagcaggaagaatttttaaagttgggggtggggtatccaaaatgtttaacttctttgggcttcagtttcttgaccagtaagttgaaaacaaatcaaatgtacagtgttgtcaaaatagatattatgtcaaatatgaatcggtattatgatgcagatgatctgataaagaaggacctaggaaaagatggatttatgtcacatacacaaagaatagaagaaatacaggtatagtcttggagcacattaaagccaggacactaggcaacagaataacatgaaagacatggggagatagtgtcactagttacagcagcagagcaaaagttctccagatgtttcctcacaaacctactcttgagtcacactgggcagaattaagtcacgtggtcatccttccctggaaaggaacttccagggaaatgggtgttctcattttttcagccctatgagagatgacttggaatggctgttgggtagccaatcagaagagtcttgcacaattatacaggagacatgtaatgtaaaaattctcctaaaatttatttttccttctttttttgttttccccttagttgaggatatacttatcctaaaatgttggttgttattaaggcctaaacaaatgcaaaagagaattcctgatctacttcagtgctttcaaatattgttaagcttcagcatattttgttttgcttaaatattgcaatgaagcccaacatgtaaaatgaaaaaagaacagagcctctctagaagaaggtttgggggccccagagccctggcctatttattctattaatatttggcctcctgctgtctaacattacccctctccctgcagtcactgaatgtgctccaaccctacctagaatacagtccttatgatagtccacattcattcagcttccacatgtaccaggcattgtgctagacactggaatcaacttaaaaggtagataaggcctcagcctttatagggcttatttcccaggataagagatagacatatagatgctgggggaagggaggataataagtaaaatgaaagttgaattttaaaatgtccaagacagataatttctgtaggaaaaagaactaaggagtacagataaagcataactggaaggctgctggcttggacacagtgatcacagaagggccttctaaggcagagacttggagaagaaggacctaggcctgtgaagagtaagggagagggaggtcttatcggaaagaactgcaagttcaaatactaggaagcaagggctactagatgtgtttgagagcaagtgctagggcctataaagccttgaaaaccataggcagagactgggactttattcgagatgtcatagaaagcctcagaagataattttgaagggaagcataagacatgatctaatttacatttaaagaagatcatagaaatatttaaaaaaggaaaaacctatgattaatatttcagcaaaatgtgttttttggaatttataaatattatgccacatcgttatagttgaaaaacatctttaaagtcaaaaataccatattttttgaatacttaaacattatgctgaaaatgacataatgtagccctagctataaacttcatcttggctctgtttttccttcctctgctatttactttgaatagcaacttttctctcttactgaaaaactgggatcaagcctgaaacccctttgtctctgcagcaagtgtatcagagtttattttcaactaagctggcttcttgctaaaggcattttgttctagctacaaagaaaagatttcttccaagtattaccctttgattagatttgaactaaaaatgaattatattcatttatagtcttatactggggaaacctagatggcctatctcttctaagatcactgaatccactgaatctctctcccctcccacagctgtctttctctgtctttctctcactctgtctttatctatctatctatctatcatctatctgtcattctgtctatcatctatctatctctatccctctctctcaatcgctcttgtgttctgtttatgtaatagagtgataggtagataacagaggctgtcaataaaatggcctatagaaaaaaattgtctctctatttcacagaaaaactaattattttttgatttcttgaagaaatagctgttgaggatccaaacgtgcatctgcaaagctgaactaaggccactaattcatcagagcagcttacagattcaccagtcaattctaacaatttatatttttattctttttcctatgtttagtaattgttctatataagtttaatacagaaaagggacatgaatttttttcaaattgaagtattgcagaagaaaagtgtttttcacaatgatataagtatcttgtattgggtagttttatgtgtataagcatcttcagatattagaaaggataatttgatgataacttattctgaagagattttcatcaaactactttgtaagaaatgcagaggcatttttgattgttgaatctgtagacaggtgcgtaaaatccttatcgttgtaacagcagccctgctgaccagattggctgttattcttaaaagatgagggaagcacttacagcatcgtaagcctaataaggtgggtgttgtgaatcaatttgtactgtccttgactttctgcttatattagaattctaaaagatcattagccacctctgggatatgtttgattaatgggtttggttaaacaaaaaaggtgaggtcaaccgtgagcagaaagtttaaaaaaaatgtattccagaagaaacgtgtgcttcccaaattgcaaatgagaagttcattccttaggcatgttctaatcaatgaaaccatgtgttctactaagttgacctcaaaggagacttttagccaccctgcttatttgcctttcagttacaggaacgtgacttctgaggctagggtattagcacacctgctgaaacggtgttaatctaggtaatacaaagtccccaaacacatgctgttaataaggcaggtagtttaaaaaaaaaaaaaaagactagtctaatatctcacagtgagaaaaaattcttctctgtcattagagagggtgaaacatgctcctgttcttttgacattatatacctcttattgtttttcctttttattaaaaatgaatctcttctgctgttttcagcagtgcatttttacttctgtattataatagctctcctctcaatgattccatgaagacaggctgggataatacaccaaggaaaagattttgctttacttgccaaaatgagaccatactttgttttttccttaaccattgcccccttactccctggagtttatcaccccacacaaattaagctaattttataaactgaaaatgctctttctattaagttctcctcaaagtgaaagcaatgagcttcattctgtttattacactgctcttcacaattagttttatgatgtatggcaagaatgtgtatactataaatcgagtctataactcttacatatctagtgatagttatgaatccattgagtagaactgaaaatacagtatataacaactcagtttaatttataatctaaattgcaaagctatttagccccttacattcaaattcatttttgcagaccttttaattagatacagtgatctaaaataatctggtccccaaaggtaagacaatcaatttagtaagatcagacaatttctgatgctttaatacaaccacacaataccaccagctaacacctgactctcttgcttttatttcttttctttaagtaaatgaagtattaaaatgttgtgataatgcgaaaagagttaatacatcagaaacagctaaaaacatgaaatgcctaagtttttggctgaatatgggtcaaactttaaatgtgaaaagagctctctgctaccatcctctgcctgtaactgataacatatatttctgtcccttcataaagatctggaaacatggcaaagcccccataagagagagcacaatggatctcatttgaaaagttaacatttcaaaaatgagatctactgtgctccacaggcagttgagagaatgttctttatttaacctcaatgctcaatcgtctattgtaaccaaatagcagttgtttggttttttgttttttataacacccctttttttgtcttatttggtcctaactgacttcttcagaatgttgctgaacatctgcagagggagacatttctataacatatgtatttatgtttgtctaattggtacacatttgtttcatgatactttggtatgagaaaaataatttttttaaaatcaaattatattcaactccactcccaagcagcaaagttggcagaaaatccatactctttttttttttttttttgcaaagtttttttttcctgttgttcttgggattatattagatctagagaatcacagtgtagaaagagtgggaaaagaaggcttggtctatttgttcttgccagaacctgagtgttctatttgcaggtaagcagctctgaaattatgacatccatgtgctccaagccaaacatgatctccaaggaagcttctgtgaacaacccaggctaagggtcttgggatccagttctcctgaaaaccaggcaccacgtccctcagtgggctgaatcttcatgagtttcttttcatgaagaaaaacacaggtctccacctttcaaggaacccacacaccctgccataaaatcacttttacctcaagaagagctattcccctttccaagagtctagaatttcagtggagggacctcttacctttattcccagataaaaagtaatctgggtttccaggtctcaaagctcttggttttttagcagaggagaaggtaaaatgtttcgcattttttttttgtatggtaatcctacagccaaaaatagacacattttctggacggcttctcctgcataagtaggtagaaagataagtagtgtgtttgtttgtgtgtgtgcgtaattataaggcattttgggtgtaggatatatatagctgtacattctgtccttgatgaaaagacagaaaaatatggtgcatatttttaaaaatgagaagttcttttgtaataacagcatctcaggaatgagataaactagctattgaggatactatcatgtgagctttaaagtcaggctgactgccttattatttacccttaatttcctttagaccctatcttgggacccagaatatgaaagacactcaaaaaaaaaaaaaaagaagaaaagaaaatgcatgttaactttatttatttatttatttattttatgtgtttttattttattttatttttttgagaccgattctcgctctgtcgcccaggctggagagtagtggcacgatctcagctcactgcaagctccacctcctgggttcacgccattctcctgcctcagcctcccgagtagctaggactacaggcgcccgccaccacgcccagctaatttttttttttgtatttttagtagagacggggttccaccgtgttagccaggatggtctcaatctcctgacctcatgatctacccgcctcggcctccctaagtactgggattacaggcgtgagccaccgtgcccagccttaactttatttaaataaaacctccaaagtgggtgtaaccttcaaaagataaatacaaaataccaaatggagtgaatgatttcatctttacataaccacccctttgctgctattataatgtgacaatgtacattgcctgaatcagttgctccaacatgcacctctaggataaattattaattcctccatctggaaccctgtcttgcctctgtccctccttctccaaaagattctcaaatatggcataaatgcacaaaggaatgcagtggaaaatgcaaattctttattgttattttataccaaatttcaatgtattctctcagtgagttaggcagccttttttctgctttccctgtcacactggtgtagtcggcaagagttactaatataaggatatggtgattagccctggcagcaaaagggcttggttttgggcagcttgtgcccctggactggtcatatggagctgaaagcaatctccttcattaacactaagtgcccagaaaattgtgtcattttctgccataatatgataggtaaaacattgaggatgctgttggtaaaaggcaattccacagaaaacactccaagaaaccaaggcacagagtgcttccgtaaaaacatcattatactcctctcactaatattctactccctagtaacacagcccaatgaatgccccagacccaactcatctgctttctttggtaataaatttagtaaagagagaaattcttctgcactttatctatgggacaatgaaaatcatgggaaatggaccttcccaaacacctggacatcacttaacacaatcagatataagagtcttagaaatgttatcacttgcatctatacattctattgtttttttaaaaaattctgtacctagagatgatgtgtttattctctctcatgatttattacttaataataacaaaatcactgtttttgtttctttttttgagagggagtctcactttgttgcaaggctggagtgcagtggtgcaatcacggttcactgcaatctctgcctcccgggttcaagcaattctcttgccttagcctcccaagtagctgcgattaagggtgcgcaccatcacacctggctaattgttgtatttttaataaagacggggtttcaccatgttggccaggatggtctggatctcctgacctcatgatccgcctgcctcggccttccaaggtgctgggattacaggcatgagccacagcacccgaccaatcactaattttttttagtggcccagtgtctccctctctcttcttggcttaaataagaggtcaggaaaagcaagcctgggagaagagtcttttttttatttttaatattagagatctgaaaaggattttgaggtagacataaattggggccaaattataacagcatttttttccttcaataatctggtgggaaggaaaagattcctacgcgcccttcatcctctagccttgatgccagatcgacagccaatcacgtctctccacttctgaatcatgtctgaaaatatgcatgagtgcacatgcaataccatactagaaaacctttactcttcatcctagtcatttatttgcacaaataaatgtcttttcattctgccaattcattcactctttctcagataacaaaacgagaggtttttccccaacattatgactcttgtgttaatattgattccctctctcttagtcactttttcagaacaacaaactaattttatgtttttgcagtatgccttcatagcttcagcaagaatcactgatttggaactttgtcatatgctttcaaactatgtaagattcaggtctaagttgaatgcaacagtacagtatctcaaaaacttaacctagttattgaggcatgacctttttgaggttgctttgtgttttttctgtcagctttgttttttaagtgtctggttatttgatccctgaattgaagttttgagatttaatgactgtcagataacataacaatatcccggagtgtgtatatataccttggataagaatagccacatgagtttcacctttctttttattcgtaagtactatgaaatgcatatgtcagaagaaatcttttcttcaaaggcctatgtcattgaagctgcaaagaaacctttctcctgtgtataggcaattattattactttccaagaggcatatctgagctgtagttgcaaacatgtcacatgcctcttcaaagctacctttcctttcattatgacatgcactatttgggacctattttttttccaacagcactgtcacagttttcatgtttttagtctgcatttactaaagaaaagttgccaagatggttcgagcttatgtaaactttgctaagaataactacatgatatagtaatgtatgcacaacacagaggagtttaaagaaagggagaggaagggagaaatctccaatataaaaagggtgtagtctggtttgttattttttaccgtgcagaattattcatgaacgtgaattgtgcttgtttctgttctgtaggtaagaatttatttaaacaggtcaaacttggaggtccctatagtacattttaaaagggtgaagattatagtaaatgaataaccatgtatagcactcatagaaaaatttttaaatgtttctattatttcattctgttttgttcctgattataaatgttattgctatagtgctttatttagtaatctagaaatatcaattgttctaacacaaagcacaaatacactcttatatacaaacaccgtcttgcaagcaccgaagacagaattatatcaatgactttatccatcaaacaaaatttaatattactttaaaggttgttacagaaactataagcattcctaaattttccacctaacttttcttcatttgttacataatggcaccaaattaaagacttcgagtgttgcagagagggtctgtcccatttctgcctctttaattgaggattctttacacagagagttccctgagttgttagcaaattgaagttagctgcaaatatccatggatatttcaaggtattttccacagtccttattccccttatctaaagtcttgatcctctactttgtgttcctgaaccaaactctggttccatttagagttttcataacgcattccctctgtttagccttatggctgatactgaagagatgcatctttgggtggaaaactctctttttgtgacctagcattaataagatgccctctgtcaggggaagctcttgtgaactgagaagctcggctttctttttattgattaaagcttgtaaggaataaaatatcattatgaaggcataaattaagaagacttgggataggagaaatgcagaatttcattttggtttatttctgaaaaataagtgatccttccacctcagcctcctaagtagctagcatgcccagctaatttttaaatttttattttgtaaacatgggatcttgctatgttgcccaggctgttctcaaactcctggcctcaagcaataatcccatctcagcctcctaaagcactgggattacaggcataagccaatgtgcccaccctattttaccactgtttctggagataacagtagcctcaattttctgagacttttaaagattctgcaggttagttcttgtctttcacaattgctagttggggaattactttccagggtcccctaattctgttatcaacaattaatctacttccaacttccaattttttgtcctttacaacctcgtcagtttatggctaaaatattattttgtttattcctctaaaaagagatttttctggtttatttgcttttgtttgtaatacagttttaaagtatttttcttagaagtatgtgaaacatgatatactttctgatattctggatattctaaactaattttcatttgctctgacaaataactttaatctgagattaatataggaatcctaggttttaggtttctacttcctcacaatagccttgatatgcaattccactgttgcataaagaagttcaatactctgccgatattatatattctttgtagctaatgtttttttcttcctagaagcttatatttctctttaatcttagaatttaagaataataccaaggtttgcttggatgtgtgtcttcttaccaatctaacggcattcatgggaccgaggtttctgtgttatccagggtcccactcctccatatgctgcccaacgtcaagctcttcctcgatttgccatccctggtcctcacactagggtcatggtcctccctacctatcaaactcaatggaaagttttttgttttaaagataaaatctcatatgaaattggagcaagtaaaaacaagaaaataagaaaaagaaagatagttatgaaaaatagtccagttttcccaacatcctgttaataggaactcaagaaacagaaaatagagagaaaaacaaatcataaataaaataattcaagagaatttgtcacaactaaagtttccaactcaaaagatctcatttgatgcccaacacaatggataaaagtagacccactccaagacacataatcttaacattttagaaacaaggaacagaaaaaaattatgtaagatttcatagaagaaaaacaatggatcacattaaaaagacaaagaggtattttcagatttctcaacagcattagaagctagaaaattatttacgctaaagaaaaattatgtcccacttaaaatctatatcaattatctgtccaatggaaaggtgaagacattttcagacctccaagttctcagcaatttcaccttccacagacacttttccagaaatctgctagataatatgctcctctgaaactaggaagaaaagaaaaaaggaatgcatgagaggctgataggaataggagaactcactgagaaaacagtccaaaggaatccccaggatgagcatgaaaagatgtgtccagaggactgttgtgtgccaggtacagtagaaaccgacctagcccagggtgatccaggtctgaggatctagaagaggtttctttaatattaatttgatgatgaggagatgtgaataattgacaaagcgtttaaggttgaacagtaaaatgtatctagaaaactaaatgaacaaaaattaagtccataccaaaaaaatttgtgttttttaagagagaaaatgtaataatcctagttcactaagagatttaagttagagcatgataatgatgtaaacactaagggctccaactaaacctaggctgcaacataattaaaaaggatacaataagacaacaataagaagtgtgggtggcagtagaggagaggcaagaaggataaaggctaaatccttatcctttattgtcaaaaatcaatgcacgaaactgaaaaactaagtaacaatgcaagcaagttttactgagctatgaagataaatacccgaagaatcaactaaaaaagttaaaaaggagtgcttcagggaaaaagaaacgtgaatgctctgaactgatgtatttcttaacaaatcttatagaactatgtgctctttaaactacagatgtcgattatgtgatcatatgtatataattttaaataaaaaattagaagaaagatgaaagaagaaagtaaagtagaatggaggaagaaaaggaggaaaagatggataatgagataagataaaatagaaactatccaaaagccagaaggaccatgtttttattaaataggaattttaatattaaaggcatcaatcagaacaccaaattacataaggtacctactaaaaagaaccaagttacagttgtgttttgtaatctagccaatcaatatccttccattcagctcctttatttcttttctatggaaaaactcaactaattttccagctttcttgcaataaatttaattcttggctgacattctaccatggccagaatgcaagacactatcttccagtcttgtccattcagatagcctttttattgttctaacattgtgtgtgaactaggttttggtctggaaggcaattttttcattatttcagtttgggccttggtccatcttaggccagtttttcattttgttaatttttgctttaccattatgtctcaaattttattcatgagatattttacacatcaattatattttgcatgcattttactttaattcatccagtataaattacttccatttagaattaatcatggaacctatacagtttaggataatgtttccaaaatttctaaattaacagaagcctgtacttgacaactatatggatcatccaatataatttaaaatgtgatatccatcttaggaatttgcatatatcactgtgttgatcagcacactttttcttacaagaacataaactcttctagcttaagcaaaaattaatttaagttcttttttctttggacccaaaattgagttgtatgatcaaatgcagaacttaacaggagtgcttttttgttgttgtttttgttttttgtttgtttgtttgtttttgttttaaagctgctttatttttctctaggatctcataatttcttatttccacctctcaggttacaattgtgtggtttttggttcttgttattggatagatccatctttctctgcttttccaaccatccacctagaaaaaaaaaatgctctcctacagtttttgagcaaccagcgtacaggtagtctgaagagactcattacttctgcaaaccccaatttcaagttcctagaagagagaatctgaatcagattgaatctgaaatccatggagtctaaacattgacctctaaagtttattactggcgtatgaaaaggcattttttacagagggaagacaaacattgaggagactaacaagtatctactgctctgcagtaaataaatgcaattagatcatacaatgtgttttagtactttctaattcattattgacaatgttggtctgtattcatcaccttgttttccttggtagttttttttttatttttttgttttttcttaccaggtcttttttttcttttatttcaacttttattttatattcagtgagtacatgtgccagtttgtaacctgggtatattgtctgatgctgaggttttggagtaccactgatcctgtcacccaggtagtgagcatagtatccagtagtaagtttttcaaccctttacgccatcctctgtcctccagtatttctcaaccaaaaaaagaactacttttggtttcgttgattctttgtatggatttcggggtctcaatttctctcagttcttctctgtgagtttttagtattgtgcagtgctctatgaaataaagaaaaatatactcactacatgctgcctacattatagggacataaaaaaaactttcaagcaccctcatcactctatatatttcttatattgtttgactcttttactacccttgacctcatttctcattatctactgttcccatctttatgtccgtacatacccaatgtttaactcccacttataagtgagaaaatgcaatatttcctgattaatttgcttagaataatgcccttgagctgcatccaggtcgctgcagaggacatggtttcattatttttatggctgtgtagtattccatgctgtgtatgtaccacattttctttatccaatctgccgttgattctacgtgtctttgctattgtgaatagcatcacgatgaacaaaagactacatgtgtcttttcagtagaatgatttattttcttttggatatatacccagtaataagattgctgggttaaatggtagttctattttaagttatttgagaaatctccaaactgctttccacagtggctaagctaacttacattcccaccaaatgtataagcgttcccttgtctcctcagcctcaccaatgtctgttgtgtattgactttttaataatagctattctgactggtgtgagatagtatctcattgtggcttcgatttacaattatcttatgattagtgatgttgagtgttttttcatatgtttgttggttgcttgtatgtcttcttttgagaagtatctgttcatgtcttttgactaccttttaatgggattttttttcttgttaaattatttaagttccttatagattctagacattagacctttgttggatgcatagtttgcaaatattttctcccactctgtaggttgtctgtttactctgttgatagtttctttggctgtacagaagccctttagtttaattagatctcacttgtcaattttagtttttgttggaattgctcttgaggacttaatcataaattatttgccaaggttgatgtccagaatggtgtttcctaggtttttgtctagcatcctcatagtctgtggtcttatattaaaatctttaatcgatcttgagttcaattttatgtatgatgaaacgtaggggtcagtttcattctactgcatatggctagccagctatcccagcaacatatattgaatagaaagtcctttccacttgcttatttttgtagacttagttgcagatcagatggctgcaggtgtggggcttcatttctgggttctctatcctgtctcattggtctgtgtgtctgtttttaaccatgctgttttggttactgtagccttatagtatacttggaagtctggtaacatgatgtctcatggcttgttctttctgtttaggattgctttggctcttcaggtctttttttggtgccacatgaattttagaatagtttttttctaattctgtgaaaaattgcattagtagtttgataggaatggtgttgaatatgtaggttgctttgggcattatgaccattttaacaatactgatgagtatgaaatgtttttccatttatttgtgtcatctctgatttcttgcagcagtgttttgtagttctctttgtagacatctttcacctttttggtgagctgtattcctaggtaatttttgtgtgactattgtaaatggcattgcattcttgatttggccctcagcttgaacattattgttgcatagaaatggcactaatttttataaatttattttgtatcttgaaactttattgaaatcatttttatcagtttcaggagccttttggcagtatcattagagctttctagatgtagaatcatattgtcagtgaagagagacaacttgatttcttcttttcctatttagatgccttatatttatatctcttgcctgattgctttggctaggactttcaatgctatcttgaataggagtggtgagagtgggcatacttgtcttgttccagttctcaaggggaatgattccagcttttgtccattcaatatgatgttggctgtgagtttgtcatagatgactcattattctgaggtacgtttcttcaatgcctagtttggtgaaggtttttatcatgaagggatgttgaatttcatcaaaggctgtttctgcatttattcagatgatcatatggcttttgtttttaattctctttatgcagtgatcacattcattgatttgcatttgtcgaaccaacccagcatcccagtaatcaagcattcttgatcttagtgaattaactttttgatgcgctgtggattcaacttgcaagtgttttgttgaggatttttgcatttatgtttatcgggatgttggcctgtgttttcatttttcatagtatctttgccaggttttggtatgaaagtgatgctggcttcatagaatgagttgggaagaaatgcctcttccttgttttttttttttcgaatagtttcagtggaattcgtatcagctcttctttgtatgtctggtagaattcagctgtgaatccatctggtcaggagctttttgcgttggtaggttttttattactaatttatttattcaattttgaaacttgatactggtttgcttagggttccagtttcttcctgtttcaatcttgggaggttgtgtgtttctgggagtttatccattttccctagattttctacttcatgtgcatacaggagttctataatagtctctgagaattttttgtatttctgtaagattggttataatgttatctttgtcattcctgattgtgcttatttggatattctttttctttgttaatctagctagcagtatattgatcttgtttatcctttcaaaaaaaaaactacttttggttttggtgattctttgtatggatttcggggtctcaatttctctcagttctgctctgtgagtttttagtattgtgcagtgctctatgaaataaagaaaaatatactcactacatgctgctacattataggaatataaaaaaactgtcatgcaccctcatcactctatatatttcttatattgtctgactcttttactacccttgacctcttaatcactttcttgtgactacttagttggtttattattataatcaaatcaacatcagtattcttttatatgtacattttccattcacttttgctgataacatcttgtctgttagtgtttatagcaactgcttcaaatctttttcgaaatgagaaagcatacaagcatacatctgaatgtaaataaatcagtcacaatctcaagtcctactgatgtctcttttttcaaaatatttaaccttggattaaattttttatcaagtatttaaactctgctgcaggtaggctgggcacgatgactcatgcctataatcccagcactttgggaggcagaggtgggtagatctcttgagctcaggcattcaagaccagcctattctcttggaaacataattacaaaaacttcattccttgccctggccgtttctttaaccaaacttcagcttctttgtgcccataggtgctggcaagcagagatggtatatctctgaatatgcgtattgtcagtgtctctctgtgaatgccattattcaagggctcacaattgatattgttctttgttgcagatagtgacttccaaagtgaagtttttggaatgctagtgctagaagactttcttaaaaacaaagatttcatagcaaagtaaacttttttatattttcctaagaagaaaatgtaacctttcttggtaatttttgatgaatattaaaagattttcaagatccttcatttaaaaaaaaaagtacctactttgtaatccacttttctgttgttactgaactggagtgcacacgataattttcccctgacctcgtatatgccacaaagattctgatttacactctgggagtcacagccttcttgatttaccaaatccttatctaaacacacaaagacatccactcttccaaaaaatcacttttatgtacagcaatgctgttagtaaagttgtgtttgtctatctgtgtcttgtgtgtgcctttgtgtatgtctctgtgtgtggtgtgtgtctgtgtgttttcttctgttttaatttgtggttcatcaagaggaacaaattgttcagtacacggaagaaaataactcatttacttttttccaagagtcagatttgaaggatttttgaaggttcctaagataataaatttattatttatggacaagcattttatatcattaaaaaagaacaaattttgttagtcttataatgctttaaaaatgcagaatttctcatgtgagaatcggaattgaattttggtatgagattatgaaattattaattattaatactcttttggtgaaaaggaatatttaaatatattttgagactttaccctctatgtgacaagcaacttttattacttttgcatttaattaaaatttctaattacatttttatctatgataaaaagtacaaaatttaaaattcaacagttaccactattaaatttgaagcattttcacattacagtttctgctgcttatacaccaaccatcaatgctattatggattatcacttcaattaaaagattgtttatgatccccataggtatagatagaaatgaaggctgagcaatgggaattccaatgatgatgtagaacattccatattaaataaaatcctgtgcacctgggaaatcaaattttagctcagttgtatttattatgacaccctaggacttgtgttttatggattcaagataagaaaatcattaaaaatctgcttgtcacattaagagatcatttaaaattattccctcagggattattattagcaatatattgtaagatcttttccttccttgaccatcttatctttatgtaacacatgatttctgtagttaactagagaattcagtgttcaggaagattatgatgctgggaaatcctcctgagacaatttttttcatcactgagattttcccccaaataggaagttgtttttcttttttcaatctgcaaatatcctcactttttctcaagccactttcattactgtcagtcttctgcaggttttcaccacacctaaaaagagaaaacataaccattacaaacctaaaaagactcaataaaccaaagtaaaaagtaaaaccttgagacctgaggtcaaagaatcaaacccaagtaagactggagttttccagtgaaatacttggaaatctaaaattcaaaaccaaggtcatggtgtggaaggacattaatatacattttatctttttataacaaatcatctctagggaaattttcctactagaaatcgtaattatctccatcagtcgctccagggcagtatcggcaagctgataatgcacctgcatctctaccaatcacattgccacagaaactggaggggaaaaatctgctgctcaagagttctatctctgagcctgtgaaatagccattatctccatggcaatctgtatttaagacagccatccaatcctcatcttttcttttttacagtttacttttaagctttcatacagcttcattctgaaaaatattttctttaattacttttcctttattcctccaactcaacatatatatatataatacatatataaataacgtatatgcatttccacaaagctatcttgtttttatataattagagggaacttatctttctgattccctctaattatataaaaacaagatagctttgtggaaaagcatatatgttatatacatatatatatactgcatagaaaatataactgatatttgagtaagtatgtaaaagaaaattggccaacagaaaataaaattcttaagaaaactaacaagtagtggttacaataatatatagagatgcaatatatataaactgtatgaaaaatgtaattgacaattgcatagagtcattatgtaaatgaaacatcaaccaatgaaaaacataaaattctttagacatttaacaagtactgattgcaacaaaacacagggttgtttttttttaacttttttgaatatgtagtaatttttttttttaaatggagtctcaccctgttgcccaggctggagtgcagtggcatgatctcggctcactgcaacctcctccgcctcccgggttctagcaattcttcttcttcagactcccgagtagctgagactacaggcacacaccaccatgcctggctgattttttgtattttagcagagactgggtttcaccatgttgcccaggctgatctcaaactcctgagctcaggtagtccacctgcctcagcctcccaaagtgctgggattacaggcgtgagccactgtacctggccagtaattttttgatgtttgaagttctactaaaaaacaaaattttcattacaataatatcagttgttaatgtttttccgactgtcaatatcattatttaactactttcttttcttcactcgatctcatagttctattcaacctgctaagaacaaacagtatctattcaaccatttcaatcatcaaagtaaaatttcaggaatattattcttgtaaaactcatgtgtggacaatgtttttgtgaagcaaaaccagtgtgatttgctttcaagattccctccagcgggttctgtttttgttgttttgccatacaagtaatgaatgtgtctgaatataaaagggataggtaatttaagaaagaagtacatctttaataaagtactgaaaagttttgaaaatatcacactgataaaaccaaacatatctgaagccataattcataatggaattaacactgtaagtctacatcaatgttttaaatattttcagtacctagaaatatatggtgaatatgtggtagtgaataagtctcatgaaacctgatggttttataaatgggagttccccttcacaagctctcttgcctgctgccatataagatgtgactttgttcctcttttgccctctagcatgattgtgaggcctccccagctatgtggaactgtgaatcaattaaaccacttttctttataaattacatagtctcaggtatgtctttattagcagcataagaacagactaatacagtgaattgttaccaatagagtggggtgctgctgtaaagacagccaaaattgtggaagccactttggaactgggtaacaggcagaggctggaacagtttggaagctcagaagaggacgggaacatgtgggaaagtttggaacgtcctagagactttttgaatggctttgaccaaaatgctgatagtgatatggacaagaaatctaggttgaggcggtctaggatggagatgaggaacttgctgggtactggagtaaaggtcactcttgttatgcaaaaagactggtgatattttgcctctgccctagaggtctgtggaactttgaacttgagagagataatttaaggtatctggcataacagatttctaagtggcaaaatattcaagaggaagcagagaataaaaatctgactatgcaataaaaaaaaaaagaaaaatccattttctgagtagaaattcaagccagctgcaaaaatttgcataagtaacaaggagccaaatgttaatcaccaagacaatggggaaaatgtctccagagcatgttacagacctttatggcagccccttccatcacatgcctagaggcctagtagggaaaaatggctccatgggctgagcccagggactcctgctccatgcagccttggggcatggtgccctgcatcccagctgcttcagctccagctatggctaaaaggggcgaacatacagctcaggccattgcttcagagaatgcaagccccaagccttggtggcttacacgtggttttgggcatgctggtacacagaagtcaagaattgaggtttgggaacctctgcctagatttcataggatgcgtggaaatgcctggatgtccaggcagatgtttgcttcaaggtcagggccctcatgggagcttctgctagggcagtgtggaagggaaatgtggggttgaagcccccacacagagtccccactgaagaactgcctactagaactctgaaaagagggccaccatcctccagaccccagaatgatagatccaccgatagcttggacagtgcacctggaaaagccacagacactcaacaccagcagctgagaggggggctataccctgcaaagccacagggcagagctgcacaagaccatgggaacccacctcttgcatcagtatgacctggatgtaagacatggagtcaaagacaatcattttggagctttaagatttgactgccctgctggattttgaagttgcatggggctggtagccccttcattttggccaatttctcccatttggaatgggtgtatttatcccaatgcctgtacccccattgtatctaggaagtaactaacttgcttttgattttacaggcttataggtgggagggacttgccttgtctcagataagactttaaactgtggacctctgagttgatgctgaaatgagttaagactttggggatctattgggaaggcatgattggttttcgaatgtgaggacctgagatcttggaggggccaggggtggaatgatatgtgctttggctatgtccacacccaaatctcactttgaattgtaattatccccatgtgtcaaggacagggccgggtggagatgattgaatcatgagggcagttttgcccatactgttctcgtggtagtcagtttcatgagatctgatggttttataaatgggagttcccctgcataagctctcttgcctgctgccatataagatgtaactttgctcatcattcgccttctggcatgattgtgaggcttctgcagatgtgtggaactgggagtcaattaaacctctttcctttataaattacccagtctctgggaacaggctaatacatagtcctaaacttcataacttatctaatgtagctctccccagtatgactaaccaccacactccatattcacctccatctgtttccaatatgtcccatccttctcaaaaagaagtgtctattctctgtatttaggacatcacttatgaggtataaattattcatgttatgcttctcatctggagtgttttctctccagtccatagcagtgttcaaggcctaaaagcagaggtgacaaaaacagtctgcctgcaaatgaaacatggctcaaagacatgttttttatggtccacacagtagccaataacttaaaaactgaaaatttttatataaaaatccagattttcatctttacctgaacacctagaacatgtggttgcactgtcccccgtggcaatagttggctggagctaagcagctctggaaccttcttggtggggcagtgtatgtactccttggtctagcccagttttcatttcttcttatttcttagcctgggtccctataggcacttcaacttttgatctctgacatgcaagaatgaaattatatagcaaagagtagaaaatctttgaacactcattcacaagggaaagtttcaacattattatagcagtacctaatctaaataaagtcaaccacaaatttatttatgtttaataaactttattactacaacttattcaacatttattgaatcctgttttgtaccaagaattagatgaggaaatgtggacaaagagcagagtaaagtatatttctgccttcccataattaatcatgtagtcaatataacagaaatcattttaaacaaggtattttaatacaatgcaataacagagatatatacaaaaggcactaaaagaaaatatctgagcatcagctgtattatattcaaagagccaacttatccatagatgttattaatgaatagatgacagatttgatggcttacatcaatttagtttttacaagaggaatataaacacctgtgtcataattgaggactgcaaactactcaaagtcataattgtaattttgcatgacttgtaaaatgtctgcttcagtaatcatgaagcactaagaaatcagtatcacactttagaatataactaaactttttattcctaacctattatttacctgcctatcttaaagaaatatcttggatgtttgagttaagtatctgcttgataaatgttatataaatcagttgctacaggcatcagtgttttggatatttttcaaatatagtgcgactgtttatttcaaatttaattcaaataagatgtattttgaactgtctcaggttaaatttctggaactttatggtaacttgaaggaatttaaaagtaggaattattacaattcaaactcatattaatctaaagacaattctgagctttagttttgggttttttatcaaggcaagatcaatctccccctgaatttgacccattaatctgtcttccccccttaaccacaccctttcaaattttgcatatttgaaaagagctatcataccttcctcacaaatatacttattcaataatttcctgtttagattactcatatggctctattatttttctgcgaactttcttctcaaatgttgccctgtttttaaacattccttgtaaaacatagcacttagaaacaaatgaagtattctagattgtggatgatcagatccaagtttggcacaattatttttcttgatgtagacaatattatttttgagcaagctttatatccaataacatttctggtagcatatcatacttcagatgcacattgaacttaaattattcatttgtttcttctgagtgccatatttggcttcatccactaaaccatatgataattatttggtacatatgataaacctatagttctaatgacaacatttctgtaaaagctatggatttcagattccttgaaataaattttcagtccacctttcaagcactgtcttcattgagtataacactcactcagtacaggatacttttcatggtatagagtccctaaggaccaaggagtcctggaatcatatgtaatctcatcacccaatcatttgctctaccatacaactttatgatattgttttaaccaaaagtcagattcactattatagaaattaccctattgttggaagttactaagataatggtcattagtctgatgtcagagaggaaaatccaaataatgacatgtcattgtttatcttattgataactgcataccactttatactgtaaataactgaaaataaacatttcttaaagcttgtagtagactgaatactggtgtcccaaagatgtccatgtcctaattcccagacctccaaatgtttccttacatggcaaaagggactttacaggtgtgatttagttaaggatcttcagatcagaggattcctctacattacttgggcaggcccggtgtactcacaagagtccttaaaagcagagaggagggtcagggcagagaaggccatgtgacaatggaagcagaggtcagagtgaaatggggccacaagacaagaaacacaggcagcctctagagctggaaaaagcaagaaaatagattcttacccacagccttcaaaaggagtacagccctgcttgcccattttggatttctgacctccagaacaaatgtgtgttgctttaagtcagtaagtgtggtaatttgtaacagcagcaataggaaactgatatgcttcttaatcaaaggctcctggtaaaaactgcactcatctaattagactttgctgggggtggaataaaacacaacttctatttatcctgacagatattaaagaacataaggcttttttcttcttcctaatagtggctttaatagtttgattttttttcaactctgctacactttacatatattatatgggaagaaattggtacaatgagtctaattttctacagatttgtcaagagtatttgaacagtaaaacatatttccaaacaatcattagtttctaacaccaaaaactgggtaaacagccaaactaaaatggtattaaaaagactcatcattctttatattaattgctaactcattaatcaattactaattcagaaatacacagattattaggtattgctaagtgataacttgtggacttaaaggtaaatttgggtaaggataaaaaattaaaacttggtttagaataataaaatgataccaaatcagaatcagaatcacacaattccaatgtttagaaactgtaaaatttatactaaaaatatttaaggcattatttatcaagctaacacagttctaaataattgtacaatgctttagacaggaatagaaaatcaataagctggaggtttcaaccattcctgtcatggaacattttaagatttatgaaataaaattgatttgtgaaatcagacagaattgctgtatttacctttcattaacatgaatgtaactgtgccactagtcaaaaatattaatcacgttgattatccttaagcaatttcaagtttattattgaaagcataagtattcattttcccaagtattcaataagactgcctgtcaaattacaaacaacacaataaattctacaaagtgtggtgaaacaataaaatcatttaacataattgaatattcccatgaattgtataaacattaatcttaatgataaatcaaaaagcaaataacttattgggtaaagttcttaagttctacatctagctctgtcactaacaacacttcttaaatccactgaaaataatctacttctaaccttgactctgttttcattaatcaccacaaggactctcaagtcaccttagtttcccatgctttaatctcctattggaccctacgcatacttgatttttgtcctcttttattacccatccctgattcctaaaccttttctattgtgtccttcaggaaccatcatcagaagaatgccttatatcctaaaattagtctatgaatattctcttcactttctttctttaatataactggctttccttcattttccaagcagtggctcatgtctcccatagtcattgttgcaataacttcactattcgcagaagtgactgaaaaccacacacacatgcacacaaatcacatcacaaaaagtaaactcagtgtatccttgacatgactttgtaagatctcaaaaatacctatggcctctctccattgctgtccaacaaggagacaagtattgcagacaagaagctagattggcagagagtgatcttaactggttgtggtcaaaatagtttacttctgtaaatatgtcaaaagcacatatccctgtgaacatattggtaaagcccctcccaggaaataagctcctgtaaggaagtggggtggggcaggggagctagaattcaagcctcattagttccatgaagaccccacaattgcatgcatcccactctctgaccaccacctcctgcgttttctctcccctctctctggtacctcaatgacacattttagtttttagcttctcattttaaaacaatttcagactcataaaaagttgcagaaatagtaaacacagttcccatgtcttcttcactcagcttccttaaatgttaacatcctacaaagccagtataattatcgaaatatagttatgaaagctaggaaattaagattggtgcaacaccattgacaaaaataaaccttattcaaatttcatgagttgtctcactaatatttttattttttactatggaatttaatctaggatcccataattaatttaattgtcatcttgcctctaatttgggacagttcttcattctttctttgactttgatgaacttaacacttttgaagagtactgaccatttattttgtcaaatgtccttcaattgggtttgtcagtatttcatcatgattaaaatcaagttgtgcatttttcaaaataataccacagaagtggcgcgcccttctcaatgcatcatatgaggtgctacatgatgttggtttgtcccattattgctggtattaactttgatcatttggtcaaggtgttacatgcagatttctccactgcaaagttagttttctctgtgtaactaatatgtatctggtagggagggagactataaatattccacatctcatcatattttgtcaactaagtttagcattcatcgatgattcttgcctgtaacaattgttactgtaacgtttgccaactggtgatccaaaactctcaaccctactgggacctccattccgttgatctttccgatgttactctatcctcagcattttcgtttcctcacttccctctatgtgtagcttaaattcaattctccatcattataattaccccttgcctatatcctcaactcattttctcttcacttgtttcactgtatttctcgttaaaaccacagctcttcacctactctttgcctagaactatggacttgagatttgctgattaaaaaatacataagcaaattaactggtttcttttcaaacaatgttcattacccctagagaatccctaatattgtcaggtaattatactatgtctttctagttcattattactttacaactcttcacaccttcttctctctcctccagctccctgtacctccttatccatttcccctctcagctgatgtccttgtttcatattttctgagaaaaatatgaatcaacctaatcagactttgaaccagctcccaccataatatctacttgctggcatctgcactcacactggctcccactgttaccataggtgaaatttctatgttttaataccatgtataaaagcttatcctttttcatctactcaagcacattgctccagcagtttctctcacttttgcatcatcaaagttttctctatattagatcatgccaacagcttacattttattattcctgtcttttttaaaaaaaatctttcattccacttttcccacatgttaccaccccattactttgctcctctttatagcaaaactcttcagaaattgttttcaatggttactgtccccaattcctctccttctattcactcaaatctatttcattcagatatttgcctctattgttcactgaaactgatcttataaaagtcatcaaaaaaccattacattacaaatgcacagttagttctgagtactctttttgcttcacctagtagtggcactcatcacagctgaacattccctcccacgtgtcacagtgtgttcacttactaccaaaggaaacattctgtgtgtttcttctgtttgaccggatgttctgcctccataccttttactcattcaagccttcatatgttgaagtgtcccaggttttactcattctgatgatctcatttaatctcatgtctttaaatgccatttatatggtatattagtcggcttgggctgccataacaaaataccatagactagatgtctttaaaaagagaaatttatttctcaaagttcttaaggctggaagtcccagatcaaggggtcaccagagctggtttctcctgaagccactctccgtggcttgcagaggtcagcttctcgctgtgacttcaaatggtcttttctccatgtgtgtgcacccttgatgtcactctatgtgtccaaatttcctcttcttcaaagaacaaatcagattggtttaaggtcctccctaaagacctcattttaagctaaacacctttttgaaggccctgcctccaaaggtagtcatattctgaggaactgtgagtttctccacttcaatatatcaatttggggaagacacaattcaggcaataatatatgacaattccaaattttatactgccaactcagaccttcctccccaaattcagattcatatatatgatagttttaacatctctcatgaattttatcctggaaatccactctccccacagccatctctgtcttgggtctcagtaactccattttaccatcctttcgtgatcctggtcaaaaaaccttagaatcctccttgaccctctcttctctaactgctcacatacaatccactagaaagtcatgtcactctacctgcaaaatatatttaaaatctgatcctttatcattctcttcactgcaatcacaatgaactaagtcaacatcatcttttgcctggatttctgcaatagtttcccaggtcttcctcttgcttctttgtagtccattctcaaaacagaacccataagtgatctttttaagacataagtcagactatattactcttctattcaaaatccttcaatggcttgacgtttcacttggagtaaaatgaaaagtccttacaaggaattacaaggccctgccagttctgggcccaactccctatccccttaacgctctgacctactcctgtgcttctcacatcagcttactacacttcagccaaactgacctcctcctatcctaaaacacaccagtcatgctcctgctttagagcctttgttctggctactactcgatcattcttctggacaaactgctaactgcatggctcgctccttcaccttcttcaagacttggtttaaatctgaaccttaccaatacaccttcactgacaattggctactgctcctaagccctgcccaccctatcccaccaccctcaacctggacgttttctttattcatgacattacttaccatttatgtaacatattatcaaatttacttattcattatatttatttttattgtttttttatctgtcttccaaaataggaatttaagtgctctagtgcaggaatctttattcattttcttccctgatatattcaaattcctaaggaagtgtccaggactttataggtgctctttaaatagcaagaaaacaaataatgtgattgaaaaaatgggcggaggacctgaattaacttttgcaaaagaagatatacaaagggccaacaggtatatgaaagagtgctcaacaacactaatcatcagggaaatgaaaattaaaactacagtgaaatatcatcctacatctattagaatggttattatcaaaaatacaaaaagtaagtgttggcaagtatgtgaagaaaaggggacccttgaatactgtttgtgggaatgtaaattagtacaaccattgtagaaaacagtatgaagcttcctcaaaaaatttttaaaaaaaactatcatatgatccagcaattgcaacactgggtatatattcaaaggaaatgaaattcatgtgtcaaagagatatctgcacttccatattcgttgcagcattattcacaataactaaggtgtggaatcaacctaagtgtctatcaaaaaataaatggataaataaaatggtcattatatatatacacaattgagtatgattcagccttaaaaaagaaagaaatcctgtcatttgcaacaaaatagataagcctggaggacattatgtgaaataagccaggtgtagagagacaaatactacatgatctcacttatgtggaatcttaaaaagtcaaatttatagaagtaaaaaatagaatggtagttaccaggggtggtgggagacagggagagatgtgatcattgaatacaaaatttcagttaggaggaataagttcaagagatttactttaaaacatggtcactaaagttaataacaatgtattatatatttgaaaatggctgaaagtagcttttaagtgttctcaccacaaaaaaatgacctatatgtgaggtaatgcatatgttaattagctagttttacccatttcactatgtataaacatttaaaaacatcattatatacaccataaatatattccatttttatttgtgaattaaattttaaaaaatttgaatgtatgaatgaatggatgaatgacaagcctcatgcatgtcacttattgagcctcagaccccttattttcataattacaaaggttaaattatataatttctgttgtctattctaaccaccagcatttgattttatgatactatagatcttacttagaaaaaaaaatagatatatagaaactcacctttacccaacagataaatttggttattttaaatgttttttgaagattcttttgtaaaaaaaaaattactgctaatgcattatacattcattgggagtctttgacacagaaatggggaagaatagtcacctcagctgaagtagatgaggtctctgacaactgtacgtcaaaggcaaatgaagataaaataccttcaaaatgatcacataaatcaataagcaaatgactttgattacaactatgatttaattaattataaggccacatctgttgcattaatcaagctaaaatcagtaacagaatttaaattgaatgtggtacctcaggagaggttttaaaagtaaactttttattaaggaataaatacagacataaaagtgtacaaatcatgcattccttgtttggtgaattatcacaaagtgaatgtattcatgtaactattattcagatcaagaatcagaatattgctagaatattaccagcacaccagatgtctccctaaagtccccaactagccactgactccccagcttccaacaattcccactatcctgatatctaacttcatagattagttttgtctgggtttcaatgttctataaatataatcacacactgagtaatcctagtgtctggcaatttttgttaaccattttctgtaatatttatttgcatcattatgcacagttgtaattcattcattcttcttaatctataatcctccagtgtattaatatacccagttgattttttatactgctgatggatattttgggttgtttctagtttataactacaatagtagtgctgctttttgtatatgttatttgatgaacatttctcttgagtatatattttcaaggatcactactggtcatgaagtatgcttatgttcaatcttagtaaatattaccaaatggtttcccaaactggtttttccaattatattcctaccttcaatatatgacagtttcagttgtttcttgccttcttcaaaatttagtattttctatcttattttagttattttggggtatgtgtaatggtatcatattggtttgatttctatgcatttgtgtggttttgaaattttatatgtacagtaaaatgcacacatctttattgagcttgataaatttatatgtatatgtgtatgtacatacacacatatacagtgtaggtgtgtatgtgtgtatatgtatatgtgtgtatgaatgtatgagtgaacacacacatatacatatacatatacacatacacacatacacacacacacaaacctatggtaaccaccatctagaacaagatatagaacatactcagcaccccagaaagatctcccttccactttcaacaacctctaagaggttactattttgacttttcccattgtaaattaattttcttttttcttgactttcaaataaacagaatcatactctcttgtgtctttgagtatccacagacacacagactcgccaatacatggagagtcattcatgtattgcatgtagcagtcatttttattgctttgtaatattaaatatataaatataccacaatgtacttgtccattccattgataaatgtttgggttgagtaaagctgtaatgaatattttgtacttgatatttgttgtaattatttcttccagatatatgtgtctgtatatggagcgaaagaaacaaaaagggggtgggtgatattgctaggtcctatggtaggcatttgtttaggcttacaagatactgttagtttccaaagatctttgtcaatttacactaccagcagcaatgtatgagagttccagtctctacgaggtcatcagcatcacaactgccattgtggtgggtggatggtagcatcacattcttatttgcatttcataatgactaatgatattgaacaacttttcatatgcataatgaatgtttaagtactctgttgtaatgtgtctgttcaacccttttgaccatttttaattggattttctgtttttatctcattgatttgtagaagtactctataagttctagacagaagtccagtcctttgttggatttgtctattacaaatattttctcccagtctttgacttttcattattataatagtgtcttctgataaatagaagataataaatttaataaaggtgaatttattcatcttttatttctttattaattctcttgaatgtctgtatttaagaaaaaaaatcaccaaaagatcatgaagatattgtcttataatttcatcaagaagttttattttttctgccttttccacttaggactatgatccataaataatttttgtatatggtataaagtagaaatcaagtttcattcctttccacaaatttatctaattgatccaggaacatgtattgagaagattatccatgccccaccaagttgcagtggcacttgttttagaaaatgagtgtgtatgtgtgggaatacttttggaccccaatcagttccagtggtatccattggaaagatttttctttgttccctataggagcaaagaaacattttctatctcatcactaggtttgtgattaagccctctataacaaaattcagattaatagaaaaaaaagcatacaaatttaatatgtgttttacatgacatggaattcttaataagaaaatgaaggtccctccaaaataggtaaatgtatattttttatgcttaggtttgatgaagagatggatagtcatgaagatgtatgattaaactaagggtatgatctaatgctaataatctcaccagggttggggcagggagagttaataaacaggacttatcaaggcctgtttgtttagattattccctaagtctctgagtcttcagagataaggatattcctttctcaggatatagggagaacacctcttccatgagggtcttatgaccagtttcaagggaaaaatcaacaggaaaatgagatggcttttctacttctgctgtttgctcacatgccaaggtgtcatatttgggagtggcatgtccatccctccaataccatgctgtcttaattaccatagctgtatagaaagtatttatattttgtactatatgctatccaactttgttcttcttctaaaagattgtcaggtccattctaggcattttgtattaccatgtaagttttagaatcagctcttgaattcctccctcctagaaaagattggggttttgactggcattgtattaaatctatagatagctttggggattaatcagcattttaacaatatcaagttttccagtctatgaacatggtatatttctctatttatgccttctttactttttcttagcaaagttttatagttatgaatgtagacaacttcacaactgttgtagatttatttctaggtattaatattctaaaaatattgtgaatgttgtttttattttctattagtttgttgctactatatggaaatacaattaatttttatacataacccttgtatccagcccttgttttttataatggttagtactacatagtctgtatatttacttttgtataatacagtatttgacactatagttgattttactacatttacactaatcccttgtaataacgccatttttgttttacaaattttctttataaagactttcaaatatcagaacaactattcttttggaatagaaagaaattcttaaaatcgttcttcaagtaaagctgtgaaatactatgctgatagcttcaatcaatcatattgtttaacaacatgatgttaatatttaggagctcaaattaccatttttagactcctgaaaaagaattttttctagtcaatacaaatcttgacattagaaaattacaaggaacaattattcttcatcagcatttactcaaattaattcaagttaatttgtccctttggaagtaaggatgacaatgaaaatcaagacttggagtgatttcttaataacataattatatgtaaagatgaagtaagagctataaacccaccctgtagaggtttcctaggtagggaaaaattaggtcctaacttttgttattcaccacacaagatgtccttaaggaaaactctaggccttcaaggtcagttaattattgtcagttaagcccatcctcattccctttcacccagatagaaaatgccaggtagactttaggagaataggtttggtgaggagcttcacagagtaaagcaaactttagaaattatatctggcttttcaatatgttccccaaaaggtaatatggaggacacagctcaggcctcgactcatcagtcttcatgtattatatcacgtagaatgaaagtacaaagcaaagatcactaaaatttctaatactcttcttcaatgtattgctgaaaggttgggataggtgagagcagggtaagagtaaaggtacataaacctttctctaccccagagtaaaaatggtggtttcttctattccagggcccaggctgaggcacgctcttctaatactatgttgaaaatttagcattcctcatattttacagattaatttttcaagaaccactgtctgatctgcccatagcttcatagttctgctatttaactttgcatggatttcctgagaagtaataatgctgaacacccctcctcccaccacagctctgcattacataaaaaagttatcccaaattgactgatgaaaaatcttcaatcatttctccctaattcttatttttataattaatttttttcatgattgccaaaggaggtaggtcaatctcccagtgcaccctacaatggtaatgcattgattaagggtaataacagtggaaacagccacaatactgtcattaaatttattaactgtttcttgtatgtcagacacttgtcaaggaagccacccactattcaatatctgaaacaaactaacaaggctgagtttgttgctggctatgcgagggagacatgtgcttgtaaaacagtctctctgagaatagcagagaactcattttactgggtttatggaggtgtgggctccggcatgggtagatttttagaattgggtgggactagggattggttgacctttagctgtgtcagattggcttactggattactggagccagactggctatctgctggcttccatgagctgggctactgaagtgagattgttgctcactgactgacgtttggaagccaaagacttaactcattggccaggcttcagaaatacagctcctaaagcttctaaagtaagttgtcatttgtcattaagaagggtttaaagctgtttctgatgattgcttgttaggatgtccaaaacacagtcttttcctgggaacacaagaatcttttactctgatgatactcaatgttaatattagttagtagtcagtttatagatgttacacaatttacttttcagaaaatcctttatgaatatgaattattagaatttccattttattcataagaaaactaaggcttatcttgcccaaagtcacatgactcataaatggaagaaacacgattcaaaacaattttaagtccaaaaaaatcaggacatacccaaagactgagtctacattcattcagtgaacagtataatacatgctgagtcatcaggaagccaggtgtagctgtaagcattgagaataccaacttacacaaaacacacaaaatctgtcttcctccaactgacgcctttgctatcttttgctgatatttgcattctaggccttttctcctgccagcttcaagatgtcacctggtaaataattctccctggattaggtcatttttgtataagtcctttgcccaatacttcaccaaaatcttaacttttttcctgtgaatggggctgtcccttactctttaccttacctctgaaaaatcagatttgcatttgacaactacacttagttcagatggctgaaggagattaaaatcataccttcaagttctaatttaatagttaacaattttattagagtaattttgtgcccatttttgaggcatccaaactaagtttatttttaccccatacttcaacgtaaggtgaaatttttctcaaaaaacaaagcagaagtagttgccttatattcaaatccatatgacttttttttatatattacgagtcacattctcagtttattttgagcaaacaagaacaatacattagcctgaagcaacctcagccactgctagtttagaatgctcagatgtcacccaaagaaatttgtttaaaaaacagggagggggcagacaaactttgcatagattgtagtcattattgctgagtgtgcagcttctcagctccaagtattgaatgttactgtaaataaagtctttaaggacaactttccaagtgttacactaaccgattatggtgaggaaataacagacacaaaatgaatttttaaaagaaactgcctgtatttctattaatggcttaattatcccatgatgatgtgctctcttctgtgttagaataatcacaaagtggctttttttagtgataacaaataactgaattaaatgtgtgtataaagaatttttataaaattatctcctgaatatctaagaagcacagcaattattctgaagtattattttctatgataaatggtttgtacatgtatatataataagttaattaagtacgaagtgtagattgtgattatttcacatttattgctaaaaatgtttactttcaagttaataaaatgaaacatttattttacaaaacagaagactgtcttattatcaaagtgaccttatacttgtacatattatgtatgttatttttcttataaattgaggaagttttgttaaattgctttactaggcacaaatctcatttagtacaaagcactcaaacatattttgtgtttatttggcttcagatgtagccaaggaggtcacagcatttctagaaaatttgtgttttattaagcatcctaggtacagaggtattcagcagaagaaagcttatggtagaaatatccccaaaattcccatgattatatctcaaagttgcctgcaaacaaacgattttcatggtatagaaagaggcccaatcctcttggtcttcatcccaggatccttttgggatgtccatctggtgatgagattgaggatcgcagtgtcaggagtgggtcgccctctaacctgcctttgcaccgcaagccagagtccaggaaggtactgtgtttttaaaaagaacagcggtaccatattattcagcagtatcttgagttttgtataagaagaaatagcaaccaaagtgaattcatatataaataaatagataaaagtcgcaatgtcactatttaaaataaaaaagcataacagaagagaagagatatctaagggcctaggaaatataatcttcttcagaaaatattttcttaatgagtcaggaaaaaaatagagaatttctacttagcattagtgagatcaaaggccattacatctatttaacagtaataggtcagaataaacagagaattcaaagaaccaagttaatcgaatcaataacaaataatgataagccttaaaaacctggcccaatactgccagagtgctacagaaaataaatatgaatacatatctataatgtggaagaaatggaaagagatgtctgttaatgtcacagatgacaatggactttgggaacagaatgtaaagaattgactttgaataacagtatttccaaaaaagaaaataacacaaaataatgagaactgatcatcaaaatgtaaaataaaataaaagggcctaagcaaataagttttgataatgtctaaaaaattgcatatatgaggctgaaaagttttcctaaagactacagcatgtaagaaagcatgatatcataattcttagtgtgaactgtaatatgagtaattcagtattttttcaagaagtggggaaagagagggtttcaaattactgtatcctatttactatagtcagatttactgtattcatgtttaatatataaactgatgaaagacttttacttgatgattagaacttagtcaatttttaggcaaatgttgtacaccacactgtcttattagtccatgtgtattgtccatccactggattccaggcctgctttaggtacagggacttctggcccaaacaaaaacagtaggacctgaagccatggagtttacagtgagaaaagacaacaagccaactgttggactttgacttaattatacttgtaatgagttctataaaagggaaatgatattgcaacaggaattactcaggtcacactggtgattagtgctgtgaatgcaattttattgcagtcaaacaacttcaagtttcacaatattacataggaactagaattatacttcatgaaggcagggattttgctctgattttttcactttcaatcccgagtgcagacaacatttcctggaatatagtaggcactcaaaaaataattgttcctcaactagtaaatgcataaaaggaattcttctactgactaattggttagctaaactcctacaagtagcctttgtgaacaaggagaaaaatagtaccttatttcatcatatataacaaaccatacattgtaagttgtcattgattatgacacattactattttatatgcaaaagataaatcaagtttggagaatctgataggacataccctcctccccagacaaggctgaaaatcgtagtgtaaaatgaacgataattaaagctacaacacagaaagtaaaattaaatttgcatgtctcaatcttgtcactgaatagaggcagggaaaacaaatgtcctttgaatttctgaaaatttgaaccataaagagtgctcacaccaatctgcaactccgaattcataccaccattatgttcccaaagaccagagacataaagaggtcccaggttggctaatggaagaaataaatggcaaatcctatctggaagaactcagcttcagtcgagactcagagaaactgtaatacagagctgctaatatgagtcttagaatccataaaatgcagtgtttagaacactcccatatgtcactggacaactggaaaagtcatctagattatgtttaaggagctaagaatggggattagttttccctttgtcagcaaagtccatctgtagccagtgacatgcattttacaacagtcagttgcaatctccaaattcaggagtgtcgaggttattcatagttccattttttttcctcaaaaaagaacagggtgatttaaaagtaaaatagagaaacctaagctgaatttctggcttaaacaagaaatctcttaggatggaatattttactgagatttggagtatatgttgcattagtcgaagccaaaagaacagaactatttccaaggaaggtaagatcatgtgctggtgtcctgaggtgggaaaagcatggcctgactgagttgttgaaagagagacattgtgcctttagaataaaaagcaagtgaaatagcactgcaagaagagtttgtggacacaggcatgccctagatcaggcaagaattctttacatttgtttaagaacagactctatccccagggcatgaattttaatgacaggaatgaaaaaagaggatttccattattttcaacatgtcctctcatctttccttataatctgggtaaatattgtctcctactttctgaaatgggtattgaactaaattttaactcacctttctttcctttaaccccagaatttcactccacaattagccaatacttctcaatttgattcaatagataggattccttcctttttccaatataagaaggttttctgtttcctaattataagtttttttcttgattcagcttccatttcttttaacacccataaattctttctgttttagttgctacgattttcaaatatttggtgtgtacttttacttccaagttctatcctgattcagtatcatctcagtttctgccagctttcatctgactttaaaactcttctgaaactacctgctcatcaaagatcaaaatgtgcttttccaccagatccagtggctttctctcatctctcatctcctgcttgctttaaccttgtatgttgttgacaatctcctgcgactttcttcaacaaattttgtccttcgttggctaaactattgcactttgttatctttctatttctcttcttccttttttttttttgagacaaaatttcacttttttgcccaagctggagtgcaatggcattgatgtcagctgactgcaacctccacctcccagattcaagtgattctcctgcctcagcctcccgagtagctgggattataggcttatgccaccatacctggctaattttttgtatttttagtagaaacggggtttcaccatgttagccaggctggtcttgaactcctgacctcaggtgatctgcccgcctcggcctcccaaagtgctgggattacaggcgtgagccactgtgtccggccttattctttttacatgaccttacttctttttcctctcttttccttgtcttagttcaacattctgcttctctatatccgaagaaagaggaaaaaaaaataccttgctatcttccccccaacagacatactttactaaaagatgttgtgctcttctattattctcttccatcatttaggacttcatttcagagatcctgaataaaacatatagataatttcatgatctggaatagaatctgcatttgtgactaacaagagaggttgtacaaattataatttctgactccttgttttctcactagaccatgtgctttttgaggatcaacactgtgcattattcataattgtatctacaaaacttggcaccttgttttccaccacagagtagacagcatatattttaatgtgcataactgtcctggtattatcttaaatctgttggatgtgtgttttgtgatagcataaatttgtttatgtgttaacaaaacacacacatactcttttctctctttctctctctctcaaacatacagagacagagagagagaaagagaacagttctcatcatcattaagccattttcgttggaaatattttcagaattaaccaaggaaaattaaccttcagattagtggacttcactccatgcaaatggtaaaagtgaaaatatgattcaaatttttaaaagcgggagctcagattgcttaatgtctcctttattctggtttacatagtagctccgtggctgtgcactgtaagtacaattatgattaatttccaagcataagcacttgttctcaaccgaaccattattttcttgcagaaaacaaagaaaaacttcctagagttctatttcttgtgtcaaaatcaaccttaactttagttcactaatcctttccaagggccccagctgatctatttaatttttcttttaaatgctatcttactagagtatttttttcatacttaggtcaaaaatcattgtaataaaaaatgttctacaaatattgaattacatgataaatttcccttggtgaatctctactgtcatccattttgaacgtcagaaattcctcgggcaatctggaaataaaatattctggtctgcaggctgaacttcccataaatgcaagctgtcactgctgtctcactctgctgatcagccaaccatgtcaagcaatgctgtcatttacttaagagaaacaagcaaacccttcaatcatgttgtttctgaaggaaagtagaaaagaaaaaccacaacattttctttttccttctttggcctaggatggtgaagcaaaattagcttagaattatagtaataataacaacgtttgctattttactgttgcaaatactttgtagtattaaccatttaatcctcacgacgttctagtagatatcataactttacctattttacagatgaagaaaatgagacattgagaggttatgcaattggcccaagtaaaacagctagtaaggggcagagcttgaattcaagcagtctaaatttaagagcacaggttcataatgctatgaggatcaatacaattctataatgggtgtattttaggtcatagatttttataatatttaattccatttaaaattaggaatttgaagaaaatgtctttatttcttttaatactaccagaaataaattatttcccattagcttcaaaatcctttgctcattttaaccatcctgataggtttcaggtttgtgatggttgttgttgtgtgtgtgcctttaagataatcatttttaatgccatatgtccaacttatgcttactaatttttatcatttgcactcacagccatcaaatctaaagccttttcctcctttaagctagtctcgttagaatataagagtgagcacttatttaggtcctactattcaccagacactattataagccctgtacctgatccttaagccccacgtccatcgtttgattaggcatttttattatcttcattttatagatgaggcttagaatgggtaagtaacttgtccaaatatacacagctcataaagggcagagttgacactacaaaacctaggtgtcttccgccctgaaagcacgtcttatttcctccctataaaaagacgtgacctcaagagtagtatcccaaatatatatgtcaaattttctacattataattttagagttatatttccttggaaacaaatttgattcccaaaacatattttggcaattctgttcttgaaaatattttattttacaaaaaataagataagttaaatgtatcatcatccacatttttctagcatagtgtagagaatttggtttcaaattttattagtgaaataatcgcaagtacctcctttcattaaagaagagaaaaagaaggatgaagaatgaaaggaaagaacgagtgtaaccattgctgattttactgtggatttgataaacattagtcaaaaacacatgtgataagccacatattattaaaaatgcaccatataattaatgctattgcattgtcattttgttacctagcatcaactggctcactgcccaaggtacacagaggccaataccatggcaccagctttcgagaaaagaaaagcattattgaaagtcacgtggcaaggagacaggaggaaatgctcaaatctgtctccctgagcgagggttgggtctgggtgatgccgaagttcaatctgattggatcctggacactgccatgcagtgtctgctccttaattcagcccctgctcctaagtctgagcactcaagttccccttgtggtagcacacttaggttcatctgggcatgctcagattatgtgaccttcaaccttggaatccatgtcaactgataaacaactcacagttttattacataaaagttgaaccggattggtctgatgtggctacagtttactacatggaaactgagtaaacgatatgaacatagtggtgctggtgagacaaatgagctctttagaatacagacaagattcctgagcaccccttttctagacacagccttccaatctcctaagcatcattctttacccatgtatgcaatgacacggtgttctgtttctcaaaggaacacacatattttactgctttattaagctgcttagttcagatgggccactaaagtgaccaattaactattaatttccttgtataagagatggctgaaggtcaatcctgagagcctaagcactccttaaagtttccctttaattctaacaaataacttgtctgtgaggcacacagatatttcgtcttttgaaaactagagcagacgtgctttgcacagtctactggggaaagaaaaatgtgcttgcttaacatgaattgcttgtaggagcagatatatctataatgcaatattattgagttaaatgagaaggacattattttttttttctttctgctctgttatgagcacagggtagggaatttggtttaaggtctcattatttggcaaaattgcaataacctcctttcattagtaagagaaaaaggaaaaggaggaggagaaagaggaggcaagattgtaaccattgttgatttcactgtggacttgttaaccattagtcaaaaatacatgctgataggccactgagctctgctagtactaataatagtctttctcttttctcttcttcaagcttcatgatactttcttgaaatacgcacacaaaacttactgtccggatacctagcacctctgagcctgagctgtctatgattagagtcagtaattatgctgtgagataatccatcatggtgggttttgtttgtggctcgcgataattaatgatgattccgcagaacagcagttacgcaatacagaagaaattcatcttctaaaggtcagcaaagagttgaagcatgaagtaaaataagcccatagctgctagctattttttaccaatcagtctttgtgagtttgttttttattttgaaaggcatagtgaaaatgttcataccttaataaggcattgtctgaaaactaaattttttgtttccttagaattagatagaattttttaaaagtttcttaggaaaagaactgattttgcttagaaaatacaccatcaggccatttggtatatgaagggaagggtgtgaactcacactagcacccaactctcacctcactcaaagacatgtaactctacaaaagtagtcagtaaaatttgcgggtgtggactagggtgtgaaaggaaagagtgtgagggaaaagtgactgattaatttctatggcaagtggggttaagggaagatatggctatgtataaacccactctctaaccagtcaacggtcggcacactcagaaatatctctgtgggggccgggcgccgtggctcacgcctgtaatcccagcactttgggaggccgaggcaggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggtgacagagcgagactccgtctcaaaaaaaaaaaaaaaaaaaagaaatatctttgtggggccgggtgcagtggctcatgcctgtaatcccagcactttgggaggccgagacgggtggatcacgaagtcaggagctcaagaccatcctggctaacatggtgaaacccagtctctactaaaaataccaaaaaattagccgggcgtggtggcggacgcctgtattcccagctactcgggaggctgaggcaggagaatggcgtgaatccgggaggcggagcttgtagtgagccgagatcgcaccactgcactccggcctgggcgacagagagagactccgtctcaaaaaaaaaaaaaaagaaagaaaaagaaaaaaaaaagaaatatctttgtgggtacaaggaaatagggccacatttcaaatttgggcacaaaagggggaaacggggacagggatgtcaaagccaggaatgaaatgtcttcccaagaatccccgatgatattaggaagcacatcgaattagccaccactgcttgtgggtgttgaatcaaaatgcattgaagtctaaaaagatgaggtggccccagctacaccttgaggttattttgttttatgtataaatgatttaaagttctgaaaatcatgttggtaatgacagacacactgatggtgacagtcatctcagctataaaaagcatcagagtaaacatgttttctagccctggttgcattaactaaagtagacacgttggtgacaagtcatttcaattctctctacttcagtttcttcaccttaaaaaaaatcatgcttaaaacttggtgataccatgaaatttaatatttaatgtaagaatgcatgaaaaagcataaactgcttattgagtgctactttgtgccagatcttattgtaagcagcatacatgtattcgatcatttaatcctatctcatccacacaagcatcctatgaggtagatactatgatttgtttaatttataaatgaatgaatgagtactaaggcataagtttcacagagagtgaagggtcaagcttttggggcagtatgatgccttcttttattcaataatcataaaagctttaatttttttcttttttaaaatttttatgtatgctctgttgaacatatttatagggtacatgtgatagtttggtagtcatacagtgtgtaatgatcaaatcaaggtgattgggatatccaccacctcaaatacttatcttttctttatgtttggaacatttcaaatcttttcttctagttattttgaagtatacagtaaattattgttaactgtagtcgtcctatggtgctactgaacactagatcttattccttctatttaattatatttttgtcccttctttaagcagcccctctttattcccccatcccctcaccccttctcagcctctggtaaccaccatttattctctacctccatgagagtgaaggatcaagcttttggggcactgtgatgtctttttgatgtgcctaattggataggccatagtctgcagttattcaatccagcactaatctaagatgttgctgtgaaggttttctatagataggattcaattctataagtgttgactttaagtaaggtaattatcctagataatctggctggcctgcttcaactagttgaaaggccttagtagcagagctgaggcttccctggagaagaaattctgcctgaggacagcagcttcaactcttccccaggagttccagcatgcccttcctgaagatcaacccccacaattgtataatccagtttcttacaacacatctcttactatgtatcttctactggttctgcttctctgatctgtaccctgactgatacagacaggagacctatgtacttcaccactgggctattctgccttccatcacttcagcctcaacctttccttcctccccttcaatgtattttaaaatgttcagaaatacgttgctttttagaaaagaggaaaacaaccatgattaattggctcagccaagatcacaaagttagtgtaaatctaaacaaagtcaggctgtcattttgaagaattataaaaacaactatgatggccagtattctacagcactggcacaactctctcacccttggcatcataggaagacccactagagcatactctagatttaatgctggacagtagcctcaattagatcacagaactgacgcctaagaagatacaggcatctgtttcatttccctcaaggggcaaaaggcatcaactttactgcccatacacgatcattagcatttcccttcacagctgtcacctgaggagcatatctcaaggaagcggaatgttgaactggagggaatactctgtcctcactgaggaagttcagattgcccttgcctttattttcaaatgctttgctccagctggctggcctttttagtactggctaacagtgagtgagttatagcagctgcttgtcattcatgtattaaaaactaagcatctctgtctttcaaagtcatgtgaaggaaacagacaggacccaaacttcctagtccattaatggccccacttatccataagcacacactttgctcaagtatgtcgtcagaactcctaattataatgctataaattatagcagagaattaaaggcagctatagaggaaggaagaaatatgaatattactaaaatgagaaggtaattaagttaccctcttccctctgagccagctctggttgtttaaaataagtcctaataacagtgttaaatgaactcaaagcacaaatgaatattaaactgacctactgcagaggttttatacatggcctgttaaggtcgttttcattaccagggagatttgagtcattcttaagaatgtgaaaggtgaatgtgatggttaattttatgacaactggattgggccacagtgcccaggtatttggtcagacattatcctggatgtttctgtggtggggttttttagatgaaattagcatttaaattactggactttgactaaagcagattaccctccataatgtggatgggcctcatacaatcagttgaaggcctcaataaaacaaaactgacctccagcccctcacctctccaccccctaccccacaagaagaaggaattctgccagcagagagcctttggactcaaactgcaactcacccctgggtctccagcctgctggtcaactccatcagattttggactcatcaagcctttatcattgcatgagccaattcattaaaataaagctgtcttatatatatgcacatacatactgtttgttctgtttctctggagaacactggctaacacggtgagtaaactgactacactggaaataacaagatgaacttcaggaatgcagaagataagaacccagttacattaatggaatagttactgcttaattttaattataatattctttgctagcattgtgagactttagtaaccaaacccaaaagaagcaattgttatagtatatgctaatatatattcaacaaataatggagtgctcatggccaaaaatgtctcttccaaagagcacatgccaatttcagggccactaaatgccaagctccagtaatgttccaggactttgggcacatatccagaaataggcaactagtcctagaaatccaggaaatcaacaactcatgagtctagctaatatttattgaacacccttatcacagggaggcaacaatggtgagtgggtgaatgacagcaaaacagtccctgatgtcatggagctcagaatctgagggaaaagtggatcatgcaaatgtataaatggagacaggtgctaataagaaggatgcctgtacttaagagaaacctgtagacaggctacacagagcatggtctacaagccagcagcattagcatcacttgggagctacttagaacacaggatctcaggcccctttctagacctgcactttaataagatccccagataattggtgttcacattaaatttgagaagcagctggcttaagggataaagaaaactgctttactgtggatagtatatttcagttgagatctgaaaagaagagggatcatttctataccctctgcatgtttactgctgggcttcacagtgactatgatcatttctataaggcagtcattattgctaattgcgaaatatttccaattctcttcccagacatcttgaaggactgcccttccctaaccccatgaagctggatctgacctagtgactagttctggctaggtgaatatgatcagaatggacctgtgtcacttctggtgggatttttaagactcattatagtttgtctgctttctcctttctgccacgataatcggcagtgtatagttagtaacagctcagtcaacgggaaacctggagcagaaacgtcaattcacctacaattaacatgggccttgaaagagcagtaaactgcatcatactaagcctctgagatagggtggtgatttgctcctgcctaattggtatactctatcatcaatggattcattcaattggtacccagtgagtgcttatgaggtgtccagctaatccaggctctggggattctgtgatgaaattagccagacaagaccctgctgaatcttctctttttctagagaaagctgggcaaataagcaaccaaaaaaataatttcagatggtggtaaaaagtaagaagaaaatgaaacagactggagagattagacaggggatgataaggctctttcaaaggaggtggtcaggtcaggaacagcctcccttctccaaggagctgatatgtgacctggtacctggataaggagaaatctcagccatttgaacatctggagaaagagcctgctgggcaggggagaagaagtacaatggcccggagacaagaaaaagcttggcatgagaaagtaatggaagcacaatccttgtgaagcccagcagtaaacatgtggagggtggagaatggtttaagatggggctggagaggcagctggaaatctgatcccagagatttcaggtctgttcagaggtttgtgttctattctaggtgcaatgggaatatgtgatctgaactataatagtatcactctgggtactatattcagcataagcttgtaacaagaagagagcgagcacagtaggagaactaaaagaaggctaatctaatgggggttacttaaaagggcagagaaatgcaatcggactaccagcctagaaggatagataactggaaatactaatattaagtgtatagcattaatgactaatgtcacccttctgttcaccagatacttgatttcctctcctttccccatgtactgtatattcaacccctccctaagcgggacaaccccaaggtcccactagtcggaggatcagctctgagttcaagatctcctggtgacatatcctagtccctgtatcagagaataatgtggtggtttctgtatcaggtttggatgtgatttcacttcatccagaaatctatgaactaaaaaggtgacttggctaggcgtagtggctcacgcctataatcccagcactttgggaggctgaggcgggtggctcacttagggtcaggagttcaggaccagcctggccaacagggcgaaaccccatctctactaaaaatataaaaaattagccaggcataatggcacacgcctgtagtcccagctactcgggaggctgaggcatgagaatcgcttgaacctgggaggcagaggctgcagtgagccaagatcatgtcactgcactccagcctgggtgacaaagtgagactctgtctcaaaaaaaaaaaaaagaaagaaagatgacttacatgcccaactgccacctgaacacacatccacacccaatatgcaactgcagaataaatacataataattctaaagagattcacattcagaaaagggaagaatatcggctacatggcagacatttgatagcaattctggaatctaggcagtgattgtgaaggtttactaccttaggcacagagaatgttcccgtattaaattgcagttcttatgtcttggaagggttctcttgtccagttttccaaaattcttgactccatcctctaagatgttcttcctttgagtttcttctgtccttcaatctggaatgtatattaaaggatcatgcacttcaacatctactcattcataattctttattttaaaatttcaaacagcctctgtccctttaagtttcagcttgtgattcatttgacagtacagttctctgaagaccttacttaatttcttcaatacctacatttcttttccaaacatacttctatttgctacttttgctttataacacccaaatctcttgtctcttttcctctggacataactaaggtatgttggactatccagtttaggtgagagagccattttgtccaattaaaaagatttaggcaccacgcctttactaggtcatggatctgagtcaaagattttaacaataggtgtgacagtcatacctagaattcatacttgctgcaagagtaattctcaaagaccttctcagcttcatcttttaaaagggtaagattccttactgcaaatcctccaaactagactctctttcttcctacatacaaattggccggttcttttgtaagctcgttattgtcttattagcaccctgacaaatgcagtcaacaataaccaaaatcaacttcaaatgcactttaaaaactaagcacttccctagaacagggtttggcaatcctgtagtccaaatccagacaacaacctgattgtgtaaaaggggaactaaagattgtacaaacaagcaatgaagaatgtgcaacagagactcatacagtttgaaaagcctaaaatccttactgtctttctctttacagaaaatgtttgccacgtacttacctagaagtacaaatatatacctcccaggttaacctaccaccaactaagctctcatcccagaataacacgagctaacctccttcttacttccaaacttcccttgccacctactaatcattaagccaaagccacacattttaggttgttttaaggcaacacctccatttcttggtaccaacagctgtatccatcggattaggctagggcatgctgcgggcctctgcttatcaatctctctagaaccacactgatggatatttcatgccattgcaagcttccatgagcatcataacaaggaaaaaatgaacttagcaaattgtgcactgcctcaaatcttctgcctgaaaatgacacattttatttgccaaattaaggcacacagccatggttaacttcaaggtatagtggtttacttaaaggtagccatggtttactttcccctggaagaggaagtaaaaaagaattgatgatggttgctaatagctaccacacctgcagtcccattccacaaaaatagcctccattaggggatggtaaaaatattttcactttgtttcatgcatatgcataaatattatcttcctctaacattacctttcacataataatcattatatgcattcatacttatagtaaagggcagggactatgactattttgcctatcataagatagagcacaaggaatggaatgaactcaactatttattatattaatgaataaataaactaatgtcattatttctatgttacttgtttctatgttcattctactaatgatttttgttatttttttacaaacatttgaaccttttattcctcatcaccataaagaatgaaaattaaatagtgcctgtaccctttcacctcctagactatgctaagtatttaaacagaaaacttttttacctctgtccccttcttacatattctgcttttctttatttttattttgctgatctggaattttttatctagatttttactaactttatttcacattatgattcttcaatttttagaaatcattcttaatattattttaaatttgcatgtacaaaattaaccataattagatttaactataagttctatgccctcattgtctatcaatgtttcctccaattttcttgagctctttattttgatacattcattgtttgactataatacttcaaaaaaaaatttttcagaactagtacatggtgaatggtgtttctgaatctttgcgtgtccaaatataactttcctttgcattcacatgaatgatggtttgtttggatcttgaaatggagcatgaaagttatcagaatcaaaatggagtcaattgtgttaaaaactggggaagataaatacagctaggaaaggccatgaagggaagcttctcatgcacaaatgactgagaacaaaaactatcacaaaagattgcaaaacccaaaatctcacacaaagactgcacaaccttacatacacacacaaaaaaaattctgtgaggacgtctgcccagcaactgcttgttcaaccttggactaattccacccttgttattgacccttgtagtcaaggattattgtctcaaaacaatgatgtaattctcctcatttttctttaaaaaacttttgtcttcctttaccaccctgaatgagaacctagtttactatggcacacatattcccattgcaatgcctatttccaaataaatatcatttccatttaaagcatctccctctctgtttgttatttaggatgatgggagtcacagtccacttgcactccaaagtttgagaagcactagtctacgctgtatttgcagctcttgtggactccagcaagaattgtgtaactattgccttctagtgaaagccactgtatgccaggaggcagattctgaggagggtgaatcatcgtggatatagcagagaaaagcaggcaactggtggacaatctagtgccacctcacttcatttccaaagctattcccaccaagtttagcctacgagaatgataagtccacttgctgcgtatgtggagttcaggctgtgtcctcaaatcctctactcactcctttctaggctttccctatcatgtccacatcttccttcctctgccacttcatgtggggtagtggagcgactcctagcggaatctgtgttccattagcattacagctactcactgaaactattgcactctcctcccttctactggctccatcacctgtgttaggagctccctgtaccaagtcttccactttattgagtaaatagttagagccaaagggaacactgtgataaagcctgtgtcagctgccatgttgattttctactgctactgtcataatcacaaagttagcagttaaagcaacacccattttgcaggccagttctctgctctgggtttcacaaagtgatggacggggtgtgttcttttccagagcttctggggatgaattcgcttccaggctcattcatgttgttggcagaattgaattccatgagattataggactcaggtccggtgtccctgccagcaatcagcccagggttggttgttctcaggttttagaggctgcccacattctttttggggtggcatcttcctcctgcttcaaagccagcaaagacccttcacagtagttcctcgattcacgttagattaaatcagcagggagcaggaattttgtgggacatcttttgaattctgccttgtgcagctgcactatgcaaatgattaggaaaaactgcaagttcttattttgaagtaattttccaagtgcctgcagtacatccttactctcactcctgcttatcactgggaggattttatatggaaagcacttccctaactttttaggaactccctgttttgcctgtgatgaaccactcagcattttcccccgcattaaattacaatgacttcatttgaaacagaaatgcctcaaattttgggatctacttatgatagccttccctcttgaccaggactcaaagtctattttgccctaatgtgtctttggtcaataaaatggaatttggagagtttgagaaggtatatttgtaatttcaatccctgtctagaaagcatgaaaaaagatattagaaaaaaatgtgttgctcttgagtattattgccattgatgagttccacagtgctagtagactacattaggaatttgaatgaagcagaattgaatgaattctatttttaaaaaaatgaattgtacattacagctcacaagtatccaagagctaaatttgaaatgtcaaaggttatgtaaatcttatatgtttagctaaccctgtaatgagaaagactcccaacactgaagtctcaaatcgtttttgagaacactgaggagagaagccacataatttgagagtgtcataaccgggagtcctagaaagaggaagatcaaacagccgatgtgaatttaggccatgaagaggtttaatttaaaagctgagagcaaaatcacagtcctttcataattattataaggagatattgggtaccctcactctggcagacctgtggtgcctaatgaaaagagagcatttctctcctgcttggcttattttatccctaatcagcagcggtacttcaaattagcttcacaatctattggcctctctcagccataaaagcctcttttctcttttgatattagcatagctccccattgaaagtaacagaaaaagagctcctacttgaaggttatatccttccttgtggatggcccacttcaaagggttcatcacatggtccaaagagaagtaaaaataagatgaggggagtgcagcagctgtgtttctaagacaagaggttctgagctgaagaacaccacatcgattaaggtcagggcagctgggaaggttgcagttcagccaaaagagggctgaagtactgaacttgaaaactctagaacctgggaaatgtaagcattaaactcagagacattttatggaaaaaaaaaagttttattttatagattcagttctgtaatatagatattggaacattaaaatgatctgaggtattgacttcaaaatccatcatttggggtgttggattatctgttatttacttaactccattagcacccagctatggataaattgtgtgtaatagttgtgttttatgagatcaagattttaaaatagtgaccactgatttgtgtcctctatatcatttaacctctgttgtctcataaatgtggctgagggcaatgagcttatttaaggctaacctgcatattaatacttttatccactgagatagtactctcccccacttaactaagacgtttgagaattgccaaaaataatctacctcaaaatatattcacatatgcatcgtctaagtcaaggaacagagggctcactagaatggattggccctccaatgaccccaacagtagatgttgatgcttaggaaggatagatataatagttgaagaaaaaatttgccagttgaaacttttgtttgattttgccactttgtcagtcattgctttttgttatggccaagttaagttgttacggaattagagaattttggaatttttttgtaagtgttcttttaataaatgtctactcaagccatctgcccatttttatttttattttttgttttttaacttttattttaagttcatgggtacattgcaggtttattatataggtaaacttgtgccatggggggttgatatacagattatttcatcactcaggtatgaagcctagaacccattagttatttttccttctcgttttcctcctcccacactgtaccctccaataagacccagtgtttgttgttctcctttatgtgaccatgtgttctcatcatttagctccctctaataagtgagagcatgtggtatttggttttctgtttctgtattagttttcttctaaggataatggcctccagctctatccatgtccctccaaaaaacatgttcttcttttgtattgctgcgtagcattccatggtgtatatatactacattttctttacgcagtttatcattgatgggcatttaggttgattccatgccttttctactgtgcatagtgctgaaatgaacatatgcgttcatgtatctttgtaatagaccatttatattccagtaatgggattgctgggtcaaatgccatttctcatattgggtctttaaggaattgccacactgtcttctacaataactgaactatttagactgccaccaacagtatataagcatttgcttttctctgcagcctcaccagcatctctttttttttactttttaatagtagcctttctgtttggtgtgagatggtatctaattttggttttgttttgcatttctctaatgatcagtaatattgaatttttttcatatgcatgttggttgcatgtacatcttttgaaaagtgtctgttcatgttctttgtccactctttttatggtgttgtttgtttttttcctgtaaatttgtttaagttccttatagaagctggatattagacatttgtcagatgcatagttttgcaaaaattttctgccattccataggttgtctgttcactttgctgatagtttcttttgttgtgcaaaagcactttagtttaactagatcccatttgtcaatttttgcttttgttgcaattgcttttggcatcttcattataaaatttttgcccatttctatgcctagaatggtattgcctaagtcattttccagggtttttatagttttgggttttacttttaagttttaatccatcttgagttaatttttgtatctggtgtaaggaaggggtctagtttcaatcttctatatatggctacccagttatcccagcaccatttattgaatagggtatcctttccttattgcttgtttttgtcaggtttgttgaagatcatacaaatttaggtgtgtggcctcatttctgggttatctattctgttccattggtctatgtgtctgtttttgtaccaataccatgtggttttggttactgcaaccctgtagtatggtttgaagtcaggtagcgtgatgcctccagctttgttctttttgattagaattgccttagctattcaggctcttttttggttccatatgaatttcaaaatagttttttctagttctgtgaaaaatgtcagtggtgatttaatagaaataatattgaatctataaattgctttgggcagaatggccatttttatgatattgattctttctatccatgagcatggaatgtttttccatttgtttgtgttatctccgatttctttgagtactgtttggtagttctccttgtagagatgtttcacctccctagttagctgtattcctaggtattttgttttgtgtgtgtgtttgtgtggcaactgtgaatgggattgcattcatgatttggctcttggcttgaccgtttttggcatataggaatgccaataatttttgcatattgattttgtatcctgagactttgctgaagttgtttatcagcttaaggagctttttggctgagactacggggttttctagatacaagattatatcatctgcaaacagggataatttgacttcctctcttcctatttgaatgcacttatttctttctcctgattgcccaggccaggacttccaatactatgttgagtaggagtgatgagagtgggcatcctcatcttgtgctggttttcaaggagaatacttcagattttgcccattcagtataatgttggctgtgggtgtgccatatatggctcttattgttttgaaatatgttcctttaacacctaggggtttttgtttgtttggttttttgttttcttgtttgtttctttgcctgttttttggtttgtttgttttagacagagtctcactctgttgcccaggctggagtgcagtggtgcaatctcagctcactgcaacctccgcatcccaggttcaagtaattctcatgcatcagtctcctgagtagctaggaataaagacatgcaccaccaggcctggctgatttttgtctttttagtagacatagggtttcaccatgttggccaggctgagctcaaactctccacctcaggtgatccacccaccttagcctcccaaagtgctgggattacaggagtgagccagcatgcctgaccaatacctagtttattgacttttaaacatgaagagtgtttaattttatcaaaagaatttctccttcgattgagataatcatgtggtttttgttttagttctgtttatgtgatgaaacacatttattgatttgcatgtgctgaaccaacgttgcatccaggaataaagcctacttaatcatggtacctacactttttgatagataacctgctggattcagtttgccagtattttgttgaggatttttgcattgatgttcatcaaaaatattggcctgaatttttcattctttgttgttgtatcatggccaagttttgctatcagcatgatgctggcctcatagaatgagttaagaggcgttcctcctcctcaattttttggaatggtttcagtagaaatggtatcagctcttctttgtacatctggtggcattcagctgtgaatccgtctggtcctgggctttttgtttttttttgcattggtaggttgtttattactgactcaattttagaacttattattggtctgtccagggattcagtttcttcctggttcagccttgggagggtgtatgtgtccaggtatttattcatttcttctagattttctagtttgtgtgcgtagaggtgttaataatattctctgatggttgtttgtctttctgtggggtcattggtaatatccgcctcatcatttctaattgtgtttatttgaatcttctctattttcttctttattatctagataacagtctatttttttattaattttttcaaaaaatgagcttctggattaattgatcttttgaatggttttttgtgccccaatttccttcagttcagctctgattttggttatttcttctcttgcattgggatttgtttgctcttgattctctagttcttttagttgtgaagttatgttgttaactatagatctgtctaactttttgatgtgggtatttagtgctttaaattcccctgttaacactgccttagctgtgtcccaaagattctggtatgttgcatcttagttctcatttgtttcaaagtacttcttgtaggttattcaattttcatgtaatgtgatggttttgagtgaatttcttagtctcgatttctaatttgattgtgctgtggtccaagagattgtttgttatgatttcggttcttttgcatttgctgagaatgttttacttctgattatgtgatcgattttagagcatgtaccatgtggcaattagaagaatgtatattctgttttggggggatggagagttctgtagatatctatcatgtccatttgttccagtgctgagttcaggtcctaaacatatttgttagctttctgtcttgatgatctgtccaatattgtcagtgggttgttaaagtctcccactattattgtgtgggagtctaagtctttttgaaggtctctgagaacttgctttataactctgggtgctcctctattggatgcatatatatttatgatagttagatcttcttgttgaattgaaccctttattgttatgtaatgtccttctttgtcttctttgactgttttggtttaaagtctgttttgtcagaaactattattgaaacccatgttttttctgttttccatttgcttgttggatttttctccctccctttattttgagcttatgtgtgtcattacatgtgaggtgggtctcttgaagacagcataccaatgggtcttggttctttagcttgccactcaatgtcttttaattgggggcatttagcccatttacattcaaggttagtattgatatgtgtggatttgatcctgtcatcatgatagctggttattttgcagtcttgtttatgtggttgctttatagtatcactggtctgagtacttcagtgtgtttttgtagtggctgctaacagtcttttcttcccatatttagtgcttccttcagtagctcctgtaaggtaggtcccgtggtgacaatttccctcatcatttgcttgtgtaaaaaggatctatttctcctttgcttatgaagcttagtttgaccagacatgaaattctgggttggaatttctttttcttaagaatgtaaaatattggccctccatctcttctgtattgtaggatttcagctgagagttccaccattaaactcatgagctttcctttgtaggtgacctgacttttctctctagcttcctttatcactttttctttcattttgaccatggaaaatctgatgattatgtgtcttgagggtgattttcttttgacatatcttactggggttctctgcatttcttgaatttgaatattggcctgtcttgctaggttgaggaacttaccatgaatgctattctaaaatatgttttccaagttggttccattctccccatccttttcagggacaccaacaagccatagatttgatctctttccataatcctatgtttcttggaggttttgttcattccttttccttttttcctctctctgttctagtctgactgactttcttatttcagacagccagtcttgaagctctgaaattctttcctctgcttagtctattctgctattaacactcctgattgaattataaaattgatgtagtatgtttttcagctctatcatgtcagtttgcctgcttttctgtactgtctatcttgtctgtcatctcctgcattgttttatcatgacttttaacttccttgcactgggtttcaacatactcctatagcttaatgatcttcattcctatctatattctgaattctatttctatcatttcagccatctcagccaattcaaaacccttgctggagacatgatgcagtcatttggaggaaaagcagaactctggcttttgagttttcagcattcttgcactgattccttatcatctgtgtgggcttatctaccttcaatctttgaagttgctgatctttagttttttttttcttttgtcctatgatgatgatcttgagggtttgattgtagtataagatgaattcagccaactggcttcatttctgggagatttggggagaccagttctcaggtcccaactcctagactgcatgctctaactctggggaacttgtattgggccccaactttgttcactggctccccaaggtttggaatccactgcgctgtgaaggccaaggtgcagcaactgcagcagcatgctagtggatgctggggtacctgcctccctgtggcagctcaccacagtggcagaggcaatgcagctgctgggggcaggggactcctgttggggaatgtgtgcatggtggcactggaggtggtgttggctcaggggcagggtactggctggcacaggtctgggtgccttctccatgccccacaagcaagaatgattgccctggaggaatttaatagaccatgcaattaaaacctcatcatttcacaaactgaaaaataaaaatcagaactaaattccaaggagattaaatgcatggcccaaagtcacatggctaaaaaatggcaaaggccccaattactatatttttattcaacaaatacttactggcttttcactatatacaagacaccgggctcagtattcaacagagaaaaatgtgaataaggaatcactatgccctaaagaaagctttctccaactttttcatgtctcagtatttggtgttttgtatcatttctgaatccttgaggcatgtacatctagaaaatagactgagcatcctcaaatcctcaaattggattccttaataagagttaaagtttaaaatctaaagttagcaaaaagaaagagaaaaaatgtggaagaattttagatgttgcctgaagtcatggttttaaataaaaaagtatatatgatagtatgtgacccagaacaaaaaagtataatttgcttaacccaagaggctcatttttggctaaaaatatgtcatggtctgatgcttttaaattaaacttttattacttagccatgtaaagtatttgatttttgaaaagactttataatcaagtaattaacaaaggaatacaaggacatttataaaatgtgaagtgaagaaagactacaagggacacggtcaactttaatttctttccaattggaagacttttctttaagtcttgtaaattacatgcttctctctttgacttctctctggtacttccaggagaaaaattcgtgaagcaacacaaaatggtcatggcaataaatatttcttgttctaaggatgtgaaaatagacgtctattctactgcactctctcatttacagagccagattgggtgctactctcatgggtttgcattgctatctcccaggtaattcagtcctcctgtattttgggcttgggtgcattgagcaagcaatttcctattggttccgctttcttatacaaaacacaaagcatgcccttaaaagtaggggttagacatatattactccaacaggcactattctccacatgactcataaaactgatgggcattcctcagactcaaacagacaggttgcggtggctgcctacttcatttcacacatctcatttttataacttcagtcactttccgatttctcctgagtgatttctatttgagcaactgcttaagttcagtcataaagatctgctagcttcagaaataggctctcaaatgtgaccttcatttaaatgtgtaaggcaatttcagggctctctaacatttctgagtttaaggtactattgacaatgccaaatacaatgttcttgctttttatagccagtagtattcttcttcttctacttcagagttcaactaaagacctgaaatgctagatagaatctgtgcaagctttggttaggctcacaggatcaacttactactgtccttgtgttaaacacccggtctagctaatcaggtgtcctactactgaaaatgctataaccacctaatatttatcagaaataactaaaaaaaaataaacctccaagtttactgctctaagaaactgatctatcaagaaaatgtgctgtattcatgtttaacaatttattcaatatgtgttcatgattctacatgttaacaattattttgggttaagtgtacaatattttaataagtggaaatgtgtgattgtgttgacctctgacccaattcggcactgcttgatttgtaatagcacttactactctccctgctacttctctcgaagctgtctccaccttggagaaagataaaaggggagagggggagaaatgcctttagcaattcaattcaacagctattcagtgtgcttccaccatgttccaaatatggagtttaatgatagaatgcagcaaacagcagacgatggttctagtcttaaggagtttgtggtccaggaatggtcacagtcatgcacataaacaattggtccaggaagagtagaataaagggtaaaatagaggtagatctaaagaattgtggatacactggccagccacggtggccaacacctgtaatcccagcactttgggaggccgaggcaggagcatcctttgagtccaggagttggagatcagcctagatagcagagtgagacccccatctctacaaaaaattaaaaaaaaaagaattgttgaaaaacagaagaaggaggaaacaattctcaccagcagtgcagggagattttctcaaacagaggaaattaatagggttttgaaggcaaaaaaaaaaaattccgaagcagagaatgaaaattctcactgatgtaatagctggagcaaatgtgttgagaaggaaaagttcaaattgcatttaaggagcttctatacaaaagcgttggtggaaaagagtcatgcatggtcagttgcagctttatgttatgttttgtctctaattcatgtgcgtgtctttgtttagtgcaaccaagcccccacatagacatttttaatctcataatgccaggtcctcaggcaggctttcctaaaatggcctgttttcaactgaggcctacagggcgatttggcactggctgtgactggactgttttccagggtagtccaccctctagggttagaagatctcaaatagcctaagctgtgtgaaggcagaggaacatttcttttctgagaaaaataaattctcttttgcccagtttttagtcttttcttttaaagaatctccgttctttactaattactattttttttttttgagacagagtttcactcttgttgtacaggctggagtgcaatggcacgatctcggctcaccgcaacctctgcctccctggttcaagcaattctcttgcctcagcctcccaggtagctgggattacaggcatgcgccaccatgcccagctaattttgtatttttagtagagacagggtttctccatgttggtcaagctggtctcgagctcccaacctcaggtgatccacctgcctcagcctagtaattactatttttattttaccatcttcttttccatacattgaaagcagccattagcataaataattgtgctaaacttttcttgagctgcttcagtttctttgtggacatagaaaaagctctcctctctccccatctcttaatccatgatgtcacttctcagcttacatatcaactgagttaatttctgaggagtgtctagctctagcgatgttgaaaatatattctcccaccaatgttgaaaatatattctcccacccgtgatttcatggtctaaagtagaggtttctcagtaaaaggtcagatagtatacattgtagcctttttggagaaaacatactctggtacaactactcaatttgtccatagcaacgtgaacacagccatgaacaatataaaatgaatgggcatggctgtgttccaattaaactccagctatggacactgaaatttgaattccattgaattttctcatgtcataaaatgttatttatgtttttaaaaatcatttaaaaaatgtaaaggctggctgggcacagtggctcacacctgtaatcccagcagttcgggaggccaaggtgggcagatcgcctgaggccaggagttcaaaaccagcctggccaacatggtgaaaccccatctctactaaaaatacaaaattggcctggtgtggtggcaggcgcctgtaatcgcagccactcgggaggctgatgcaggagactcacttgaaccctggaggcggaggttgtagtgagctgagattgccccattgcactccagcctgggcaataagagagaaactccatctcaaaaaaaaaaaaaaagtaaaagccatgctaaatttgtgggtcatagggacaggacttgtttgccaggctacagcttgccaatttctggtctaaaacattgacagagtgggcctattgcttctgaagttgcttgcttctacagtgttatatttttctctatacactatctctgcaaatgatattgttctctgtcttagatgctgacttgtttgctgctgttaatcactccacctctattactcaacctgttattattatcatctttattatctattgtgcatagttcatatacattgcttatttaatcttgacagctgtccaaatggtataactaagtaaaacaacacagagtgttaaagaatttgcccaagattatacaattcttaagtggcagttacaaaatttaaacctatttcagcattgtaccagttctcttgaaaacacatattgtctccgtgtcttctcccaataattatattcttttccaaggtttcccttcatatatagctacctatgattacttttttttttcattttcaatgcttaccaccatctttgcagctggattctagtaattcttacctaattctattgtcactttgtaactgagtattggctttctaataatcacatatgagatgaaagaattaagcactttaaatttattaatttaaatcttaaaatggacactaataaaagtgaattagtaacaataatagtggcaaatatttttgagccagaatcaggactgagtttttccatgttttaagcttcaatatttctatgaaatgaatagtgttattatttacattgtgtagtttttttaaaaaactaggtcatagggaagctgccagtctacctaaggttgcagagctaataagaagtggcagagctagaatttgaactcaggcaatctcactcaaaagcatatagtttaactattgaactaagaaggaataataataatggaaaaaaggaaggaaggaatgaagggccgaaggaaggaaagaaggcatacaggaaggaaggaggggggaaagaatctgaaagctgtgatgaaggggaaaattcattggaaattaagagatctaaattatagatgagactctgtttttgagcagctgtatgaatttaggcaagtcacttcagcttctttcatcccctccttttttgccatttgtcatctgtaaactgaagccttgtagctaggtgatcatgatatcctctagttctatgatcctattttaaaaaagccgtcttcttttcttctcccccttcctgacagaagagcacttctgagacctcaaactttattatataagccctctttgattatttaaaatctgtaccctttaagtgaaatcaaagactgtcaaaacagatattttatgtctagcatggattgaagtgcatgattccctgcagaatgcaagggttacaaaacagtaatcagttgagacaaggattctttgagatgagtaagcatattacacagcagaattataatcagcagtggctaggctcttttacaacagagtcaaaaacagaatgaaagaggccctgagcatgcaggcacagaaaaggattccatgttactgacaggaactttagccttgctcccacctcagcagcatcttccttctgattgaagggacccttaggtgcccttgcctctggttctgaatggaggctttcccactgccaatacaggttatgaagggtaatggcaggtaatcaagcagaatctatcaattgttaatgcctgataaataataaaacctccccaggtttgttcctttttctgcatgaagagtaaacagcatccctgatgttctggaattctttgtagtattcttactcttattcttttcctttcttttgaaaatcacattttattgatttaatagattaaaaaaaactcccatgacgtacacttcatatcactttatacaagatgaattaaaaacagtgaagaacatacaaaaccaatatcttaagtccaatgacgtttagtgtgtataatctatatactgagatacacatatcaaagatatatctatgagataagttctgaataatgacttataattagaaatattaaaatgaatatcttatattggtataatactttatagctcataaattactttcatgtgtttcttagcaaaaaattgtttgtattctaattaaattgtaacttaatatgattcctttataaaattatataaattagttacataattatgattcctgcatcataacagagaagagtgaaattcagagcatgaagtcatggttgtgaggaaatataactattatgtttcaggacaagaacctgaaggtaaagatttgtatgacagtcccagtgctctttcccttcagccacagctgcctcagaggaagaataactccagagcaccagaccttctgagtcctcctgttcctatcaaattaactaccctccatttacctcagagtaactctagaccaggcaattcagggccataggataggccttccatcagacttcaagttatttcctaattagaacctccccctctgtttatgtcctgaagaggaaaggtaggacaaatcatttgatttcacaaaattaaaactctcagaacaaacaaaataaagtttgtgtgaccacggggaaataaaagacagatacagggaggagacacagtaatatgacagaatttggtgcacagaaatatagaacacaaaaccaaatagataatgatctggacagataaaaacatgaacagatagtgcatagagttctgcctaaagatttgttcttcgttattatttaagataattaaaaaaaagaattcttcttttagatcattttaacacagtttacaaaaatggtaacattttattgtgtcttaatatgatggagttgtatctcattaaatatttttaatgtggcaaatccttaatagaaagtagtatcatgtacaataagccaatggattttaatatatataacatcaagataacactataagaaagagtgaaatgaaggataagttcaaaaatagtaatgtgtctgtaataaagactttgtaaacaaatttgggataggtttttagataaaatgacaggatacccactagtatgtgaatttcagataaaaaacaaataggttttagtataactatgtcccaaacattgtgcttaaatatttgccaatatttgctaaatttggccatcctaactgagctggtatctctaggaaatgccagtagaagctagctttgccagctcaatgagtgagctgggtagtactttctccccactcaaaaaggctaatccatcattgagagatttatgattatgacatttaagacaattttaacctggtcagttccaggaagtattgcaaacagatttttatttggcctgaatgtgctccccatgagctaaggggaaaaaaattagaaaaaaaaatctgagccactcttgtgcactaaatactgtacaaagaggtttacgtttattatattgtctctgttgattatattgtctcaatctttataacacaactttaggaaaggtatgcctaagccattctactgatgaggaaaatgaggttcaaagagaacatttattcttcaaagtgcaaaacagggacacgaacctgtttcctgcgttcatttctcccatcagttcattttctgtaagcaatttgggagtttgttgagacgttttggccaaagtcagagactaatccacagcaaaacaccctcagagccaaagaaaccacaactctgagtaacaggctgtggtatctgtcatgtcatctaaaagatactgaaatttcttggatcattgtagtcagtggtcatagaacacagaagcaggcaaagcctcagatggccaaagctggaggagatatctattcacttctatgcatgtgcttcccttgataatgagaaatggtttatcatgtcattttaagtcaacattaaaatactttggtcactggaaatatatgcatccaatataactattttacttttttaaaccagtgtgccacagtggttacaataattctttcaagtcttttaattaaaaactttttaccctaacccttgaaaaaggacttgtatttatttttgccagaaatccatgaaaaagtaatctcatagatttactagaaatgatacagatcttattatttgtcaactggccgtaactacaccgtacataacaacttacagctaacgatattgcagtcagaaatgtaaaggaagaattgtcacagttatattcctgtagaatctagttaacttctagctagggacacataaattgaacagaatgaagcagttagtgagatactattcacaactaagcagacggagttatttttcccaaaataatatcaattaactgagagaattattctttattttaaaaacaaataggtggaagctggaagcagggattagctttttcgtgttagcagtttcaactgcaggcattacatagagcccattcctatgacttagaaaggaccacacattcttaaaaattacagattcactcatcttccagaaaaaaagtcatgcaacccagctccagctttgcgaattatctaaccatagatgcatctataaaggatagatcgctgtccattccttattaaatttactagaaatgcagacacatctatatctctctagttattagctatctcaatggcttaacaccatagtaaagaaaatcagaatctttaaaattaagaagtttgtatgtagcagataacagttgctcaccttcttataaaaatcattagagatgatggcgtacacagctttttatttctagattccagacttccatctacttcattcattcatccattcattcattcatgcatacatctagttatatgttcatttaggcaattaacatttatttggcaactaccctatatgcaggcctaactttagatgctagagaatacaagcaattataaacaagtttctggtctcaagaaccttcaaattttgtcatatggattaaaaaaatggtgtatgtaaaatattaagcaataatacaatcaattagatgacacacaaaaaagtatatgattaaatgctaagtaagtaaaacatacaaataatgggtctataagagagagaaattcaggtcatggaaaaggaagaagaaactggatgggtagtacctaaattggggagaatgctaaaggcattttaggaaggttaacagatggagtcaagactgaacatggaaaagagatgaacctttggtggctcactgggagtggaatggcctagaactcctttagccattgtaagcttcagtcattctgaagtacttttcattccacaagcatatatttcttttctctctcctatgcctttgctcgtgctgccttctgcatctgaaatgatttcattcctcaagctctccatttctcaaccctacccattttttcaatttaccattaacatgccaattactctatgcaacttcttgctcactctagctggaatgtaagtcatttatattcaaagagtgaattatcaaactcatgacactttttagtatgattgttaccttgtacatattgtaaatacctacagcatttaagatatggccttgcacatattaagcattctattacttgagttttcaaaaatttcagatatgtagaggaaaatactatggcaagttaatataaataaccagaaaaggagagaaatgtagaagggcaaaagtaaaaataaaaattcaccgagattcatgtatgtatattcttatttttgaacctggataataaaatgccacagcaagtcatttagtgaatctttttcattagtttaaaatttgactaatccttgacatttcttcattcatttttcatgggcttttctactcaattatagaagacataattgctaatattatataaactgagccaatacagctctcaggagagatctatagaaaatgtatcccctttttagcctctttactcatttatctgttcactactgcttatagtgagatcaattactgtaatatccaaaggcacattaaagaaccgagcaagaattgattaccagtgtgaccagaggataaagattctcagctgtactttgcaaaatggctcacctgaagatggaatgagtatcttcttatttgctttcttctatgttcttaaactaattcttctataaccatctcatccacccatccttcacccaccaccactgctccacattttaaaataccaggtcagagtaaatcctctttttgagtcttcaattgaataaaacattaatcatttctataactcagccaggcgactttagaaaaaaaaatatccctattgttttcatagcacattagaatgaaggagcggggatgtctacttctggcatcatatttttctccatccctttgtctcagtcagtgagaggtgcaggcagtcaataagtagtccattccctctgagacaccagatgctgtatgccatctgtccaagttagatattaaacataaggataaccttgcttaggtttcaccaaagagattacttgagagtaatcaaattcaaagtctatgtttaggcactggattaaatattcaaaataattagaccactatatttttttaaaaataagcccttggagagtaagtttggagagcaaatctgtcctcctcatgcagaaagcttaggggaattcatcacgccttgtgctctcatggtcccactgccagatccaccaaccaccagcctctgcagccacaccacctgccttctcccctgtaaagatccctctgggatcccatcctctatcatctctccttgctctattgtggtcctgcaacatcagcaggacctgagcagagcctcagacccccacccccactcccgccatgaacctactaaatcaactaggtccccaagtgattcattcatacagtaaaacatgagaagcctggctctggtgttcatggaagctttgttattcaatactaacctttttctccaaaggaatctacacacaaagatgtgattctggtaacttaattgttagctataaaggtgagaatgcaagttacttatatgattctattcataaaacagtatgtacaagcaaatttccatgcaagaaacttgagaaaactagaggaaaacactatagaaaaagaaagtttattttatttttaacttattaaaaccttgtgtatcaaagcattgagtgaatgaattatacctattcctaaatacagggctaggacacattgctttgtgctattctttgagtttctatggccctcaaggaatgtgttttttccttcaaaggattcaatcatgtatgtgttttcaatgaacttcaaataattgatattttgtttttaggcctcatctatccatggttgacataatgtccttttgtgttttacatgaaattcagtctcacacacataatacaattgtaataatataaaaattccttataggagcatcacataatcacattaccgtctagttcttacagctctgtgatgcaggtaacatcacaatccccattctccagggaaggggacgaggctctgagaagtctgatgaccaaaccaaggtcacgaagccagtaagtaactaagaaaccctatacataaagccagttttgttgattccaactcaatacataaatgtaatttttttcctaccaagtcagatagaatctggtaaaagagaagcttcttttacaggatctgtatttcacaaatttttgcttttggtctataataataacaataatattactcagcacttgaaaatttacacctgaaatttccatctgcaatatatttgataaaaatgtgcgggagtgggtgctttcattttaagtgggttgagaattagccctgttaataatttcttggcccggcacggtggctcatacctgtaatcccagcactttggaaggctgaggcgggcggatcaccaggtcagaagttcaagaccagcctgaccaacacagtgaaaccccgtctctactaaaaatgcaaacattatctgggcacagaggcgtgtacctgtaatcccagctacttgggaggctggggaaggagaatcgcttgaacccgggaggcagaggttgcagtgagccaagatcgcgccactgcactccagcctgagcgacaaggcaagactgtctcaaaaaaaaaaaaaaaaaaaatttcttgaagctactgaacctttcctttcatgatttctccaatttatgcattttaatactaagataatgtttgcaatgcatttggggaaaaagactttagcgcttggcagattgcagagaatgtcagttaccatattctcctttgggctggggaaaagcccctaaggaaaacaataaagtatgggacagtctcgggattataaatattcagttgctggctttttctttaaaagcaaaatgtatgaaatttataaccataagtaagctctaggtttacttagagaaactcaatgtgtatggcctgtcttaactattttccttaaagtcattttggtatttgatatttaaagtgaacggcaaatgtgttcctaggaatagaatacatttaaatactatttcctagataccttttgtccttgtattcacctggctttaagaattacttacaaaattacacaatttgattaaaaattaatatgactgctgtagtccaccaaagtggaaaaaactcataaataatgcacatggcaaactgtctaaggaataaccactaagttaaatttatggtaaattattaacaacctaggtagcatatgtgattgctactttgcccaagtttggaatgtttcttttatgaatttggaagcagtttccttcacataatctgaggtgagaaaccaaaacctatggtagcaaattggaggttgtaaatgtaccaatttatggtagtaaattgagcaaggtgatgtgcgtagcaagtggtagtgctgactggaaagattgctcaggttttcttcttgagaagaggaggaagttgtcaccatttgtgttgcttggacctccacttaaagagctaaaaattcaccttctgaacaacccaaaaatcccccttatttcaatattccgcccataatgtttatagagagatggcatatattccttcactagacatatcatgctaaatgaaaatgcacttttagtaagaaggctgtttatttcttaggtctgtgctccagcctctggcactcctgctccacaactctgtgcaggccactctgtcaaacacttcactatggaaatggctctccccagtggatgattggtataccatacttggatctgtgtggtgaactttccccttatggagagtacccatgattctagtgagaatcctaagctgctcccttcttaaaaggcatttctttttatatttaacttatttgtgcctgtgtcttgtttacctgccaaagacagacatccttgtctctctgtgcaagtatcagtgtgcacatctcattttttcccaactccctactcagtaacccaaagtcagccacaatgggagtatttacaccacagaaattagctcacactaccaattagaatattttgttttccagagagccaattgttaaacatgtcccagtatgctagtgttagaagttatatatgcttgtgttagaagttatatatccccacccctgacacctagaactcttcattctacttactctttactaatctggaaccaggatgagattatagctgaagtagtttggactatttatgttcattggtaatagagttattattaatatgaaaaaggtagactgtacaatatagtgaaagtagaattggatacggagttaaaatacttcgctattatttaaatttctgtttccaagcaaacttggacaagccatttaactttctccacatcaataaaatggaaagtataaagcttagcccaactacatcagaggattattatatgacttaaaagaagtctgacatctatgaaaacattttgaaaagtaaaattttaatatgaaaaacgttttgaaaatttgaatatcaaattgcattctttttttgacacttcaacattttcaagaatttcacatatcttatcatgactctgatatgaagacagatattattattgcaattcacatactgccagcaagggacaagatcttctaagttcttaatgctttttctgtggggtatgtgcccagtggtaacagccactcactcaactgctgatgcttcttgccctgtctctgtattcgtcaacatgttaaccacgccaaatatttaacagtgtcctagaaataaagaaaactgtatgaagccatcccaagtagagcatatgtaccttcaagttcataacattttctacatagtgtttttagtgttaaagaaaattagatgataatgtaaccagacaacatgtctttcagctaaagctcgtgatttttaaaaaaaaatcaaaaccaggatataaagtatacaaatattttaaggtatccaaatttgaggaaaaaaattacaaattaacttcagaggtataaggtatatccataaagaatgtcatgagagctcagactaagaagtaatgtgacaaaatatagaaattaaaataacagtgattttcttgtcatgaaggaaagtttagaaaaattgtaataaaaatcacacttagccaggaaaaaataacaaaaacactcaattccatggatttaatttatttcattttttctgaggaagaatgtcaaatagcttgaaaataagcccataatgaaactttttaaaaagtaacttcttattcttttgtcttggggcactaccaatttaaccccaaattctataccttccagaaaaaaaattcttattctgatatttaaaagactgactctttgtctcaattcatttaaccaagattttagtacctcttatatttatcacactggatcaggcccagtggggaatataaaagttaagaaagaagccatttctgtatcatgtcaatttgtaattgagtggtagattttaatgtgcctaataaacatacaacaataaaaaacaaataaggcaatattcttatgatggccataaagtgctatgacaactcaaagagtgaaatcacttccagttgcaaaaacaatggaattgactccttttcagaagaggtcacctgagcacatcacattatagtggattactctcatgtacttccttagacggaaaagtgaccaaatgcacttgagataacatttcccaattaaaacaagagaaaatattatttgcatatctctcaactaacctgaaaatttaactaaccaaaccatagcattccccaaaccttctggttaacttaattctactggaatattctttaagtacataagtgaatcattgatgtttattatattaatatgttcttgagaagggcctggcactatccctggtgcatatcagaactctaagagatttctgtagagggagtattgtagaaatacaatactctaagagagatgagatcaaaggcacgctcagaaattggcttgcaatacaaaactagtcaacattaaagaccaaacattttgtgctgaataaagggctgaaaacattcaggaactggaagatcagtgagcactggaggaggcaggaaagtttccatggaggaggacaacattatagctgagccttgaaggatggctggggagggtagaggatgggtattcccaggtcatcaccaacatgaacaatgctaccaagagtagaacacaaaggaaatactcatcaaacagcaagaaaacatgaatatctggacagagggttcatggggagaaccataggaaagaagattgataaataaggttgagaaaaccatgggaaactgtcacagaaatggcatttactgtggcagaaagcagtacacctaatgatatatttgtcagcatggccctgattaagtattgcactgggtctttgttgaaagcagcaagatccatgtccgtctaaagaaggagttatttttaaatgttacatgactcagactctttaggagtaccataaataatgttaccttaatagcacatggctcttctagtgaaaacactgctgtcattactgctcatgactcaatacctgtgatgctggggctggatgtctggagggcccacagagatggtcaggcaaggcagatgactctgcccctaggcttgaccaagaaccctgcctcactccccaaggccaccacttcttcctctacatctcagcaggtgcatctgatacagagacctaggtcacatacacttaccatagctgcaagggagtctggcagtactgtgatagtctctcatactctatgatatagaaaccagaaaaagacagaattatagcagaagctgagcaagacaatctaaattattgtgtgcacccaatttgataaaactttaaaaaataaaaagctgtcaacctttacataaagcctgaaatatgtgtaaatcattaaaaatatagataaggatatggtgaatgtaaatctttccttcaaaattgagagttgtattcagacatgcctatttaatgcaaaaagcgggattttttttagaaacaaaggtagcatatgtttattaccaattacttggattactcagaaatgtgcagaaaaaaagaccaaaaaaaccttattatttaactttcaaataatcactcttaacgcttactctctttgatgtgcatctgcttgcatattttaactcatattctataatttgatactctgcattttcactttctaatatcaagtatttcacaattgtgtgacattttgactatttgcagatttttgcaattataactatctctgcaattaaatatatattattaaatgtcttaatacattctagattttttttagataggtgaaattattgggccaatgcagaaaatctctttaaagtctcttgataaacattaacaaataactttccataaagcttataccaagttgtactcatatcagagatgtattcatttgaaagcacctttttggactcagatacttttatttttgaattattttttaatattatgtgtgaaaattatatgtcattgtttaaatttgaatttcttgtgttataagtcagttcaaattattttttaaacactttagcagcaagcatttttttcttttatgaattacctttgtttgcactcttattttttatgggaagtaggaaacctaagaaactccctcccttactaataagttgtataaaaagaagccagaatatgaaacttttagataatgagaaaattgcagtattctgaatacatcctgtggtggaagttaggattgtctataacacaaccctaaaattttataagtcaagacttcaaggcaacctctatttccttctacaatacagactttgagaccatgctcattggtagcctgtgaatgagtcatggtgatgacccagaatgactcatccaaggctgaagatctagccaaccagtctgtgtacaaggagaacaggtgaatattaaataagccaaaattgtaatatgaaagattaagcttacatataatgttacgtaagggataacaacactacgattggccaaaatatgcataaaatggaagaatttatttttagataattaaaatagggcaaatggaacagaagagggtatatgacctcaaattcctcccttctctaaatcagaatgctaattaagtctcagtgatgtctacctaatttttaaaatatatagaatttcagtcctaatgattattcagcattaataaattatgttatctattaggatttggaagtggagtctatttctcttatttcctaatcccacttatcagtaagttattaatttctgcctatctggtcttccaaatatcttgctaatccctgagtttacccccattgccccagccactggctttgtcctaatcaaggagactatcagcctcttcatcatctgtaccaacaatctcttcttaactggctctctgactctgccacagccctcatcaatatattcacaacattttagagagtgatctttttaaagcacaaattaaatatctccccactgcctcttgggccacatatagacaccttaactcaccccagtctggttcctccccagctttaaagcctcctctcactatgctccttccgcactcaaggctccacctatgggggaggtttttcatttcttcccaggtgttcctcaaaacagctgattctctgccttgggaagctaaggacagccactgaaaaactgaatcctggtaccaacactggagatttttggcttattgtatttggtatgaagccttggaatctgcatattttaaagctgattccactgtgcacccagtttgctattctctttgccttgaatgatgaaccctctgtggcttttaatggaattactttttattcagttataatgtagtgactgtccactatatgcaaatcactgtggcagagatgcctcatatgaattccactatttaaaataattatgacacagacatatcatttaacaattcctctgggaacaaaaaccttttcaatgaaattagcctgcgtactgagggccaagaagtattggtttatttgagcagtcagagaaggtgtatcagtaagcagctgcactatttctttttttttttttcttttattctttaagttctgggatacatgtgcagaatgtgcagatttgttacatgggtatacatgtgccgtggtgttttgctgcacccatcaacccatcatctaggctttaagccctgcatgcattaggtatttgtcctaatgttctccctccccttgcccccaataccccaacaggccccagtgtatgatgttcccctccctgtgtccatgtgttctcattgttcaactcccacttatgagtgagaacatgcagtgttttgttttctgtttctgtgttagtttgctgagaatgatgagtttccagcttcatccttgtccctgcaaaggacatgaactcattcttttttatggctgcatagtattccgtggtgtatatatgccacattgtctttatgcagtctatcattgatgcaactgccctatttctgtaaaggacttctcagtgttgagcatatgcaagtggaaatcagtgatctatgggggctggaagcttggaagaaaccagaaagcacaaggtctttaagcagagactggaacagcgtgaggaaagtagggttatttcctcatagctgagatctgtagacttgggagaagtccaccaaaggaatgtgctcccttacgtatgcattttgtattatttcttcctccagtgataaaatataaccatgggcttattaaagaaaattatttctgctttttaaaaactaaacaaatattgtacactgaagattatttaatctttctttgatgattccagaatattctgtggtcataattatgacttccaattgcttttggaaatactatgatatagtggaaagaatactaactgagcttggtcatccagtagcttcacagtctttggcaaatcatgcttgtgattcatctgaaaaataaaaataattctatgtacctcaaaaacttttgcaaaaattaaatgatagtatatagtgtgtccatcacagttcctagggcataaatgaaaccctataaatgtcagtcctctttatcttcttcctttacaatgtcgacataaaaaagtaggagatcaaaagcttaaaaaaatcagaacactgaacaacaacaaaaaagatgtaatgatttactcttgctaaaaacatccaggaaagattaaaaaacaatgacagaaatgatgtaggtgatcttttgtataactgattcattcatttgattcattcttttgtgtaactgattcattcatttctttctctgatgctattcagtttatcataacattttaaaccattttaatctttctatcatagatcttgagataaaatggaaaggataataatttttatcaaaggcataaatatatccaaaaataccaataagtgtgagatgcagcttcactgtgagttctgctttcattaattactatttgttagaggctgattatttttatctccctgagatttctctcatttcatgtttcttatttgatagactgtgttttctttctaatttatttttattttcaatatttttctcttcaagaaattgtaggctgggcactgtggctcacgcctgtaatcccagcactttgggaggccgaggcgggcggatcatgaggtcaggagatcaagaccatcctggctaacatggtgaaaccctgtctctactaaaaattacaaagaaaaaaattagccgggcatggtggcgggcacctgtagtcccagatactcaggaggctgaggcaggagaatggcatgaacccaggaggtggagcttgcagtgagctgaaatggcaccactgcactccagcctgggcaacagagcgagactctgtctcaaaaaaaaaaagaaattgtaatcttggaaaatcttcccaagtcattaaactttaaattctccatttttagatattaactaatgtttctcatctaaacaatttattatttattttgttgctccttggtcaatgataatgtgtgggattcaatcaacactaagaaaactctttgagaaattttcctagttgtagctctaaatttccagtggcctaatgtgtctccaatcactctagtttctatagtgcaagacttgatccaaaaattttgggtataatttttctatttacacatcactctcaaccattgagcttgtcatgcttgattttttctagctggcatttacaaaccttaaaagactgttttcctgttgtttcacataattttaaatatctaaacaaccttttgttcccataaaagatatcagctttattcacctttcaggcattcctaattttttgttttgttttgttttttatttctttctacacaacagattgatatggtttgactatgtcccccactaatctcatcctagattgtagctccccataattcccacgtgtcatgggagggatctggtgggaggtaattgaatcatgggggcaggtcttttccacattatacttgtgatagtgaatacatcttacaagatctgatggttttataaaggggagttcccctgcatacactctcttgcctgctgccatgtaagacgtgcctttgctgctccttcatcttccaccaccaacctccctgaccatgtggaactgtgagtccattaaatctctatcctttataaataacccagtctctggtatgtctttattagcagcgtgagaacagactaatacacagattaagagaaaaaaatcatcacttctgtaaatgcattttcactttcatggaaaggaaaaggagagatgttacttatcaataattattctcatagtaactggaaattatgagtttttcttacatgactgatttgtcacattgtatattcaataattatgctttttaattgtttcctctggactacacaattttaaagtagatttatattcaattagtttaatatacaaaacaataattcttcaaagatatttatgtcatgatactcaatcaacagaaatgtggctctgacctttttggttaagtgagtatcagtgaaattaaaattttccaaatgccttttttacagcaaattatgtgaaaaaaataaaaataagatatccttagcatttctgaaaatactggtttttatggagctttactaaccattatacatgttcatttagaccagcaatagaattgcaagttaggatgagaacataggtcattaccctggatgcatccctgctcatcacacccatgtctcatccttaactaaaaccaaactgctgttaaatcaggtggatgacaagcagcggagatcttgatcctctaagtaaatagaaatactaaataaaaagttggcatttcactggagagcagttgagtatgttaaagtaagacaatttgtgtacaaaataagtttaacttacaattataaatttttaaggaaaatcaaagttaccaaccaatacacaagtgaacaattggaggaaagcaatggattacaaggacaagtagattacaaaagaaaataatgttcactggaggaagggcttcgtcagaatgtaaaggactattgctcaggctttctacaaagagaagaaacaaagccgagaatggaatacgatgcttgcaaggtaactaggagaaagcatgagacaatcataaatatatcatattattaaaacttgcctaaaatactagatctttagacttacaacaggatccatgtgctctagcctattttaatgtttttcctgggtaacaaacaagactaatagagaacaattataacatgtttagtttttgaccatggttctttgaaacattcagtgcctagttcttcccaagcacctggatcaaaacccccatgacagcctggtcactctaaaccaatttaagactcctacagtctcatttagttgcaaatcacaggcttaattctgtaattcagctgttcaatcctatgtgacaatagaaactctctagtacatttgaggctggcattattccctaatgtgggcctatgacagaagaagtgcctacaaataaaaacttagcattgtcttctctatacttgagaaactcctccccatttgggaggagtttttattttttgctcctatgggttgttttgactgattggagtgaggctgatgatctcgtgtctttctgagcctgcccggtattcagagctgctttctctcatagtactattctgaattatttgaagacctcccacagctagagacttactgcttacagtcccttgacacaggcaatatcagtattccaactagttttggctcctcccatagcctctgagcattaggccacgaccagcttccttccgctgagatcccatctaccctccactcagtctcttggacaggatccaaggcttcctcttgtgggctttgcctcccacgtggccacacctcttcctttcccttgacaaattctgggagctccattatttaccaaattgcagctctatactctgctatcatgggctgacccagctaacattcaagctttggattcttaacgatgattcagacacaagctcactgtgccactcaaactatgtttgtgtgctttgatggagatggggaatgggagtcacataaattctccacatggtcgcttggaagtccagtttcctaaggaggtatcctcctgctcctccccactaaaagcaaagaggtgagatatataggacaactcactccaaagcaaccttcaaaattctttttctaatttccaatgactggtatctgtatgccataaatatggatgggaagtataaaggcatctaatcagtttcctcccacgccttttttgcaagttctgtgtcttggtcattctataacaaaataccataaattgggtagcttataaacaacaaaaatttatttctcatagttcgggaatctgggaaatccaagatcaaggcattggcagattcggtgtttagagaaagcctgctttctggttcatagaaagagccttatagctgtgcttccacatggtggaaggggcaagaaagctctctggggactccttcatgaggatcttaatcttactcatgaaggctctgtccttatgacttaatcacttcccaagaggccccacttcctaataccatcacactggggactaggatttcaacatatgaattcagggggacacaaacatttagaccatagcattctgcatggtaatgtttcatacctcagccaaaattttatttttcataaatgtatgtgtgtgtgtatatgtgtatctgtgcatgtgtaactaaacacagaattttaaaagatttcacaatatatcacaaacacatgtatacataaggttcagtccttcatagtgactttcacagctgtgtggtctaggaagagaaatgagtttattttataaataaccttctctcagagttgccaaaatgaaacaaaaagcaataaatttctcttagaaataagtccgcaataaaaacaggctaaaaagaaggagctcatgtaagaaacttatgtgaagaacagaaatgccataacctcaaatcctcactaagtccagggagacctgtgaccagatactataatcatgagagaaggcacagctacaaagagttaagatttgcagtagatttgctatgagcatgtgaaagagcattttaaattatgttccaataaataagttttgtgctttgggccagtggtgaaatattgatgtattacaaaaagaaaaagaaaataatttttttgttttctttttctcagtaaggaactattttttccttaaaaggatagaccaaatatcaataaagaagcagttgaggcctgtaataggatgcaagtatctaaacactcaagtgagttcaagtctcttgaaacaaattgtgtagcagattactgagaaaatttacaaatgataccaagaaacttccgtcaatgacctatgcataaggatttatcaaaaattagagaaattctgaaagtttgaaacaagtaagcagttttaaaaaaactaccaaaaattggtatttattgaatataatacaggttattaaaatcataaccttgtaatcatattgaaaggaaattggcaaccaaaaggggtaaccaaacagagtcaacatggcctccctgtttgactttattctgggtcaaagtaattgggtttctcctttaaatgtgatgacaattattgttgaagaaaaatgcagtggacatttctagatctcaacaagacaatctatttaataacattgttaaaaacaacatgaaggaatgttgaaggataatgataaaagaaagggaatttgtaacctgttaagtaactaatgaccaaaggtgctgatttgaatggatgtaattgtagagggatttactgattcacatgtactgaacacactgctgccagctttttactgaaggtaggattcttcagtttcctatttagactgagactcccagagctagtgtggtttacctggtaatgaggatagaaatgaggtcagccggttttccacaatcagccatccagtggacaaacaggtgacccatcccaaaggaatacaaaaaaggtgttctgatctcttcatcacttattactttgctccctgcaaaaatcattaacattcctgacatatggtcaatcgctcacccctgttaaagcaagtttctccctattgcgttgcaaaggcatacaaaacaaataagcatgatttctaaacaaagaaggctttcaaatataaatttgagatattatataggcttctccctatacaggcagtgtatctatggaaagaggagggccatacttcattttaaccgaaaatgcaacagtctgttaaccccgtttatttcccataagaaggaaaaaaaagtgttacatatgaagcttaaggagcctgaggcctcatggaacgtgtctcaaaatctttgcctgagaagtagaaatttagcaatatgactgaaataatagattgtattttcatttagagacaccatggctgtcttttcctcacatttctcatcttatttactaataaatttttaaagaagactgaagatatgtttattgatttacattagataaattgatttttcagtagtgtggagttttccttggtggggttttacgtcattagaacatagttcggtgagcctagacagacttcagatatttacatatctatgaagccgagtcattaatcatgcagaaaagttcaacatagagagaagttgctataattattggtggcaaacaattgaaatagattcatgctaacttgaagaaaggaacttaatttttggaaggctattcagttacagaatctaagaaagagtatagcatccaggccaacaggtcagagctgggactctgattaataggaaataatgggtaatttccttgagtcttgccatcaaggcagtcttctgtctttaggtaactcttcccagcttcaatcctaagaaagaaactctgatggggtgggctttagtcgcagtgttacactttagctatgctaggggctggtggcgatttctagttataatcggaataggacctcaagaaatggaggttccacgaaagaaaactattgccaggtctctttctcagaagtggggacaagtacactatgaaaagtatactttaaaatgggttcagtacctttatagtttgaacattgtacattaatggtaaggctctaattatctaattgggtaatggattcataagtgttcatttctcttatgtaaataaataaataaataagaataaaagagagccatgcatagactaatgaaaacagtgttttaagaattaaccgttatgattaatataagcctgaaatacaaaaataaataaaatcaaacaaaataaaaaatattaccctaaacatcagacaaaaagaaatcaaaactgagcaggtacattttaatactttggataatttatattttactatttctggataacaatgataaataatgaaatgatcaagcagtcagaaaattctcctaattcaagtcttcctgaactacttttgtaagtcaaaaatggcaagtttgtcttagcaattcttgatcttcagctcttttatatcaatattagaatgagtttctcaaatttagcaaatacatacacacgaagagacacaaaatctattggaactttcactggaattttattttgtttatacattattttcaggatactcaatatttatgccttcatttagttttcttattcataaacatcctatctctcacatctcttctcattccatctcatcctattttgcgctatctctccattgtcatttttaatattcttccttaatgcttaaactttctttgtagagactctgcagaatatgttagatttattcctgctgaagtctgaatgtcagttccccccaccccgaccccctcaaaatttttatattgaaacttaatatccaatgtgacagtggggcgggacctttgggaaggtgattttgtcatgaaggctgtagccttataaatgggattagtgaccttataaaacaggctcaagtgagctctctagtcccttttttgagtccctccctccatgtgaggacagtgagaaggcatcattttggaagcctctagaactgagagaggctgaataaatttctgagaaataaatttctgttgtttacaaattaccactatttcagtatagcagcaggaatgaactaagacaaattttaagacactttatagttttttttgtcattataaatggtgtcttttcctttaaattattttatttaaagtttattactcgtataaagacatgcaattgacttttctatggttaagcattttgctaagtttttctatcatttctagttatttttatgtatagtttttttggttgttttatgtatacaaccaaatcattttcaaggaatgatggttatttcctctaaatttgtatgcttttatttatttatttttattgcactaactagaatacccaagtcaatgtaaaccaataaaatggtaaaagtaggtatctttgtcttatcttatatttttaaaaaatcttataaatttttatccaatttagatgttccgtatttctttcttttgcctaattgctctgactacaactttcaatactatgttgagtaaaagtggggaaagtggacctctttgccttgttccagatcttagaagaaaggctttcaattattctctattcataggatattacctatggatttttcatatatcacctttattgttttgaggtacattccttctatgtctagtttgttaagtatttttattatgaaggaaagttgaactttatcaatgtgttttctgcctctatggagataatcatatggtttctgtccttcagtttgttgatgtagtgtatcatagtgatcagtttagatatgttgaaagatccttacattcctggaataaattttgcttgatcatggtgaataacctttctgatgtgctgttttattcagttttccagcattttgtgaggatttttgcatctatctttatcagggatattggaatgtactttcctttctttcttgtgtctttgtgtggtgttggcattagggtaatactgaccttgtacaatgaatttgggagaactccctcccacgtaaattttttggaatactttgataagaattggtattagttcttctttaacagtgtggtagaattcagcagtgaagccattcagtcctgaacttttctttcctgagaaactttttaattaatgattcaacctctttatccattattggtctgtttagttgttctgtatactcatggttcaatcttggtatgtcatatgtatccagaaatttatctatgtcttcctgattttctaatgttttggcatgtaattgttcataatactctctaatgatcctttgtattgctatgatatctgttgtaatgtcacctttttaatctctaattttatttatttgggttttctctcatttttttcttagtactctagctaaaagtttgtcaattttgcttatatttttaaaaaaccaactttttattttgttgatcttttgtaattttttagtctcaattttatttatttctgctctgatctttattgtttctttccactaactgggggtttggcttatgctcgtttttctagttttttgaggtacatcattagattgtttatttgacctctttctacttttttgatgaaagcatttcttgctataaacttctcatctctcttcataatctttttctgtatcccatagattttggtatgttttgtttccattttctatggtttcaaaacattttttttaatttcctttttaatttcttcatgaaccctttgattgtttaagagcatgttgtttaacttccatgtatttgaatacagtttccaaagttcctcttgtcattgatttatagttttattcaattatggtcagaaaagataacataattttgacttttcaaattttttgatttattttttggcttaacacgtggtctatcctagagaatgttccatgtgccaacaagaagaatgtgcactctgcagcagctggatgaaatgttctttaaacgttggttaggttcatttggtctagagtgcagtttaattctgatgattatttgataattttcttctggatgatctgtcttgctaaaaatgggatgtggaagtcttgtaccattattgtattgcagtctatccttttaggtctgttaatatttgctttatgtatctgggtgctttagtgttgggtgcatatatatttattattatatcttcttgccaagttgactctgttctccctatataatgaccatctttgtttcactttatagtttttgacttgaagtatatttcatctaacatgaaagtatagctactcctgcccttttgtggtttcaatttatataaaatatattcttctattttttctatttaaatcatgtgtctttatagatgaatttcttataggcagcatttaactgggtcttgtacttttatccattcacccaccctttatcttttaattggggaatttactccatttacactcactcttattattaataggtaaggacttactactgctattttttttttgttttatggttgttttgtagctcctctcattcttcttttcttactgcctccttttgtagttattttttctggtagtatatttcaatttcttgcgtttgctttctatttttagtttttatattataggtttttgctgcatgggtatataaaacatttatgtttttaacaaagttattttaaacggataacaactttattttgatcataaagaaaacaataaatttaaaaaaaaaaactaaaaatctctacactttagctctattccttccaaaattttgactttttgttgttccaatttacatctttttatattgcctatctcttagtaattttctctgggtatttactttttccaatgatttttatacttcaggtggattttttttggttgtatgttggtatccttttttgcctccagattgaagaactccctttagcattcttataagaccaatgtggtgatgatgaattttctcaacttttgtttgcctttgtgtttcaaggatagctttgttgggtacacaattcttggttgacagttttttttcctttagcactattagtatgtcatcccacttcttcctgtcctgtagggtttctactgagaagtctgttgccagacaaatcagatctcttttatatatgatttaattttttttctgcttttaggatcctctatttgtccttgaactttgagagtttggttattatatgccttggggtagttttatttgggttaaatctgtttggtgatctttgaccttactatacctggatatttatatctttctctagattttgtaaagttttctgttattgtgtctttgaataagctttctaccccttgctctttctcaactccctgttaaagaccaatgactcagatttgctctttttaggctatcctctagatttgtaagcattctttttgttttcttttttctcttttatttatttccaaattgcctattttccagatcactggttatttcttctgcttgattcagtctgctgttgagaccctctaatgtatttttcattttgaccattgtatttctaagctccaggatttctgtttgatgttttaaattatttcaaaatctttgttaaatttctcataaatttctgaatttatatgacaaatcttgaaattcaccagatttccttacactgctggtttgagttattgatctgagagctttcacataaacatcttattagggtcagtgctgtctcatttttttgtccatttggggaggtcatggttctctatccactcttgttttctgtggacttatgtctatgtctttgcacttaagggagaattatttattctagtctttgcttttgccttggtctttccagagtatgtctgtctgtgcaggttgactgatgagttcctttagcccaagaccactgcctcctttctggcattaggtggtttcctaagcccagatttgccataactcttgaaaaagttcagaatactgcacatctcagactgcggggatcccagtggggataccctggctgtgtaagaaggctagtttggagtttgtgcctggaatattcacagagcacacctttgacagcatagtggtcatgtacagcctctctaacttgctgtctcctttggctgagatgaaaagcagccacagagttttgcatgctggctcattttagcccaacttctgtttgtctccagctaccctcaggagttttcaacctacatgcacttgcagtacttcctatgggttggggcaggaatggttttcttgccaaggaacccatgatggtggggaaactggctgtctacctctattacacttttacctgtgtagaaaccatcagtccacggggacttttccacatgttgcctggcagtttgggggaggggtgtcacagttagagttttattcctcttaccttctgctcatgatttttcatttttctgtggcccctgggattgtcacagcctctgttgtgagttttagaatattgtttacggtttatttagatagtaagaattgttcaaaaaattcttcaactttaaaaattttctcagaagattctgccaagtaggcatgtagtgtttgttgtagcagtgacaaactaccacaaatcagtagtcagatagatctgccctattgacacacctcttaaaatcacaagtatagtcctgccactaatatgcagcctcttttcactacttagaaaaagcaaaagattaaatcttatccagcacacttttgaaggcataactgaaataactaacatgggttaaatccaaaagaaaggtattgcttaaattcattttcaatcaactcatcataatgtccacttccaaaacctctttgttaactgttgttaaaggcaaaattattctgcatttgttaaaatcgtaaggaagactttattcagacctgtcaggtctattgtgacaggtgtcaagactgttgtaatagagagggagattaggctcaactccaaatacagcaatgacagctggggatttatagccaacaagcagagtaattagaaaattactaacaagagacatcaagtatagggggattcttgccaaactgtttaacaggattcttgctgaaggaaagccatggtgatcagatatcaagggtgagaagattctcactaaactgagcagaattcttgttacagttgggctatgtaggtccagcaggggtggggttggggagagccaaagccaaggtctagttgagaagagggatcaaagaaacctgactaaagtttggtcaaggatagatccttgtcacttggcttgcatttgataaataatataattctcctcaccataaaaacaaaacttttttctcctcgctttgttgcccaggctagagtgcagtggcacaatctcgactcactgcaacctctgcctcctggactcaagcaattctcctgcctcagcctcccaagtagctggaactacaggcacatgttaccatgcccagctgatttttctatttttagaaacgtggagttttgctatgttgccaggcaacacttcgtggtctcaaacccctgacctcaagtaatccgcccaacttagcctatcgaagtgctgggattatgggcctgagccgccacaccctgtcaaaatagaagtgtttataatgtttgtagtacaggtgtcatccaggcatttctctaccaatgtctgagcagtgagtctgtacagtttatggttaagagcagcaactctgaaactaaatagactgggttcacatttcagttctgccacttactagctgaattaccaaggaaaatgacttagcctgactctcccacagattccttgtctgcaaaataagaattgtcataatacaaaccacaaagggggaccttaagagtaaatgagccaatatataggaagaatctgaacagtgtcccctacatggtgagccctagtgattttaaccattattatttgtaagcttttgatttgcatacagaacacaatttcttcagtggttttaatgaaaacatcttattctgaccatatcataattgtatatcttctgctgaacagcacaaagcacattacatgtttgtgaaaaatcttcatccaagttttctttttttccaattcagatctctttcaaactctttacttctttattgtgcatttgttatttgagatgccttaaggatcttgccttctaccctaagtgggatttgaaggcattttatctttttctggagaaaaaaaattgctgagttcttctgaaaggcattcttttgaaaacaattttttctatattgttctattggcttctattatttatgtccctactccttcatttcatgttttaccctgggtgatttcatgcccacatgcatgcttgcgcaccctactcaaaagagttgatgatcacatgcaggttttctctccttctggccttcttggtctctcctctcccctcatattcagagtcccaggcctgccagagcccagcaattctcttctccctctcccctccaagcaccccatcaaacaagattggaggcagtgctcatggacacaatcagtgctgaagagagaaagttgacaaagaataatggaagcagggaaaaagaagtcatgccacataatgcattttagccagttgaaaaagtttatggtgcatcctgtagttcagaaaagtgctttgaaagaaagattttcattcttgccagcccgacttaccatgatcttcctttaataaacacacaacaaagggtcctgtaggagaaacagctgaggctgagctcagtctgtggataaaacaaacagttcagagactgtcagcaggtgagctttgtttttgatgtgtttattctctgaagtgcctgagctgtcagcaaccagggccctcaacccagacagctcccctgcctaccttcccacagtgtggggaaaggctatccataaagcagggccctaaatgatctttaagataacttaaagacatactgatgattttgtacaatagcaaaataaaatcaggatgaattacaaagttaaatgttaaaaaattgagacaatagggtgttttgaaaactgaacagtcaaccaagaaatcataaaggtgtagatcgatagatttgatatatataattaaagggaaaaaatgtagatgaaattgactagaaaaacaaatgattgtaccgcattgacaagcaaagcactaacatttttattattaaaggagttttcacatttgagcaaaaaatgatgaacactaaaaggttaaaaaaagctggcaattcacaaaaaaatttaatgacaagtaaacatatgaaaagcattaaacttcactaaaaattaaagagtataaattactataatagatacattaaaactcatacatttggtgataaacttttctaagacaatttatattgttggcagggtgtgagagaaaaggagcattctaatcgtttgctggggagtgaaaattagaggaacatcttgagaaagcaatttggcaaactggaacaacattctaaaaaatgttcttatattttgattcacatctatttatttatcatgaagaaagcaaagatgtgttaaaacacacacacacaagcataaggattttcatttgaattctatttgtaataataaaaagttgcaatcatgaatgtacaagaaaagaggaagttaaaatagctatgtcttaaatacaatgaaatatcatggaaatattataaatcaagttttcccacccagtgtcaacagcaaaatgatatcttaacactcaaggaaaaataaaatacctctcaagtagttatggaaacctcaagctattttaactcgatcagttaaaattatccaactatgtcttgctgttttgattccaaatttataaaaactgattcaaacctgtattgggtagttttgtgttgttttgctgttataatttgcttctaggaaaataatatcttcaatttggaacatggaataagttggacccacttgatatgtaatttttaataaaattattaaatcgataatttttaaagtaaacttatattttatgaaaatgtattcaaaatatctgatttccccaaatgagtgctagaagaaaaaacaaggtaaaagcccatatttagcagtacaaccttagttatgttaaatatttattcaacaattattgaacattcaacaaatagttattgagctcccattgtatgccaggcactcttataggtactggggatacaacgaacaaggccagcaccaactgaaatatctgccttcattgagcctgcaacctagagagagagcaagacccttcttaataaacaaatgtgtaatataaaagaattttgggaagtgttctagggcaaaataagtcagggaagagaattggggtgtatgcggtaggaggaatgtgactgaattttaaaacaagtaatcaaaaatcacctacgtgacacttggtcaaagacctaattgttgtatggttgtgagaaagtcagcctgtggtctgggaaaagcattccaggcagatggaacgccgcgtacacatgtcttaggtgagagttttctgatgggttctgtaaacgtatagagattactgcggctgaagctgagtcaatgaaggaagaggaatgggctcaggtcctttggagtcctgcagccctttgaaaggaattgtccttttattctgagtaaaataggaaaagaagattctgagctcagttgtggcacaaactcagtggcttgcatttcaaaggaatccctctggcttttgggtgaatataaaataaagggagtcaaaattgaatgtgtgccgggtgaacaaggtagggttccaggatgattccaagggttttgacctgaacaacaaaatgataagagttctccattcctgaggaggagcaggttcggaagggacttttttgtgaacatattaatgtccaaattttggcacacgaacacattagatttccaagtagatgtgctgagtgggtagttacaggtatgcagatggacttcaaggaggcgcagtctgagctagagacaggcacaaagtcaacatacatatggtcttaaagtctattaacatagatgaatttaccaaaggatgagtggagaagacaggacgtccacaactaggcccttggccaatccatccaagaggtcaggaagatgaggaggaagcaaaggggcaggagcaagagcagcaagggaaacagaaggaaaaccagagctatcccggaaggcaggaaaagagcacttcaagaggacagagtgatcaactctgccaggtaacatgacagctaagagtgaattaggtaggtttaacaatcaatatttttccatgtagatttctgtgtaggcatgtagggttgggtgtgtttgtgtttgggtggatgtgtaaatggaacgccataaagaaaaacattaatagtggttgaacatgtattgcactctaagaaaaaaacttgctacaagtaaaatataaggaaatcattagaaaatttatgtaacaatgtactataagttattttcaggagcttagtagatttgatcattgatgccacttttctttttagtatactttaagttttagggtacatgtgcagaacgtgcaggttagttacgtatgtatacatgtgccatgttggtgtgctgcacccagtatctcgtcatttagcattaggtatatctccaaatgctatccctccccactccccccacctcacaacaggccccggtgtgtgatgttcccctttgatttaccattctttttacattaaggatgctacttttttatgaagaaaaaataatggaaacaataaaagttctggtggtccttgaggtaatatgagtgcctttcaccatccttccttcattagatcacctcattttgatgtaaatgataaaacaagttaccatgtgagatttatctcacagaacctctgtgtctgtgccatttgtgaaacaagattgttaaggggattgaatgagttacattatgtatgcttgtacaacaaggcctggaacactgtatgccttgcataactatcacctgtcataattatttgttaaaaagttctaaatagcaaaacattgaaagagaagccactgacatataaagttgagaacatagattttgaggctgaacataatgagtgtaaatctcagttttgccacttgctctcaccaagaccttgagcagattatataacctctggcttaatttccttacgtgcaaaatgaccataaaatatctattagactgggaagttggaatctttacagtatgcagtatgtctgtgtcttagaaggtacacagtgctccctatctttagaatttatatttgaaaacttgttgttatgacataaatgcatttcagttagtttttttcccctaggtaactatacaagaaatttaatactgttacgtgctgtatcggtcactcttctccagaaaaacaaaaagaataagagaacaacaaaagaataagatgtgtgtgtgtgtgtgtgtgtgtgtgtgtgtgtgtgtgtgtgtgtttagagagaaagagaaagatttattttaaggaattggctcacatgatcatggaggctggcaggtccaaagtctgcagagtgggcatctagtgtggagacccatgaaagagccgatgttgtggttcaagtccaaaggctgtcagctggcagcattccctcttgctgcaggagatcagtcttttattcaacttaggccttcaactgtttgatgaggcccacccacatataaagggaaatctgctttactcaaaggccactgatttaaatattcctctcacccaaaagcaccatcgcagggtactgtggtcactgtggcccaaacatgttgatgcataaaattaactgtcacatcttctttttatcagaaagtaatatgaaaataaaatatggtcactgaatcatagatttccctcaagtcagaaaccagggagtctgcctatgcccattcttctctctaattagtcaacaaagcctgaacatggtgctcctcaatagatctcaaatccatccctgatctccaactctgttgtcatcgttttagttaaatctgcccttctttctcatctttactaatgcaatagtgtcagcttatcaaactgtaggtttctttcctgttagactcaagcttgagtgtagagagctgttccacaagaaaaactgagggacttgatgggtgcagtggctcacacctgtaatcccagcactttgggaggctgaggcagatggatcacttgaggtcaggagttcaagaccagcctggtcaacatggtgaaaccctgtctctactaaaaatacaaaaagtagttgagtgtggttgtggtgtacgatgacagactggtccccaggaaataagagggtttgttttgggaaagggatattattgtttttgttctaaactataagttcctcacaaagttagttcagcctacatccagaaatgaacaaggacagcttggaggttagaagcaagatagagttggttagatcaaatgtctttcactgtctcagttataattttacagtggtggtttcacaccaaacacacacacacacacacacacacacacacactcatctgctaatttaggttctggttctgttacttaactattggctcttgagcaagtaacatcactgatcctgcctcatttacaaaataagaatcataatgatcgtaatacctacctgacagagtaagaaaggcttcaatacaggcagccataaagcaaaacattaatagtggttgaacatgtattgcactctaagaaaaaaacttgctacaagtaaaatataaggaaatcattagaaaatttatgtaaaaatgtactataagttattttcaggagcttagtagatttgatcattgatgccacttgtctttttagtatactttaagttttagggtacatgtgcagaacctttcaatcaatacataggccatttaaaattatttgtttgaaactcagtattcaggaaagcagcaggataaattgagaggagtgtggggaaggtctgctggtggcaatgggtgagcgtaagggctatgccatcttagaagactttatgataaacacttgccactcatgcattttaacatgataaaattgtgatccaaatataaaattttgtgcatttaaaggacttgaacatttaggtggactattgagatttctgattctccataatatttctttttccaccactgctaaacctgacatttacttcaaaaaaaaaaaggaggaaaactaatcaaattctgtataaaaggtcaacaaaattcattaagatcttctggtttcagatttatacagaatatctaatgatttcaacaaaaaaaaatggtgtatctactacttgaggccaggaattatccttttggggtctctactatgatttagactgtctcttttattaggcagaattcggaaaaactcttatggacattgtcctttatgaaggtagtaagaaaagcaacactggtgtatgtggcggcagggtgtgtgtggggatgtgcatgggtgtatgcacacacacaagtatgtgtggacatgcctgcatgcatgcttagaagaaccaatgttgttatggttctgtgatctatgtctctatgtttccattaagatgagaaaggccagcataaaagagtgcaggttctgcaaacagcaggcagagatactaaactaagggtgaaaggaaataagatttgtgacagcattttgagaagcacagggtactctccaaatgtaaggaggtggtagtattgtggtattcttatcactgctagtatttataaataaccagaagaaagcaaacatatgtcttttatattcagagaccagttggtcaggcacatatttttcttacatttcagtgcataattaatgacattataaaaagtcattcttagttaacaattctatttaaatcctggggattgatttatttgctactttttacaatgaaaaagataaccaaatggtcctgtttgtagttgttagatccattttcagtgacatttttggatctgctgttggtgttaaaaggtcttgcatacgtttgtggactaaatgcaaagaactacatatgactttgtgagttaatccaaacaaactaagtacactatgttacttcatgaagtaattgtttaatgacaaactgaagttattgttctcaaataatcctggtatttagtaatttatctatagactggcgttcagatgctgtgaatggtaatgagagagatcacatgacgaccagctttccacaactgtagcaatttggcagttttgctcccgcaccccaccccaacaaccccagggtgggacatttggcaaactctagagattttttttttattgtcgtaactaattgggagaggtgctggtggtgtctagtctatagcggctagagaatgctagtgaccatcctatgcacatcctagacagaaaaacccacacaacaatagctagctagtcagatgtccatagtccctgggctaagaagccctgctgtaagccaatgcttctcaaactgtagctcatggagcagcagccggatccccaaaacccagtccatgttatgatgagcttaccgaaatgtaaatcaactaggtcacagagtagttcagctgataggttttataataaggctctcaatgaaggaaagagtgtattgaattacatcttgatgaaagctcattatctcctcgatgactgacgcccagagtacaactgttttatcaaacattcccagtcgctcccttgggtggtctctgctcactcccataacgcggcccatgattcttcagaggataaatatatccctagacccacagcagaccactttacattgtcacagagtattttctgaacgcttaaccttctgttctgtaccgcattaaggaaaacaaagattttaagtgggctttgactaaagtgtatgcacttgtaaaatgcaaaaatcacagcagaatttaaaaagtgtacaagtcaaaaattatttgaaagagaagtagccatcgctactggtttagtaagtctaagtccgcctaagtctcactatggaaaagacaatttagttattttctctttagtcacccataattgttctacaaattccttgcatagttggagtttatgtcatttttcatatgctatgtattttcatatattaaaatgtggctgataaatatctgttgatataattgattacagaatcatagttttaagtcagcaccaaatacaaaattttgtggatgcccctatatattaacactgttaagaattaaattcctgggcctcacacctaccagttttaaatatcaataacccattatgtgaatatatctctaagttacaaaaaattcagtgtcatttaattttcagtagccaaaataaagccttagccaaattaagccttagccaatatactttatacttttaaacacaacttctgaaatactccagtaagtttaacattggaattataccaacaaaagggcatcaggctagaaagagtttgccccttaacacattctatgtaatcattgcaccatgaggaaagctatatttgctacacttgactcaaatttgatctttattaaacgggaccaaaagctatttcccagagaatgggcatcaagtggtcaatgtgctaacgcagtccacatgaactatagcatatattggtgaaaatgaacagtgaaaagttgttaagaatcaataaagatggcagatgagcaccaattggtgggctgaaaagaaagcggggaaaaggaatgcctattttagggttgatatacattggaaaatccagaatgaatgaaatacaatataccaacttgctactacaattgccagcactactatgtgtataggatacatcaacacacagatattggaagagaatataaaaagccttgggaagtaaagggtttctaagccatgaatagaactaatgccataaagtgacttactaaatggtatcctggtgacttgaaaaattaatacattttccaaaagtctgaatggactccccaaaatatactgaaaaacagaaaaaccctacgagactttaaaggataaagaaatcacagcaaagtctcctttcagagattaagggtgtgtgtttatgtgtgtctatgtatgtgtataaatgttctacatttttcgttctaatgattgatttaccagttcagtcactcagttgtaaaagcttttaaatttatacaactatagtttcaaaattataaatgtcagcaacataactatagtataatattaagaatgtttacttacactggaaactaggtggtagaatgatttgttttatatacatctattaaagttttggttggaaaaaatacataatctttagcaactgaataactgcatttctattgtgcagataattcagaagaatctacttcatcgttatgatgattcatgactttaaaagagtgaagatgttaatattttgtgctaaatatacatttcctgatttatatcatgtcatatcataatttcaaaatgaaacaaatatacacagtaataaataatatttaacctttaaaacagtcatctgggcctggtacagtggctcatacctgtaatcccagcacactgggaggccgaggtgggcagatcactggagaccaggagttcaagaccagcgtgggtaacacagggagaccctgtctctaaaaaaaaaattaaaaaacatatgagccaggtatggtggtgtgtgtctgtggtcccagctacttaggaggctgaggcaggaggatcacttgagcctgggaggttgaggctacaataagccatgatcatgccgctgcactctagcctgggtgacagggcaagaccccatctcaaaaaaacaaaaaaaaaatcatctgtaaatatggaaaaactgtcacatgtcaaaagaatcccatatttggttttgaagtcaatatgctaggcagaccctgagtgttcaaaatggtgcatcagaatcagaatctcaggatttaggagtcagtttattattttttaaaatcaacttttaaaaaataacagcaatagaccatcatcttcctattgctgctgcagattcaaagttttaggaataagagaatcttctttaaaagataaatttctacacaattaaggcaatcacatatgcaaagtgtttgtaaaaacaactcattgagttgttcatttagcaactcaatgaaacactctccaatttatattacatttaaattacaacatcacaatgggcaaatggccagacacctttctttcgaaagacatcaaaacgagttacccttgtaggttaatttttgtgtaattgcttaataatgtatacatttaagttatagttgagcacagcttagaaaagaaactagtagccaaattagccctttctactttcataaaaaccagacatactcaaaatgaatcaggcctgtctgcacacccaaatctcagaaacaagcatgaattttcaaaatgcacacatagtaaaaaacattttaactaaggacagaaaaacccgagttttaatccttaccctaccatttatttagctggcaaccaagaaccaattataatactcctttaagcctcagtgctgtcatttgtaaaatggagaataaaacacttttataactttttgatggagataattgaagcaatgtatataatggatatatccctatagacaaacatttaaaaaaaaacactgctttctcctctactttccttattgctactagaacacattcttataaagatttcacaacttctaaatgcaggtagaaaattagaatagcatacttgactcaggacgggtggtgtggcttaatgagagcgtttgccaaatccttagatataagatatattttatgtaatctatgattactacaactgttaccaggaagaggtctggatccagaccccaagagagggttcttgggtcatgtgcaagaaagaattaagggcgagtctacaaagtgaaagcaagtttattaggaaagtaaaggaataaaagaatggctactccacagacagagcagccccgagggctgctggctgcccgtttttatggttatttctgatgatatgctaaacaaggggtggattattcatgcctcccctttttagacaatattaggtaacttcctgacgttgtcatggcatttgtaaactgtcatggcgctgatgggagtgcagtagtgaggacgaccggaggtcactctcctgtccatcttggttttgctgagttttggccggcttctttactgcaacctaaatataggtctttatgacctatattttgtgctgacctcgtatctcatcttgtgacttataatgccttaaccatctggaaatgcagctccgtaggtttcagtctcatttgttacagggcttttccttagttcagctaatgacggggtccttgtccgtccaatggccatgaaaatttaggctcacagacagtttaaagggtgagtaaagcagggttttattgagtgaaaagggaataaaaaggggaaacagggatcctccgcaaggccagagtcccctgctagagtgcttcccgcccgccattcaaatcccacgttccacacaggaagaggaggggccaggctcctcactgctgcaaacatcctgaacttcccgaggctccacctcagtgggcaagctagttagtttctccaggttcccccctcccacctggttgtctcagttttacccagctcctattcaagatggagttgctctggttcacgcatctctgacacaaatatgcagaatttgtccacaaggatttttcccctggaacaccagaataacattgcaaatgaaaaacttcctctaaatcaatataaacaaaaaattaaaaggctgactatattaattttttaatcaaactaattagggatgtagacagccctgtaggatctgagtggccttattcaatgcattactctttagtagtaaagaatcagaaaattattttacctctcactgttagccaatgtcaattaaaatattacctccacttattctacctttcttatctaaagaaattatttgtgtgtttgtctttttgttttatcctttgggagaaccaagagtcagccttttaagaaatcagcttggtgctatacttttcatggttgattcctcttaatagaattagaattatcaggtatcttatgctttaaatgtagcatgtcaccatagaaatggcagaagaaaatattaagtatttctccttctttctgtctctatgttcgggaactataaaaatgtattcagtaatagaagtgcataaaaaggatgataagatggtttgaaaaacagaaggatgcttctaaattgctttgtgaatctaaaatgttatggcataaatgtcacttattagtcaataataacatttgaagagattctaacccaagatagtcatggattttattttcagcacatctttctttaacatttattccacaatgataacccttggaaaccaaatacttggaagaaaaggcaagggtaaagagaagggggcagaaaataaaagaggaagagaatatctacaaaggtatttaatcctttgaaacaacttcttcttagcatgaataccaagaaagaataaacaaactttcttatgtattaaaattagagtttctttaaaattgcagaaatattaatatagaaaggaagtgtttcaagttttaaaaaacatagggaaactatcagatgatttcaatcttcagctttcttaaagtcttccttagggaaagaccataccaggtatcaatagagttggttacagctatgccataatttgtgtgtatgtgactgggcatgacagaatcattaaggcctaacaattctagggcacatttaacagtgggttgtcctgtattctttgtcagctcaaatgaatgctgtgagtagacaaacacattaaatgactgtcattagattcatctaaatcaatactttatgtggtcttttagatgcaggtgcaccaaacagcactctctctctacttctcgttatgtctaatcaagcactgcatatgcagtgcagctagagtggtagggataatgaacttgtgttaagcatttttccaagactccactgccagcatcattagggctttgctaaatagaagaattttgttgcttagtaacacaaatattgcaatggaggtggcggaaggctttttttttttttcccaaaatcgtgactccctaatttactttcagtcctgcacgaacagagttctgattaatgatgtggctcctttctgtcaatgtgatcagtctatcttttgtgtacccagcaatgtacaaaccaaaccccagttgtgttagaaatctttgtctttaatagattcaactctcttatgtttttatcagcctcaccactaaaattaaaaagcagtatcctcacaatactctagcccaggtttaattgtatagaaatatactctaaatgggggttccatttcttaagtgaaacttgtatgcaatctgaaataaataaatatgacatgtacatatgacaaatacatggtgataacaaagtaacaccccttctaagaataagctttataaagcattgataaagttggacaaatctttagaatattttttacattttaaaaataatcactctaatgtgttctttgactccactgagacacaaatccactttcataaaatagcttgagtgagtctccctctctctttctctacctccctctctctttttctctcaggaacattttgattttttaaaatgcatgtgaatatacacagtaaaatgcaaatgaaaatataagaaaagatcagaaaacatattgaaaaatgaaaaaaataattttacctacatgtaccataccataagtgaactctaaaattggctctagccttctggtcaaccaaggcaaaaaggaaacagtatgccttgaacaaatcttttgaataaatatattcttttgaatttgtgaatgaatacaaacttttcccagagctaacattaaggagaaatttagcaacatgttggagagtcagtttctgcataagttttctattgctgccataacaaattatcatatgctttgtggcttaaaacagtacaattttattatcttccagttctgtaggttagaaatccaacatgggtctcactgggctaaaatgagggtgttggcaggactatgtcacttgtggaggcttaggaggataatccattttcttgacttttctaacatcaagagggtgcccacgttctttgactcatgtatatcagcctccatttcaaacccaactaagttgaatttctccaaccactcttccatagtcacagttctctctctaaaggatctgcgtggttaggttgggactacccagataatccaggattatgtctccatctcaatgtccttaattttaatactgtaaagtaacatattcactggtgctagagatgagaatgtggacatcttttggggggccaatattctactaaccacagtatgatataatgaaaaagaggacctctattgtcagacctgaatttgaatactgcctctcacaattactagccttgtggccttcccatacttatttaacctcatgggtttccatttcctcatctaatcataggaaattataatatgggatctaagatcttgtggaaagggatatgtcaagtacttagcacagagctcaatacaccatagttactattgttttagttgatctttatctttttttatactgtcctagcacactttttttttctgattacttagtttgacagcaagataaaacttttatagtgccttgaagaatgaatggctaatgtgttgcatcaactctttctcttaaatccccatttcctcaaccatattttttggcagatgccaagtaacaatcaattaagtttcagctccctggtagaaatccaatgtgtaggtattatgtattattgatagtagaaaaatccattcactttaggtatcaaagagtgaagtggtggtttaatattctttttgtgaaaaataagtggcctaacaaattttcttccagaaaaagaaatatatttttgagccacaaaagtacctctgtacaggttcactgatatgatatatcagtgaacacgagagatttatagggataataatcgtacttacttcataaggttgttgtgaggctttctcagcaaagctctgggtctggcaaaatgtcaggaaaccatgtgaaacactggaaagataggttggccttggtaaagatcataagtcaccatgtgggagcagtgtgatatctttccaaaagagtgaacagaacccttactaattccccagtcctgtatattattgctcaaacctgcgtcaccctattaaatcaatcacttttgatgctatttagaaatgattctagatttcaatccttcttctcaacttctcccacccacatcatcagtcctttatttcaagccattagtctattatacaagatatcatttggaatttattcaaacctaagcaacacaaaatccatcctatagtagcttaaacaagatacgctttttctcacgtaacataaaatctggaagtaaggaaactcaggactagtgagcagtcgatgattatcaaagacccagagtcacccatcatgaatgacaacacctttgtgaagcatctctgaatcaattagttgggctctctccctgtgttcaactttgtatattagcctttgcacaactgtcttgtgctttttctgtttccaagtgtctcccacctctgcagtctgagattgcttaaattaagccttcctatgctcttcctgacacacagcaagacctcaatacatttgtataaaaattaattaaaatgagtgaattaagaagggaagttattgaagtggttagccaagtactaaagaatcagtttttacgtcaaaatatggcaatagacccaaagtttggggaaaaaatagaaatgattcagaaacctgagaaagagaaaaagaaataaaaggtgaaaagctcaaggaatctgggattcaagaatcaaaatgtgaaatccaggaatctgggcaccaagaagaagagcaagaaaggagcttgaacatcatcagggtgctaacaagatatcacctgggctctccttcttccaggacacccagacatgatttcacacaatttttcacatgcaatggaagtcttcgtctcccccaacagccaaaattttctgggtttttttcaagtatttttcccctgtctccgtgcttctgttagtactgaattagtttgggtcatgaattatttctctattccatatagcattttaggggtaattctcatctcctaccttagttctttggaaaaatccatttaacacaacatttgcatgtataggagacactacagaatatctatgaggattaatgaggattttaattataaacattaataaaagcaacttccaactgaatattacatagtcctagtactaagtattttggctctccgtgccacccccaaactttttcaccttctactgtactcaggctccacacattcttctagttttaggaatgcagaatttctcagagcatgtcaggaaaaatattactcctaaacttagctttgagtccactgtgcttatctagatcaaataaggatcttcttctcaacagatataaggggttgtaatataactggagagactctttatcaaagataatcaaaattataaacagtataaatgttcctaattaggccaaaacgttgagagactatattcctaacttaagataaaaattgggttgaaaatattgtcaaaagttagaattaggtgtagaagggttagagataggcttagagtttcttgacaaatgtttaacaatcttgcgttctgctttaaagaggtctggatttggttaatgaatgataaacagtcatttcctcatctgtgaaaaaaattattcattctgctaatatttgtcatgcttctatgatgtgccacgtaatgttctaagcttgtagatatatcagtgaacaagagagataaaatacgtactctgatagaagttagaggtttatagggataataatggtacttatttcataaggttgttgtgaggattaaattataaaatgtatgaagcccccttagaacactgcctggaatgttgtagaagtttcaatgattataattgaggcagcgttccttccgcgggggcactagctgcggggagtctgttccttcagagccctgattcagcgatggatgaataaacgtacactgacacacagatattctgctctgccagtcccgctgagggtcccagtcgcttacaggcttcctgctgagccctgtaaacagttgccactgggccctgatcagctagcgaggctctcgccatttattcagtgactaattaacaaaagttgtgagtaaacaccactagaaggtaaggatcaaaggccaggttccgaggcctaaagcaaacatcatttgcaggtaataaacttctgccgacccccgagtaggaggcagtaaagtacccgcggtaggacaaaggtcagtcttaagccaatataagtaagcatgttagtaagagcaacttcccacattcctttgtacttgcaccctaatctttctggctcctgcaaggagagcttggctgccttcagccaagcaatctgaagctatgcaaactctcagatcttccaagagagtttttggctattactataactatcttaatatttttcccaccagcctgattgaaccccaacctataatcacaattattataagatgattatactctgatgagaacacttgatcaaagtacagtgatgaagaataggaaagttcttgacacatagggatgaaaataatggaagcttatcatgatccatccaattcaacacatattgattgagagcctatcatatatcagatagtgttctaggagcttgaaatacagaaatgatcaaaaagaaggaactcagaagttgtcagaacatgtttcttacctggtgtatgaggtccctattctctctctaatagtccctgcttctgtgagcttaaccaccatttcaagtgatcaaatgtcaggtcatcttcattaatgattattgttaaggatctctgtgaaaatagattaactttcaggaatcaaatataagtgactctcaaaggcgaaagacatcccactggcattcagattaaaaacttaataaactggaaaactataaaatgtgtaaatgaggttaaaagtatttaaataacaatgaatatttttctaccttaatattaaagttaataaaattgatagtaaaattcttttctctcagttgtcattttgtgtcaacacaatttatgacttgacccaagctccttgtgtgcccatagaaaaacctggccactctactgttttaagaaataacgctgtagtcatccagaagtcttacctctctaaattcatctgcagaaagtcatatactttacaccacacaactttctcccattctagtctcattttttcaagagctgccaaatctaaaggaaggataattactcacaaactataaacgaattcagtaaataatcatagaaaaatgctcagattcactaatgagcaaataaattcaaattaaaacaatgaggcatgagatatgtatttaatctaataaattagccaaacaaatcctgtttttataaagataattcccaatactatcaagaaagcaggaaaattggtaatcccatattgctgatgtcagtgttaattggcctttaaggaataaatctaacaaagtgtgtcacatgctattaattttttcatatgttttgaacaagtaactcaatttgttgtgttgtatcctaattttgaacagaagcatatgcatgaagatgttattaacaccattatgtgtattaataagaacagaaataatttaaatgtcaaacaataagaaaactcttaattctagcacattatttaagcattaaaatgtttttaaatatttttctttttaatatttaaattattttaatattaaaaatatttttcttctttttattgtttttttattgaggtaaaaaataccatctttgctattgttttcttttttctttttgagacagagtctcgctgtatcacccaggctggagtgcagtggcgggatctcagctcactgcaacctccgcctcctgggttcaagcgattctcctgcctcagcctcccgactagctgggactataggcacctgccaccacgcctggctaattttttgtatctttagtagagatggggtttcactgtgttggccaggatggtcttgatttcctgaccttggcctcccaaagtgctgggattacaggcgtcagccaccaagcccggcccaatctttactatttttatgtgtacaattcagtggtaataaatacatttatatccttcttccttttctcttatattactccattttaccttcctggcctccgataaccaccagtctactgtcaatcttcatgagatccactttttttagttctcacataggagtgagaatatgcaatgtttgcctttttgtgtttggcttatttcacttaccataataggctccagttccatccacattgctgaaaaagacaggatttcatgctttgttatggctgaattatatttcattgtatatgtacatatacaatgaaatatatatgtacatatacaatgaaatatatatgtgtgtatatatattacattttctttatccattcatctactgatgggcacttaggttgattccatattttggctattgtgaatagtgatttgggtattgtgaatatcataatatttgggttttatgaatagtgctgcaataaacatggaagtgcaaatatctctttgatatactgattacctttctctcagatatatacaccgtagtagaattgctagacaatatgaaagttctacttgtaggtttttgaggagattccataatgtcctccaagtggctatactaatttacattcccacttagcgtatgaaggttgccctttctccacatccttgccaacatctgttgttgcctgtctttttgatacaagccattttaactggggtgagatatctcattgtggttttgatttgcatatctctgatgattgaagatgatgagcattttttcatacacctgttggccatttgtatgtcttctttagggaaatgtctattgagatcctttgcctatttttaatttgattatttgggtttttccattattgagttgttcgagctccttatatattatatattctggttattaatcccctttcagatggatagtttgcaaatattttctcctattctgcaggttgtctattcagttttattgattgtttcctttgtagttcagaagctttttagctttatgtaatcccatttgtctattttttcttggtcgcctgtgcttttgaggtcttacacaaaaaaatcttttctcaaataaatgtcctagagcattttcctaaagttttcttctagtagtttcatagtttctggtcttagattcaagtttttaatccattttgatttaatttttatgtagggtaagagatagggatctagctttattcttctacatatagatagttacccagttttcccagcaccacttattgaaaagactgttctttcctcattgtaagtttttggtgcctaagttgaagataagcaggctgtaagtgcatggatttatatctggattctctattctgttccattggtccctgtgtctatttttatgtgagtaccatgctgtttttattactatagctttagaatgaattttgaagtcaggtagtatgaggcgaccaactttgttaattttgcacaggattgctttggctattaagggtctttagtggttccatataaactttagaattttttctatttctgtgcagaatgtcattggtattttgataggattgcattgaatatgtaaattactttgggtggtattgtcatcttatcaatattaattgttccaatccatgagcatagactatctttctgtttttttggtgtcctcttcaatttcttttatcagtattttgtagttttccttgtataggtcttttacttctttggttagattggttcctaagcattttatattttttgtagctattgtcaatggaattactttcatgatttctttttcagattgtttgctgttgccatatataaatgctactgatttttatatgttgattttgtatcctgaaactactgaattcttttatcagttctaacagttttttgatggagtctttcgatttttctaaatgtaagagtgtgttttttgctaacaaagctaattagacttcctcctttccaatttgaatgttctttatttctttctctttcccaattgttctggccaggacttccagtattgtgttgaataaaatcagtgaaagtgggaatccttgtcttgttccaagtctttagaggataggtcttccatgtttctccattcagtgcagtgttagtcatgggtttgtcttagatggcctttattattttgtgatatgttcctactgtacacattttgataagggttttttaataaagggatgctgaattttattaaatgcttttgaggcatctgttgaaataatcatatggttttgttcattctgttgatgtgatgtaacacatttattaatttgcatatgttgaaacattgtcttacccctaggatgaatttcacttgatcatggtgaacgatctttttagtgttgttgcatttggtttgctggtattttgctggggatttttgcagttatgttcttcagcgatattggcctgtagttttattttcttgtagcatccttgtctggttttggtattaggctaatgctggtcttgtagaatgacttgggaagtattccctcctcttcaaatttttgtaagagtttgaataggattgggctgggcacagtggctcctgcctgtaatcccagcactttgggaggccgaggcgggcggatcacgaggtcaggagatcgagaccatcctggctaacatggtgaaaccttgtttctactaaaaatacaaaaatttagccaggcatggtggtatgcacctgtactcccagctacttgggaggctgaggcaggagaatcacttgaacccaagaggtggaggttgtagtaagccgagatcgcaccactgcactccagcctgggctacagagcaagactccatctccaaaaaaaaaaaaaaaagagtttgagagtttgagtaggattgatattagttcttctttaaatatatggtataattcaacagggaatccatcagattctgggcttttatttgatgggagactctttattacagctttgatctaattactcattttttgtttgttttgttaaggtttcctatttcctggtgattcaatcttggtagattgtatgtgtccaggattttatccatttcttctagttttttcattgtgttggcatgtagttgttcatgataatctgtaatgattctttgtatttctgaggttctcagtttctgtgtctccttttatttgctgattttatttatttgcgtcttctctcttttattcttagtctagctaaaggtttgttgattttctttatcttttttaaaaaacaacctttgctttgttgatcctttacattttttagtcttaatttcatttatttctgctctgatcttttattattttttccttctagtaatttaggattttatttatttttgcttttctaatttcttgagatgccttgttaggttgttaatttgaagtctttctacttttttgatataagcatttattgctataaaccttcctcttagtactgctttagctgtattccatagagtttggcattttgcatttttatttcaatcaaaattttttaaaatttccttcttaattttattgacccattggtcattcaaaaacatggttttttaaatttccatttgtttgtgaattttccagggttcatcttgttttttatttctagttgtatttcatatttttcagagaaaatacttgatattatttctagttttcagaatttgcacaggcttgttttgtggctcaagatatggtctatcctggaaaatgttctatattcagtgaaaaaaatgcatgttccacagaacctagtgaaatgttctgtaaatatcaattagtcctattagatctagtgtgtagtttctctccactgtttccttgttgattttgtgtctggatgatctgtctgttactgagaatgggatgttaacatccctgactattattgtattgcattctatctcttcctttaggtctattcatgattgcttcaagtatttaggagctctgtattgggtacataaatatttatacttatatcctcttattgaattggctcatttatcattttatagtgatcttccttgtcttttttcacagtctgtgttgtgtagtctatttcatataatgtcaatatagttattcctgctcttttttgctttccagttgcacagaataccttttccatcctctctagttatgtgtgtctttacaggtaaagtggggtttttgagggcagaatataattgagtcatttctttatccattcagccactctatgccttttagttggagagttgaaaccattcacatttagcgttattattgataagaacttaccactgctgtttcgttgcttgttttttggtggttttgagattcctctcttcttttcttcctttcttactgtcttccttttggcttaaattattgtctctgatagtatgttttaatttattgctttttatttgtagtgaatcaattataactttttgtgctgtggttatcatgagatttccaaagtatattttattgatgaaacaagttactttaaagggatggtgacttatcttagaacacaaataaaagaatagacacaaacaaaggcaaaaaaacccacaaacacaattctacactttatctccatctgccttacattttgacttttagttgtctcaatttacatattttaattacctatctcttaacaggttgccatgctatttttgtttttgataaatttttctttgggattttatactagagttataggtggatggcacaccacaaatgcatactctgagtttgaatactctgagtttgttcatgtacttaattttgcaccttagtgcttttgtttttcagtttgaagaactccctttagcatttcttgcaaaacgggtctgttggtggtgaattctctcaggctttgtttgtctgtgaaagacttttctctatcctcaaattagaatgagaattctgctgaatacatttctgggtggcagttttttctttgaacactttgaaaatattgttctattccccttgagccagtatggtttctcttgagaagcctgttgccaaactaattgtagctcccttatatattacttgattatttcttgctgcttttaggatcttctctttgcccttgacttttgaggatttgattatctaatgccttggggtatttgatatggtttggctgtgtccctgccgaaatctcgtcttgaattgtagctcccataatccctatgggggtatttgatatggtttggctgtgtccctgcccaaatctcgtcttgaattgtagctcccataatccctatgtatggtgagaatgacctagtgggaggtaattgaatcatgagggtgggttgttcccatgctgttctcatgatagtgaataagtctcataaggtctgatggttttataaagggcagttcccctgtacatgctctcttgcctgctgccatgtaagatgtgcctttgctcctccttcgccttccgccatgattgtgaggcctccccagccatgtggaactgtgatttcaaaaacttctttttctttataaattacccagtcccaggtatgtatttattcacagtataaaaatggactaatacagtaaattggtaccaggagtggggtactcctataaggatacctgaaaatgtggaagcgacttagaaactgggtaacaggcagaggttggaaaagtttggagggctcagaagaagacaggaagatgtgggaagtttggaacttcctagagacttgttgaatagctttgaccaaaatgttgatagtgatatggacaataaagtccagactcatcagatgaagatgaggaacttgttgggaactggagtaaaggtcactcttgctatgcaaagatactggtgacattttgcctctgccttcgagatctgtggaactttgaacttcagagagattagggtatctggtggaagaaatttctaagcagcattgtgttcaagaggaggcagacgataaaagtttgaaaattttgcagcctgctgatgcagtagaaaagaaaaacccattttctggggagcaattcaagtcagctgcagaaatttgcataagtaacaaggttcaaaatgctaatcaccaagacaatggggaaaatatctccagggcatgtcagagaccttcactgcagccccaggcccagtggcctaggagggaatgggtaaacagacctgttccaaatgggagaaattggccaaaacaaaggggttacaggccccatacaaatctgaaatccaatagggcagtcattaaacctcaaagctccaaaataatctcctttgactccatgtctcacatccaggtcacactgccgcaagaggtgggtttttacagtcttgagaagctctgcccctgtggctttgcaggatacagagcacctcctggttgctttcatgggctggtgttgagtgtctacagcttttccaggtgcatggtgcaagctgtcaatggatcacaggcccagaggtctaggaggtaaaaatggtttcctgggccaggtccagggtccctctactgtgtgcagccaggacttggtgccctgcatcccagccgctccagccatggctaaaacgggccaaggtacagctcaggccatagcttcagagggtgcaatccccaagccttggcagcttccgcatggtgtttgtcctgcaggtacacagaagtcaagtattaaggtttgggaacctctgactagatttcaaaggcaggggtgtgctgcagggttgtagcccttatggagagcctctgctatggcagtgcagaagggaaatgtggggttggagcacccacacagagtccccactgtggcactgcctagcggagctatgagaagaaggccaccatcctccagaccccagaatagtagatccattgacagcttgcactatgcacctggaaaagctgcagacactcaacaccagcccatgaaagcaaccaggaggtgctctgtaccctgcaaagccacaggggcagagctgctaaagaccgtaaaaacccacctcttgcagcagcgtgacctggatgtgagacatggactcaaaggagattattttggaactttgaggtttaatgactgccctattggatttcagatttgtatggggcctgtaacccctttgttttgaccaatttctctcatttggaacaggtgtgtttacccattgcctatacccccattgtatctaggaagtaactaacttgcttttgattttataggctcgtaggcagaagggacttgccttgtctctgatgagaacttggactgtgggcttttgagttaacgctaaaatgatttaagactttgggggactgttaggaaggcatgattggttttgacatgtaaggacatgagatttgggaggggcccagggtggaatgatatggtttggctatgtctgcttccaaatctcatcttgaattgtagctcccataatttccattgttgtgagagggacccagtggaaggtaattgaatcatgggggtgggttatcaggggtaccagccccaatatttcaacataggtacttttctattttccctaagtgtcggccggtctgagaaataaagagaaacagtacaaaagagagaaattttacagctgggtctccaggggtgacatcacatgtcggcaggttccgtgatgccccttgagccacaaaaccagcaagtttttattagggttttcaaaaggggagggagtgtacgaatagggtgtgggtcacagagatcacatgcttcaaaggcaataaaatatcacaagggcagagaggcagagtgagatcacaaggccagggtgaaactagaattactgatgaaggtccatgtcctgctgggcacacattgtcattgatgaacaggaaacagggtttgagagcagacaactggtctgactagaatttcacctggctggaatttcccaatcctagcaagctggggggcgctgcaggtgaccagcgtgtatttcatcccttatctacaactgcataagacagacactcccagagcgactattttagagacctccccctgagaatacaatattttcccagggctgttccttgctgagaaaaagaattcagtgatatttcccctattcgcttttgcgagaagagaaatatgactctattctgcccagccccacaggcaggcaggccttatggttatctcccttgttccctgaaaatggctgttatcctgttcttttcaaggtgcccagatttcacattgttaacacacatgctttacaaacaatttgtgcagataacgcaatcatcacagggtcctgaggtgacatacatcctcagcttatgaagatgacgggattaagagattaaagtaaagacaggcataggaaattataagagtattgattagggaagtgataaatgtccatgaaatcttcacaatttatgttcagagattgcagtaaagacaggtgtaagaaattataaaaatattaatttggggaactaataaatgtccttgaaatcttcacaatttatgttcttctgctgtggcttcagctggtccctccattcggggtccctgacttcccgcaatagtgggtctttccaagctgttcttctgagagtgtataagtcttaaaatatctgatggttttataaaggacaattcccctgcacatgctctctttcttaccactatctaagacgtgcctttgttactcctctttccaccatgattgtgaggcatccccagccatgtggaaatgtgagtccattaaacctctttttctttataaatttcacagtcttgggtatgtcttattatcagtataaaaaaggactaatactgtattcttatttaggttgaatctgttcggtgtttaagaactaactgtacctggatatttatatctttttcaagttttgaaacactttctgttatagtttctttgaataggctttctacccattgctcttgctcagctccctcttgaatggcaataattcttagatttggtcttttgaaataattttctatgtcttgcaggtggtctttattccttttcattctttttttttcctttttctcctctgaatttgtatttttaaatagcaggtctttgaactcactgattctttcctctgcttgcttcattccactgttaagagcctctaatgtgtttttcatctcagccaatatatttcatagttgcaagatttctgtttgtctttttattatttcaattttttgctaaatttctctgatcaatttctaaattgattttctatattatcttggagatcactgagtttccttaaaactgctgttttgaattcttgatcagaaaactcacaaattgccatctcatttgagtcagtcactggctttttgatttgaccttttggagagatcatggttttctgtttgctcttgtttcttgtgggtatacatctatgtctttgcactggagaattagttatttattccagttgtctctgtctaacttgttccagtttttattgaatacatttgcttagcaattctttactagtggattgctgcctccttttcagctctaggtgacaccttaagcctaggttcatctcagctctagtaaactgtcagaccactgcctgtcccaaattgggaaggtcccaaaagtattattctggcatcatgggaagcttggctaggggattataaagaggggacctggggaacatacctcctatagctgctcttagttagactctcctttggctgagttacagagcagagtttctgagctggagatggtagtcctgcctactttgtttgtttctgcctgtcctcagagatagttttcccttcaggcagtcatgatgctactcatgggttaaggcaaggacagttctcctgctggtgaacccaagaaaatggggaaatttgttgacaacctcaattttactttttccagtgtagaaaccatgagttgaagggagattttcctcacaggtggtgcctgggcagaattagttggaggggtgtcatccttgtgaatgtcagttgtccatcatctgctcagtttttccacttctccgcatccccagaaactggctcatcctcatacttgagctctgggttgttgctgttgaagaactcagcgctgtatatttggactttttgttgttgctgttggtgtttgttgtaatggggaatgaagccagcttgtctctacaccaccattttggataaaaatatatttttttaataatctacttcccctatactctactcaaaaggtatgtgagatagggatgtcatgctaaatgatttttaatgcagaatacatgattatatacaaaatatattttaaaacgtgtcaatgaaaaaagtcaaactctgtaaaatatttgaagagatttattctgagtcaagtatgagtgaccatggcccatgacacagcccttaggagatcctgagaacacgtgcccaaggtggttggggcacagcttggttttatacattttaggcatacatgagacaatgagccatctatcagatacatttaagatatactttggtttggtccagaaaggtgagacaactcaaagcaggtgggtcgggggagtggtgcttccaggctacaggcagatttaaaaattttctgattggaaatttgttgaaagagttatcagtagaaataaatgtctgggttatgataagaggttgtagagaccaaagttttaccatgcagatgaagcctccaggtagcaggcttcagggagaataaattgtaaatgtttcttatcaaacttaaagtctgtgttaatgttaatgctgaacggtatagtgaggcatatcccacccccacttccatcatggcttgaaacagtgtttcaggttaaattttagaatgacctggccaaggaggaagtccatttagatggttggagggccttagaattttatttttggtttacacatgtactggaataatatgtagcccatattgtatataccagtgagattgtggatgactatttttctttgccatttttattttgtggaaaattcttatgtaactttctaaggtatgttagaactcactgtgaaacctcaggtcctacttcttgtcataaggacaggaagttcatgctcatttgtttgcagggtctcatcagggtgtaggaagatagggagaaaagctgataccgagtagtaattgttaccacttgttttgtttggttgattggtaggttagtgggtgggttttattttttagcctattaaataaaagccttaaaattagaaaatttggcaagagcttatctcaatcattaaaccagaataattccagaataatttttccaaaactaatgtatttacatcaagtttggaggaaaacataaaaactcttgaaaattgtattgatagtacccaggatgtaagaacaatccattttagatctgccatctcagcaagcctctcttcaaaataaaaatctctcaattctcagcattttattacatactaagaattttctttagatttggctgagaaacaacatagagtcataagttatagaatatagctgtagctgaaaaaaagaaatgcttgttataataagcctctcagtgggggaaaagttggagacaaaagggacagttagaaataagtaaaaacctatgaaaaagagcagagctgttcaagaaatgatacattaaaaaaaaaaacttacaaggatggctacatgttttaattttcagaggcaccatatcttactgataataaaagccaaagcctttgtagggacttcaaaaccctcctggatccagctcccatttattctctgacctcatctcgtaccgtgttttctgctccctggatattcctccatcgttctctcaaggcctttgtacttgttctattttattggcatactcttctccccacgtgatttataccttcacttccacattgaccaagaaccattcagaaaaacagacaccacaccaggaatttcaacagaagaaatttaatataagaacttaattacacattaatctgtggcacagaagtcagggtagtggttacccttggaagagagcctaagaggatgctggaaatgttttatttcttggcttgggtttgcagcatggctgccttcactttgtgaaaagtcatcgtgttgttcacagtctatcctcattattcactgactctggaataatgaatttacctaattgctaagatttattggtaacccccaaatcagtactcactgagctttgtggccatttgcagacatacacattgaggggaaaaatttgagtcaccaagacgcatgctttcctagctgtggtcagacaaagcaactctctcatattgtgtcagctctacttgtttcagctctcatattgtaaacaagagtcttttttgtggtctacttaatactacatggtgtgtgggattttttttcttttttgcattttcatgctttctggtggtgatttcactgtttaaaattacccacaagaatagtgctgaagtgttacctagtgtgtgtaggtgtaagactgtgatgtggctaatgaagaaaattcatgtgttagcttcattcaggtgtgagttaccgtgctattggcagtaaatgcaatgttaatgaatcaagcgtatattttaaatgaagtatctttaaacagaaacacacatgaaataagattatgtgttgaatggccaattaaagtgtgaccagaggcttgcaggagcctacccctttaatgaaatgtaagtgcaaaaattacagttgatttgcattatttgtgatagttatattgtataaaatcaccgtgaacactgaattagtgaatgttgaatcattgaccttaaaatattgaaataacccagataatggctgcaagaagccaatgggttttgctcctccttgggctaaagaaaaatgaaaataatttagggtcatttgaacctaacagtttgaaaggttctcataccttgggggtgatgccacctggtgctttgggtatctctgaagggatattatgaagctgcttaagaagccggaagctggaaccaattgctgttggggcattgtcattgccgggacaatctcaacagaaacaccaagcaaaggagaagaaaggatttcctcttcctttgtgccttccagtcttcctctcatatccttattggcaaaacctatctcaaagccaactggaaataaataatacatacacatacatttcatatatgtacatatacatatgtatacacacatataatgtactttacagagttaaagtctagcattacatagaagaatatatttagatccgagagataatagcttaataactatcctagtccatgctttaggcttctcagcatccatatacactctgctacatatatttattatatagaagaatatatatagatataagaggtaatattaataactattctagtccacactttaggcttctcagcatccatgtacaccctgctacatatatttaaacttatagataacaagtgaagacagtttcactctccgcctaagaatagaagacatcaagttccaacatcatagtcatctttgagaagtcactgtatccaactctgagaaatgactattcctctaaatcacacaaatcccacctgaacactctgtaacctaaagaatgaagtttagctgacaatcctatataaaacaatagagaaaaataagaacgaataaaaatattaattattaataaaaataagaaaaaacatatactacactgcatacatacaacaaaaaagaaaatatgactaaaacatctctcagttctctagtttgtcacaaaaccatttgatacatgtaatttctttcttctaccaccccatcacatgtttcttttgcccagtgttcagctggttaggatcctttagataacgggatagttcaaaactttattcttaaagggtaagaatacctggtgaacctgtttgtttggggtttctcttggtagctttacattttcattaaactttactattaaacatgaagtactatgacgcaccacagatgatctcttgtatccaaaacatagtactccctacctgcaatatgtcacagcaatataattttcctgaatagtccaaaccaatcaccccagcctgtaaagtacctctcttctttgcctactagatctgtggcaagagataccaaagtggctatgtgtaatctgtttcatactgaacacaattattgtgtcttcaagtaaagatatttcttctttgggaaccaagatctgaaaactaacagagcacaaagttacagggataggtaaggaaaaagttggcaagcaggtaatgagaagggccgctaccatgaaaacaccttattttcagaacccatgtattctggctatgtaagagactacctataaaatagcatgtgtccaaacctttagccatctttcagtccagataaagcgaacaacaaactatactgcttaaaatctgctgacaggatttcccttcaccaccatttttctaggacatcatttttttggaagccttaatactatagcagtccacttctagttggtgctaatgtattatgcagagctatcagcagacctgagtctaggtaagaaccagtacgagctcggggtcacctccttacacagtttactgcttttacttaatgatcgatagctgttatgcatgccaaacttgtgatgtgataggtcaaataatcccaattaatcatgctcagctcaggttacatggtgatttgacgtcccattgttcaacactcaatctttaagaagcctcaatagcaagcaaagaagtagttctccaaaggaaaatagttatatgaaaagagcctattgctttcctccatgggatgtgctgtaattctatggaggcttgccaggagttccatacagcattcttacatgtgtcagacctttaaatatcatgagatctacttgatcagaagacccaagtaaaagagtagcttacaccacagcctagagttgttgcagagccttttatttttaccccctcaggctccactaaaaactggcaactgcattggttcctcagaaaatgggttagaatatcatatcctaatatagtatatgttgcctcaaaaatccaaagaggttcaccaagcattatgccttgtttttgggggtagatgtttaagatgcttttaactgtttttcactgtgaagatgatattgtgacatactgcagatcgttggacaccctctggaaactttaccaagaagatgccctttgaattctggggactttatcttccaccctcatgtgctttactaagatacataaagcaatttcaaggtcctggctcatcaaaaaaattatcatgatggcatcagtgtagtggaccagtatgatgctcagtgtgatatccagatgatgaagatctgtctaacagagaacataactgtgcagatgtgctatcatccttatgagaaaagaaatggcttctcgatgtccttacaaacttatatttaaaaagtatttgccagataaataactgtatatcagatatcaaagattgtgttgacatgattaaatttatgataatctattgtcatcctccaagatccatctatcttctgcacaggcaaaacagataagttaaatgagaatgtgatagaattcatcacctttcatacttcagatcttttaagtggcattcatcttagcggttccagagggatatcatattgcttttgaattattaccctcctctagaggggaaactccaagagttctacttagcccttcctgtaatcatgatcctgaattcacaggtctgaaagtcaatgtagagattctatcagttgccaagtgcctatctcaattatgcattcagaagttgaatctgcatccccactgaactgactgttagacaaaggttaacattccatttaccatctgacttctgtaagcatccactttgattgatgggtataatggcattttgggtccccagaaattaggatcactttagagccagtgactggatatcagtaataaattccctttcctaagtgcttagctatcataacacatggctacaaatccattttggaaaaaaacttggagaaagtactagcaatacatacttgtggcaatgttgcagttatttttcaagggaaactggaacccccttaaatcaaggagatacatgtctgtgtactgatgtaggtctagaaaacaagttagagactgcaactctctattgtgatgactcaaatcagggttctggtcaccagatctagaagattttctataaataaagtaataagttagtaggctgcccatttatttcattactaaggacaatttgtcacttccccaaatttctgggtgtcaacactttgatttccactttatcctttgtgcctattgtggtgactgcctccaccttttctctctcgtggtgaaagacttatctctcagttggcctctgccattctaggatcccatcatcactgttgataccaagaagtcaatctcatagtgccatttcaaacaagacacaaaaggatagattttaagagtgcgcgtgcgtgtgtgtgtgtgtgtgtgtgtgtgtgtgtgtatttcagatcataatatccaccaattttgtattttctgtttcatgcaacatttattagggaacattttcccttgccattcaatattgtttcatgttatttgattttagtataataatcaatcatgtttatataccaaagattaagagcatacttggaggtgatcattgaagtaactaggcttgaaaggatatgagaagaaattaaatttagcaagaattagccttaaatgagaaaaaagaacacccttttttctctcaaacaatagggaaagctgggataaaagaacagcaagaaattctataatgtaaagatagtagactgtaaagtttctctgttaattaaaaaaagaagataaagaggatatggtaagaggatttatacaagcattgaaaagcaggttcaagttttgttcttgctgctgtgggatatagagaaatgaagaaactggaaattcataaaattagagctcttattatgttatacattatgttattttagtggttattattactaggtgaaattgtagagattaaagaaaattattatcttttcaaaacatatatatatatatgtacacataacttttataattagaaaaataagccataaaattgtagaggcaaaaacacagaatcatctgaccagcagtgtgaagaatgaattggaggtaaactactgtggcaggagttacagaagcttgctaaggtcaatatacttgcctgagtaagaaactataaggtgagacattacagtgacttaaactaaggcagaagtggtcacaatgggaagaatgggattcatatgtaagagatagattcaaaattaaagttgacagattggagtcgtggcaggagattggagaggggatgagagagtggaaggagaggttttggacttgagcatccggttgaataaccatacttttcagtaaattattcaaatataagatgaaaaatacaacttaggcgagggagctgtggatgtctgagggatttcaatgttaagatcatccacagtcaatgtgagctatggagtgtggcagagtcaaaatttcatgggttttggactaagacattactggttttaaatgttattactgctgcttaccaatcatgttacaaaacctatgggccaaatacttctctcagctgaaatttctcatattaaaatcaagataataaaattataatgataataataacatctgccttatagtattgcttgaggaataagtgcctagtaaacctgcaatttaattgtaaaattattataggcaattattattattattgcttgctgtgttttgttaggcaggttagtcaatttctataagcctcaattttctgtaaaatgaggataataaaaatctaccacacaaccttaaagtgagcgttaagtgagatactgcatagtctaatgcctggtgtatagtagttgttaacaacaatggtaccaatttgtttttattatttgtcatcatcattcctattataatgtgttcaaacatattagtaaccaaagtatgaaaattaaaataaacactgaaatgttatcaagttcactgaattttttatattttaattggatatagccatttttatagtatctaagcctttttctcaatgtttctaagtctccatttttattaatttgtaaaaatttctctatattagcttttgtctataatagttaatattttgcagttcttagctaccttttatttttgaattttctttatgatttttagtggacataatgtgggtttataaaatattcttttgtgattaaaaaattcaataaattaggtataaaaggaatgctccttaatataacagaggccatatatggcaaacccacagctaacatcatacttaatggtgaaaatgtgaaggcttttcctctaaggtcaaaaacaagacaagaacgcccattttcaccacttctgttcaacatagtactataaattataactagagcaattaagcaagagaatgaaataaaagccatcaaaataggaaaggatgaagtaaaattgtttctatttgctgacatgatcttctatatagaaaatcctaaagactccacctaactcgaaagtgctgttaaaactgataaattcagtaaagttgcaggatacaaaattaatattatgtttatatactaacaacaatctgtcaaagaaaaaataagaaaaaagtccacttacaataccatcaagtagaataaaatagttatgagcaaatttaactaagtaatttaaccccaaaatgcagttagtgaaagcaaaaacgagataggattgcctcaaacaaaaaccttctacaaagcaaaggaaacaacagagtgaagagacaacccatagatggggagaaaatgtttgcaaatcatatattggataaggggttattattcaaaatatacaggaaactcaaactactcaatgacaagaaaacaaataaccccattaaaaatgggcaaagaacttgaatagacagttcccaaaagaagacatacaaatgagatgaatagataaagtggaaaaatgttcaagatagctaattatcaaaaaaatacaaattaaaactataagaagatatcacctcacatctgtcagactggctattatcaaaaagatgaaaggtaaatgttgaccaggatttgaagaaaagggaacacttttacactgttgatggtattgtaaattagtatagtcattttgaaaaacattatggaagttcctgaaaaaaaactaaataaagaattaccatatgatccagcaatctcattactggatatataccaaaggaattgaaatcagtatgggaaagagatgtatgcacccccatgttcattgcaacattattcaccatagctaagatatggaaaaacccaaatatccatcaaatgattaactttttttttaatgtggcatatatacacaatggaattgtgctattcagcttcaaaaaaaaaaaaagccacaggaaaatacatgtcatcatttgtgacaactagatgaacccagaagacattatgttaagctaaataagccaggcacagagagacaatcactatataagctcactgacacagttattgctaacaatgttgtcaataggttcttggaaactgcaacttttaagtgaaacaacatgtaacaaaaccaattttactatagattaattgatataagcaagacttaggttaagcttcaaaagaaagaccaaaacacttataatattaagaattaaaataaatgtgaactatatatacatttaagaaagattaataaaaaacaagtaagataattattacctgtttattccagttcagggatgagggtggacggagcctctcccagcagctcagggcacagggcgggacctaaccttgggcaggaggccattccatcgcagtacgcactcacacacacacccacactcagactgggacaatttagacccaccaattaaccgaatgttcacatctttggatatgggaggaaacaagagtacttgaagaaaacccacacagacatggagataacatgcaaactcactccacgcagacagacagtggccccagtcaagaatatattttttttttctctcatcaacattataatgaaacaacatggaaaaaaaatgctatttcagggcctgctgtatgtggaatctaaaaatgttgaacttacagaagttgagagtggaatggtggttaccagaggctggggttacgggtagatacagtaaggggaaaagttggtcaacacatacaaagttacgcttaggaggatgaggtctggaggtctggtgacctatcgcacagcaggagggctacagttaataataatgtatatttcaaaatagctaaaagagaggattttaaatgttctcaccacaaagaaatggtagatattcgaagtgatggatatgctaattagccagatttgatcattccataatgtatacaggtattgtactgcatgcatatacacatattttcttttgttgttgttgttgttgttgttgttgttgttgttgttgttgttgtttaagacaaggtctactctgttgcccaggcttgagtgcagtggcatgatcttggctcactgcagtctctatattccaggctgaatcggtcttgccactttagcctcccaagtagctgggacataggcatttgtcaccaggctaatttttgttgttgttgttgtttgttttttttttgatagagaagaagtttcaccatgttatccaggctggtctcaaactatacaattattatttgtcaattaaaaatttaaaaagataaccacaaaaaaggtaatcatgtatgtcactgtttttctttgagaccttctattatgtttatgcttggtctatcctccatacctacgatatccttatacacccctaatcttgatagtctttacaatttaattatcagctataatatttaaaccatgtgaactttgttgcattatgccaggtgatatttttcacttaaaattttttcagctaaccaattttctcaataccgtttgttttcaaaacatccattcctctctccatttatgtgtgaaggttcttttataaattactaagtttttatatgagaatgtatttctgagcattcaatttggttttcacaattctacaaatgacacacactgtttttaaaattactacattttaagtggctgggaggttaatcccatgtccctaagccccccaaatccctctttttaaactttccttagataatattggctgtgtttattttgaaattaaatcttcaatcatattattaaggtctagggtgatatctaattcccaatttcatacttgatagctttacagctcttaatttgaaaagaattagcatcttaatattattcaatctttccttccaggaacatgatatatttttccatgtcttctataattctcacaatatttctgatatttactctttgtagactcaaccttttaattaggtcattccttagtatggttttgttattttgtgaataaggtctagcttttttcaactatatccttaaatagttattgctatccttcagaagaaacgcttctagttttcttattgatcagtctattgaaattatgtctgcactactaaatgatttagttagtgttccctgattcttgtgcattttgataatttcacaatcttttaaaaatttataacaagagttaaaattttatatctgctataggtcttcagatttctggtacagtatgacattaagtaatacttctgtatatttgtctccagttcagggttgcgggtggatagagcctcaattttgagtttgtacttcaataacacaacttcaacaaagttttacagtgaaagacatatttttcaaggaaaaaatgtgaagcaacattcaaaataatacttattaagttttgtggttcacaaaggaagtcttctatctaatcaagattccttatttctcttaaatcaacgaaactttcctttgctcagctacacacaaatgaatcagaggcaggattcgtacctgccacttcaaatgatgccaacattattgtccagagtgattgtcatgacctaccaggaggtactctattcctcctaggagccaaatcccacacaacaaccttcaagactcaactcctctaggaaaatgctctcatgtcaggatggctttattctgtcatttccttcactcttgcaaatctgcaactcctcccttgacgttcctttgccttttcccatttataatataatactctcaaatattttctttttatacattgagaatcataatagacattgttataattttgcttcaaggtcaaacatattttggaaaactcaaaagaagaaggaatatctattgtattttacccatatttttgctctttcctttgttcttttttcattatgttccaaaattccttcttttttcatttcttttgtttagagtacttcctttagtcattttcttagggtaagtctgctggcaacacattcttttagttgactctggagcctcaatgttatctaagtagtccaggttctaggaatgtatctccaaaaaaggagtcctatttcaattataaatcttatatgtgggttgtgaagtggtgagttgtgatatcagaactgaaactacccagttctttcaaagcatcctacataataaagggctattgttgaggcatatgtggtttgtggtacctgattctatactgggattttaccttttacgcatatggaagtgatagaaacaaaattagcacagcacttcactgagaatgaaacaggagagtgagaaaacattactaacacacttttcaaaggctgttgagactttagtcttttcagtattactaaaattataaaaaaaagaattgtgattttaactgtaggtgtttagatcaaagatcaaatggagttaaggctcaaagttaaatgtttatattgaggtggtgggtaaccatggccttaagaagtgctggggaaaaaatatcagcacatcttaataggacaaactattgatcttaaaaatatcaccaactatttcactaatctttctctgtcattgtgtgagatgctacaaaggaaaaaaatgaatgcagagctagacactccttagaatccttccatcctatctgaattgcaaagaaaggcagtgaaaatttcaggaagtgatgccacaagaagggtgatgttcctgagccttttgaagtcacaaaaacagtgtaggctggatcctcattttcagacttcacagcacagcatatgcccaattgacagcctctgggcacatccacaagacacaaaagccagtgttctgtttaatgcactgtctagaatatctggtgtttcttgaaagactgcacaaagcagctagaacaagtaatggcagcacctctagtctgagcagttctgtctaccaactttgctaacgactgtctctttggctcattaaattattctgtctgagtttcactgggaaggtacaaagtcatacgtgcttgtacttctcatgaccctgcaagaactctttcattaaaaaatcaaggtggaaaaccagcattattagattaatagactatgcagtggccctaagaggaataagtaattatgttaagtaatccatatcaacttaaacttaaaaaaaaaaaaaaaagcccacaagtgggaacgtgccaaaaccctacaagtgagaacttgccaaaaaccctattgtgaatggtacaaataataaatcaatttttggtaagcttgtttaatcaccatttgcttaaaaaagtaatatatattaattattttctgtcctgttgtgagaacaactaattatcaggaaattcaagaaggctgaatgcttgtgggctttttaaaataaaactaaatgttattataaatgtaatataacaaaaataaattaaaatgtgttaaaaatattcagcacacccaaacaatatggttagcattttggcatacttccttcattttttcccctgaagcaatatacatccaattttgcacttcaaatttacttgacattaaatagtaaatgttatctcacatagatacataaacccataataattatttataataactattatgtccatttagtaaatgaaacataagttgcttaattagttattctttaatttgtggtataaaggtttatattttttacaattatgtttttaaaatatttaatgcattacttcaagaatataatttcttccatatgttgaataatttgcttgaaaaatagtcccagaagtggaataactatgttcaacattatgaagattttaaaaaataatttgaatgtattgcataatttacttttgattactttttattataaaactgtgtatccatgctgattttaaaagttttgaaactctatgaactatgaaataagaaaatacttgcaatctcctagcccacaaatgaaattaatttattttgatagatataattttatttttttctgtgaagatatgtcttctttcaaaactgagatgatatactcaatttagtcatctacattctattattttcattatgatgaatattttcaatataatcaaaaaagtcttagaaatataatttaattactgattccacatgtgaattgatatggtttggccgtgttcccacccaaatctcaccttgaattgtaataatccccatgtatcaagggcagggccaggtagagataactgaatcatgggggcagtttcccccatactgttcttgtggtagtcagtaagtctcatgagatctgatggttctataaaggcaaaagctctcttgcctgctgccatggaagatgtgcctttgctcttcctttgccttctgccatgattgtgaagcccccacctcagccatgtggaactgtgagtctatcaaacctctttcctttataaattacccagtctcaggtaagtctttattagcagcatgagaacagactaaaacatgaatagagtacatttaatcacacccttatcattaaatatttaggttattttgaattattttcaaagtgttatgtaaaattatgtgatgaagtttttctcacataaatcttggacaatatcacttgacgaaaaagtcttaggcttcttaaactgaaaaatcacattttaagactattgcaagatttcccaatttattttttaaaaccattcgtttctaaagttgcaacacaatttgaaacagaaaaaaaaatgtgctgtcactatatggacttcctaaaatctttgataattattctttaaaattggatctatcatagaataaccacaattatataataatttgtcatcaaaataaaatatctagattagtttgctaggcagtttagtgtctggagaagctaagcaaaatattgtaagatttagtttgagccataatttttttaaaagaacaaaaggatgtttgcttggttcaaaaaaaaaatctgtggaagatttagtagaggcccttaactacaaagatgcccacgagcagctctgcagtgctaatgagaagggagacagagataggtataggagagaggagggaagaatagatttgggttgaatttagagattctttttattatgtgagcacattagaattttacacaaaagaaggaggaaaattatactttttacataaggatttaaatttaaggtatagaactctaacatttcaggcaacggttggtggaaatattttggaatattgtgtaggtcttcttatcactcaaactccttccatattcttgatattttaactgacagtcattatcaataactgtgaatcttccttttctattaatgtaagtagtatacacacatacatacatacagaaaaggaagagagacagaatataacatagattttgagccaggcatggtggctcacacctgtaatcctagcactttggaaggccaaggtggttggatcacctgaggtcaggagttcaagacaagcctggccaacatggtgaaaccccgtctctactaaaaatgcaaaaaattagccagatgtgatggtgcatgcctgtaatcccagctactgaggaggctgaggcaggagaatcacttgaacctgggaggtggaggttgcagtgagccgagatcgcaccattgcactccagcctaggcgacaagagaaaaactccatctcgaaaataaattaaaaaaaacagattttgatcttggtgctaaaatgaatatgcattataggttatcaaaagtatctcctatctaaactctaaaatacaaaattaagctatgtttttatggaatggatggtgttaatgattgttatagttagaattctttagcagttcttttgctaaatactaatgttggcccaactcttccacaatttagaatagaattatggattccatagtagcatccacaacaaaaactcaaggaacctcacttccaccaaaaaaaaaaaaaaagaaaatgaaaacagatcaaagctccttaatgaaggaaaggggagggactgtagagaatgaggaagatcttttgtggttcctaagctcctcagtccaactcttgtgtcatcgcaggacataaaaactaccaattgcccacccagattttataaaaagtaatgcttgatggggactgagcctgcactagagtccatttgtcctaacttacttactaatactatttttattccatcaggttaactttgagtcacagtacactggtcatttgcagattctactacatcattcagaatgattcaaggatttaaggattgaatcattcaaggattatcagtgaccacttagaagccataagataagagatagataaatgacagatatagatagatagatagatagatagatagatagataattgataaatagatgcttttacaaaatacaaacttcaattaaacttctaaattgcaaaaaaaaaaaaaaattcacttgccgaataccactcaatcaaagttttttgagaagtaaaatatatgactgtggtttttagaagaaaagtaaaaatgatgatgtatcacaaacatcagataaaggaatggaatccctgctgtttccatcagttgtctgtctcctaaagaaacaatattatccaagtaccttgcacactgctggttcacaagggtggaagcctggagaaccttttatcttggaattaacaaataacaaaactacagtctttcttatttttaaaatatagcctcaaattcatgataaaactccttgattcatttcactcatttatttgaaattaaaaacagatacaacatacaaaagcattgtatattttcagtcaaattttgcaggctttgggagattgcactatgacttttatttaaattaatttgtgttgactttagaaatatctattcttacaaggcatcttttaacttctactaatttttctgtggcatattcttcctgtgccttgaattcaccatattcattatattttcctcagtatccttatttaatgagtttaaaccacttagggatattacttcaaagtattaaatgatgagagatacagcatatagaagtctcccttcatttggtaccaacgtgaaagcaaaaggatttataatttagattctctaagcatttttttagctgtcaatgattattaggccttatactcatcaataaaaccaaagaggtagtaatcaatgatagtgagcaccagaattctggtagcttagcaatgcaagcgcttcagaagtaagttattatagccaactaattccaaagtttacaaagttgttgtaaagaaaattggcacttgaagtggactacagtgaaaacaatcacagaagttcatggtttaccaaaagttctagtaggttttagttgttgaaccttaaatatgcaattaaaaaaataatcatagaacaacactacttgaataactggtgatttgtccattgcaagcataagaaataagatgggggctgggcgctgtggctcacgcctgtaatcccagcattttaggaggctgaggcgggcagatcatttgaggtcaggagtttgagaccagcctgaccattatggtgaaacctcatctctaccaaaaatacaaaaaattagtggggcatggtgatgtacacctgcaatcccagctacttaggaggctgaagcaggagaatcgcttgaacccagaaggccgaagttgcagtgagccaagatcgcgtcactgcacactacagcccggcaacagcgtgtgactaaaaaaaaaaaaagaaagcagatgtgtctacagttggcagaagagtttgttttatacagattataaaatattatgagatttatgattataaagaaattaatgcctcttttaggacaaagacattgttgtatacctcctctaggaactaaaatataaggttgacttctctgtttccaagtgttttgcattaaagcaaataaagcaggtaagggtgaaataatacacccttatctggatataatgtgatatacaactgaccaacattaattttagaattatattttacaagttttttgaaagattacattgatcttttttaagatattgctagaaggcaagactttgttttacctgcattttatctgatgttcttttcttagcaaagatcctggagaggttctagtttcatcttttttcccattattaattggccctgtaactaagtaaaaaattatgaataataataaattgatagtgcttccattgattaagcatctggtgtatgccaggccttggcaaacctttgccctctgaaatacctaatgcacagtctgtgggctactcttcagataacagagaaaaaaataaagctacattttcctgggtcttgaggttttgcaagcattttctacattggaatagaaaattcgtgttcctgtttctctacttcactggtccttctcttaacaatctattttttagttaataaaattaaaattcagaaattaatgtactatggtactgcccaggctttaaagtttaacccaactgggttataggatttggtaacagccctgagagttaagacaggtgatattttttccattttactggtgaggaaactgaggcttagagggattataatatttacataaagtcatgcaataaggaaacattaaaatcagaacttgaactcctctgtctcaacttccagtctctattcctatacaaagtagaaacatcaattgaatgcaagatcatctttcaaaattatgcaaactccatgcaaatgaggacatccacgaactaattaggaaatatcaagtaacctgacacataaaatatgagaaacattccataaatattaattctggtgatctttcctacataaacaattgaatgtggtctaccttttcaaatggaaagtaaatgttgagatgttacgtcccatgtgtttttttctgtttatcttgtcattgtgatttatataatttttgataaatcataaaaatagaaaaaggtacagagaataattagcacaaaagcatatgttctaccatgctaaattaataattgtaagcattctgccgaagttctatagtggtgttttgggattagcaaataaacattacacagaaagttgaagcattgttttcctccatcctaaacacaaccccactgcagttttttccctctctctcaagaggtaaccagtatcataaagatggcatacacttctagtccatctttatgtgcacacaaccacctatgtacacataaacatctatatattcatgaaaagtatagagtattgtatacatgttttaattttaaataaaagacatttcactgaacttaatattatacaattttttgtatagtaattttcattcaggccaggtgcggtggctcatgcccataatcccagcattttgagaggccaaggcaggtggatcacctgaggtcaggagttggagactagcctggccaacatggcaaaaccctgcctctactaaaaacacaaaaaattacccaggcatggtggcgagcacctgtaatcccagctacttgggaggctgaggcaggagaattgcttgaacccaggaggcagaggtttcagtgatcagagatcacgcccctgcactccagcctgggtgacagagtgagactgtgtctctaaaaacaaaagaaaggatttcattcaatatcataattgagatatatccccatcagtatatctaaatttgttgctgaagtagctcctctttatctcactttttgtggtttaaagatattaaatgggatattccagaaataaacaattcataagttttaaattgcacaccactctgagtagcatgtcaaaatttcactttgtcctacccaggacatgaatcatcccttggtccagcatatccatgatgtaaacactacccatctattagtcacgtagcagccctctgagttatcagatcatagtatatataaggctcagaactatttgcagtttcaggcatccactgggatcttggaatgcattcccatgcgaggacaataaaagtcccaaggggggactattgtagtacaatgcattttatcagtccactcccttactaatagatatttaggcttttcctgattcttctctattagaaatataaccagttagtctaggaggttcaacttattgcagtaaaattaggtgtcactggtgtagctctgagccttcatctgcttcctctatttactttcttgcccacaaccacaagaagaggaagagggcattgtatgaaagcagagtgtccctgaactcacccacttaccaagcccctagcctagattcactcagaaattgcatctgtgcaggtaataggggagatgaattagaaattaccaatgttcactattagccaattctcctttgggtgcatggtggatgaaattctctgcccttttcaaggtaggtgtgaccatgttcatattctggccagtgagatggaagcagtcaaattctacaaactggaacaggcatcacaccgatcactctggcttattaccagtcagatccatgtgaagagttttatttcttcaggcctagtggtcccttgcaggatgcaatcatatatgtcataccactgatctttagttgaaaatgcctcttgtcacttgggtaagactgtagtcaacaatttcatccaccctttagggtctcctcccataggcagggggtgtgtgcagaatctcctccacctgactgtgtcctcactccgccatctcttcctgtagcactaaccatgaacattatgctgtctcccatgccagtatcccatactctcaggtacacaggaactagggaagtgactttcttaggatattacacagagaaggaatagtttttcctcataaatcctgcacctgcactctttgaaatatttatagtcttttttttttttttttttttttttttttttttttttttttttttttttgagacggagtctcgctctgtcgcccaggccggactgcggactgcagtggcgcaatctcggctcactgcaagctctgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccacacctcttcttatgtcaacttggattgtgatgagagaatggggccagtcaaccacccagtgaactctgtaggtaggctgaacccgattactttggtttctcagaacctctgatgtgggccagttcctccttgtgggtctcagctttaggatcaccctgttatgtacaggaggctgctacaaaaggccttgaaaatatttccttgtagaaatgtgcactgaacatacctagaagtaaaagtcttgggttggaggtttagttaatggtcataattagtacaactattcctgaaatttttaaaaaatagacctactctgaaacaagtccccctggctcctttgctctcaccttcccaccttaccctgagatgcttgctctgctgtgatgacctcttttctgctaagcagagttgtttttcactcttaagaacattgatgccctgcttctctacaactgccccagaaataacatgccctggcctgcaacttcctagccacctccactgtcaataaatgaagcagagggtcaaggacactggtccctgctgacctgtgcccttcagccagctgcactcacactggagagtgtgagttctgtcttctaggaggaccctgatccctcgccccaccgactaccccccacaatgtgggtcctgaccagcaggggataggaggacctctcatgcctcgctagggcctttcgtgattggtggtgttggaggagcccacagaaatgagaaaattgacaaagtaacccgaacggttgcctaaatgcagtgaccaacataaggagccaatggattaaaaggataggaaagatgagagtaagaaaaagaggctcgatgaagagagaatagaaacagggagtcaattcctgattaggcaactttggagtgaacaagttctgaacaaggaaaaatctagggagagaataaatggggcctgcctagagaaactaagaataggccaaattatacaatgatgttgtcccttctatagcctgttcccataaatacttgcctttcaggaaaaaaaaattaggtggtacaagttgcagaatttacacctagacctcttttaaatctgagaaattattctaccactgttggttctgagtaaagaaaactttatggaggatgtatactactgtgtgtgcttcactagcaaacctaggaggaaatatttattataaaacacactttagggaccaatttaaagtaatcagtattatattaaaaatctaggatcagagtccagaaaactatagattgagtatgatttgggataagctactagagaagacatttcttttttcaatgtttatttgatgtctatatgtttgatatagtttggttctgtgtccccacccaaatctcatgtggatttgtgatccccatgtgttgaaggaggagtctcatgggaggtaactggattatggggatggattttccccatgctattctagtgatagtgaatgagttctcatgagatctgatggtttaaaagtgtgagagcttcgcccttgctctctttctctctctctctctctctctctctctttctctctctcctgctccactatggtaaaacgtacttgcttcccctttaccttctgccatgattgtaagtttcctgaggcctcctagtcatgcttcctgttaagcctgtagaactgtgagtaaattaaacctcttttcttcataaattacccagtctctggtagttcttcatagcagtgtgaaaacgaactaatacaatgttcttccactgttcccatttctcagaaaacatgttgggatcttcaacctgatcaaaccagctagtatacagtgcaaagtgacaaatctttaaatacaagcccttgacaccagggactgtaaactgcgccagatcaaagaatgggtaaatgtttactgatctttttacttattttccaattaaaaaaaattcttctgtgctcaagtaatgtatctaatttttaaaaatctgcataccatgtcaaaggacaaaattggagcactcttattttgtagattttcatttttttaatagcctgcaaaagcgtacttgagcagcaatgttgcttctgctcattcaactgcagaggtacaagagggaaaagtcaaatacagggggctgacagattcaaatattcacttcttgagacaccgaattatataaatgttcttccattaatgaaactggctgtatgccatttaatttagcctttattcagaaagctgctaaataaatgctagtgaagggggatcaaaaaataactattataccaaagaaaaatgactgtgtcaaacttaaaaaaaaaaaaaggagtaacatgaaactacatgagattgcccgtggaaaatccccaggctctgtctttaccttttctagtctgttttctccatgtctctttccccaaaccccatcatcagctctcttttgagtttatttaaattatagaattttctttaacatgatattctgattttatcttgtgacattaatcacagttatgcagctatatagaagccttgcacattataacatgtcctgctgatcataccacaattaactcttgaagtagaaaaaaagcaaggttgaataaaaattactcttcaaattatccaaacagcagattcactcaaaaaaaaaaaaaaaaaacccagtgaaagtaacatcgatttatgcattcctccaactatttggaggactcaaagatcagaaaaacaagttttcccagtaaggaagataaatatttgtttaaaaaacattagaaaagcttcacaatttaagactttctctttacttaaataaaaaactctcaagtctgccatatgatggctgccagtgacatcattgcagacaaaaaaaaaaatgaattaccctcatggttcacttgagtagcatatacatcagtcaccatttaccgacacagagcactgtcatcatacatccagatagacacaggagcggtactaagggagaagaaaacagttattacagctgagtgtcttacagtctaaagacagtcgagaagtacatatgccatgaattgaaaaaaaaaaacaaaactggagaatcacagcaaatgcactggtaaaatctacttataagtaatcagagagaacgtgaagtaaggaaaatagaaagtccaggacctgcaatattcagctatacctggcattttctttcattaaaacatcccagtcttagatttattttctcactcatgatcaaaagaatacttgataatttatttttctacttctttttaacagttagatgcccttaagtcatagagtaaaattggaaggaaagaaaccagtttgaaaatcattccattgtcatttatcttacaaattccagtttttctattaagcgttcttaaaacagacaattacaatgaactaagtagacgaataattaccttgtataaacatctttcaaaagctttcacaatcagcatctcaaatgcttagagtaaaggcatcgtatctatggagcttgtttaacactgagcacaggtatttgacagatgcctttaatgagaagggtgatctcaccagactcctagaatcagagaaatagcagtgcttaaacaagcggcttagattttctacaaagcatagtgtttgtgaactctttcatgtagccctagaataaaaatgaagacctaagaatcgtgatcaatacttcagcattttaaaaatataagccacactaacaggaaattcaaagaaatatcaatgactaataaacaaatgaagaacattcaatattactaataatcaaaaaagagcaatttcaaacaaggtgtatttttttttttttttttgagacggagtttcacccttgttgccaaggctggagtgcaatggggcgatctcagctcacagcaacctccatgtcctgtgttcaaacgattctcctgcctcagcctcccaagtagctgggattacaggcatgcgccactgcgcccagctaattttgtatttttagtagagatggggtttctcgatgttggtgaggctggtctcaaactcccgacctcagatggtccgcccgccttcgtctcccaaagtgctggattacaggcgcgaaccaccgcgcctggccagtgttatttttttctaacaaattgagagaaaataatttattacacaagatgaaaaagtcaattattaaaatgttgaaaaaccatttggaaatatacatcaaaactggagatccatttgtttgtttttgcctttgtctaataattttcatgctagaatctatcttaaggaaataatcagctaaaactagttatatataataattattgtacagttatttttataataaaaacatactttaaaattaaatataagaatgatgaaataaatatgacataacctaataatacataggttacaaagtaaaagtaaaaaaacaaaaaactctgaaagtgatctttttgacgaattaccagtaaaatgaataaatgctcaattgttgagtcagaaagtatgatggtatcctgtgtgtatgtgcacctgaaagtaaaaaaaaatcaaaaggtgaacattgattctgtctcaaaaatagaatcacatgtgagtttcttctgctatttatctcactatttacaaattatcttatatgtactcctgtacataaaaaaatttaaaaagtgaacttagagatagtttgtcttatatagactactgaaggttaattccacaagacctgcatagttatcttaaaataagtttacttgtgaagaagtgttattggggatttttaggaagaactttgtgaagagagtgttcagttttctttcaccaaagaacatatattcgagcaaaagatgatacttgggaataagctatcattctctggaactagcataatagcaatccaggaattaattatcctcctggttcccttgagtactgatttgtggaaacagcaactgagttttcaactgtatatcacagagtggtcaacggcacttcaggaggatgtgctaaggaggcaattaagacaaaaatgaaaccagcaacacagacagagagaaatacatttgtattacatggagaatgcagaaggatcaactgcagtgacatagaaaattaaatgtcccaaaatataaaatgagaagtaaaaatatttccaaaacttgacctttttataaaagtgatatattagaaaatttagtttcatgtttatatagttctttggcattttagaggaaaattactatatgaatcccaaacaccctataatccatctaagtccttgtttggtaaatatctcatggaattgactgcttattcatctgaagtgagtaaacacttatggagaacacagagctggatattctgccctaattcatttattattaaataattgtccatactctgagtagtcatttgttcattaattgtccaaaaattagctcaccactgtaaaatctgattacatgaaattacagtagcaccagaaaatagatgggtgataaaaatctgtgtatttcttatgcagcttttgagtgggttagatgttgacagttttgtgttgatacttgcctgctaaatctatttcctcttcagtcgtctcccacacagctcagatgagaacatagagtgtttctagatatctcttcatactcatccaaaatacatcaagcaaagggtgagggtaattttcagacaaaactttcccaaaaaatcacatgtttgctgaaaagaaaaaaaaaagcatataaaataaccatattttttaaaaaaagaaaagacaccatatttcaaggccatatttcagagctgtggttcaataatgatattagagaaagaaaaaaggaaaaccattcagggggataaatttctctaagactggactacctacaagcagcattcaaatataacatgatagcagaaatgaagagaatgaagaaacaggagagctcattaaagagtcgggcaaatggaatggtttctcttccaattcctctgttgcctctctcttctacacctctattccatgtacaactgattaaacgattcttcagcttgagtacattctttcggtccctaaacttactttgtacagtgttgtaagggaatttttaggttttaggcaaaaagaaagtactcattcccaggtgaaatttttggatatttaatagacaatcctcctgccctgaaaacagtatttcacttatttgaagtattttatgcattccgagtctatgttgcaaaaagtctttttcccttttgtggctccttgaaaaagtctatgctttacattaaatttgcttaacaagtgtggctctctgtggatgcgttcaatgtctctaacataatgagggaagaagaacctgaactaaatagtactaagaatagttacttaaatgtccaagtaaggcaacatgccttaaagatccaactttaattaaaaaggactatggagaaccatcattaaataattgtctagatacataaaagcagccaaagcaggaaaaccttcacctgtccttccaaattctaaggttgtaaagtctcaaaagaagtttcttttagtgcaattgttgctggtctagagtaacaatttttctgtcaaggaaaggataaatgcttttcatccaaggatcaggttacagctcacagaccccagtaggaagagaatagtgccaacgaattactgcaggagtcaacctgcattttcaaagtccataaataatgcaacaagagaacatatttggagaaggaatttattggccatgccttcatccatatgcattggtagaagcaccattctgactattttgctggtggggcatttgtattctactcaatgatttacatactgatgaggctatgagaacccagaacgatgttcctaggcattgctttttcagcactatgcaatttgcatctaagttcttgaaaaacagttaataaataagagctaaagaatattgcatgagaatgggagccagtgaaacctgtccacaaaggattaaactgggctgtctttcaacgtattatttgtgtcagatcagaaacaaccaaaatgatgcaatttatctgttgaaatgagaatacagtggtaagaacacttatcagaaaactcaatataacctgatagaaaaatgaatgaaaatatatcacagaggccagatgttttcacagaacagctcccatggatgtaccaatgtatacaatgaagaagtgtaaaatgcaagccttgaagaaataaaatccatgcccacaacattcagaactttactgtattgcatgcagcatttcaaatgcccaagctgtgcgactccccactcctccacatagccttgcacatcaactacctatggccacgtcacctttttttcccttaactagtggaaaatctagtattttgaaattcttgctatattatttaaggtagtttaaaattctagtaaaactagaaatgtataacattcccgtgaagaagaaaataattctagggttgttttttgagatactcaagaactgattttttttcttttttttttttttttttgagacagtctcattctgttgcccaggctggagtgcaatgaatgactccatctcagctcactgcaacttccacctcccaggttcaattaattctcctgcctcagcctcccaagtagctgggatcacaggagcacaccaccacgcccagctaatttttgtatttttagtatagacggggtttcaccatgttgaacaggatgatctcaatctcctgacctcatgatccgccggtgtcagcctcccaaagtgctgggattacaggcgtgagccactgcgcctggccgagaactcattattttaacagactgcaaagaggtataaagaaggctaggtattattctcacgttgcacacatacccgccaccaaggcatttttctctctttctttctgagtgatagatgctaaatgttgagaaaggataattcccttttagagttaaaaggctgaagtctatcctattttattgatttattcaataaatattgaatgcttaatatgtatggaactcagtgctacccttggaggtatataaacatgaaagagacatggacccttgttctccaggaacttacaatcagcaggagagagaagaggcagacaaattacaattaggtaaactagaatggaatacatagagtaggtaaagtacaaatcaagagccacagtgataccagtggggtatgggaggtccccaaacgctggtgggaacttgacctcagccagtatccaggctcttgacaccattgtgagaacgaattcaagaatgagttagaaaagagtgaaagtatagagatttattgaaaaatgaaaagtacacactcaagaaagaggagtgtgggtatactcaagaaagattcatgcaagggggtttggggctgctacctctatgggtgtctttaactaaagggtagaatatttataaacattcctggaaaagggtgatttcttggacttgtggtgccaccatttttacaccaaatatgaatgtgcctggaactaagacactggtgggtgtgtgacttgtatgttactgaggtcttaggagaaacctaggtcaaatccagtgccatggtggatccagtgggtcttagccaacttgacctacaccttggttttttagggtcttatcagctgtttatgcagctatttcaacagtttccacttgctagacatgtgaaactgctgcttggaattttctgttctcctgtgaccaccctgtctgtattgttcctgtctcagtggagttcagacaagagagagatacttctgcttggaggaaactgactccttcaaaggatagcctttttgctggtccgcaaacagataagcagttgagcaaaggcacagtgtagaatatatttaaagtaggattgtcagatttagcaagtgataaactttttaaactataagtattttcatgcaaataatgaatccaaatgtattttggaaacccgcaattcatctggcagtctcataatctaggcctacggagccactgaaggtgttagagtagttagagtagcacaatcaaggcagtgattcagagacattgctctggaaccagcaatgtgctggcttgaggttttaaaaaaaagatattttaaagatattttaggaaaaaaattaaatcagcttgaatgagagtagtgacagtaaaatcaaaggcaagaagaattttgaaagaagaatcaagaggacttggcaattgcaaaatatagaatacaagggagagggagaactcagaactgccacaagcatttaagcctgggtaacttgaggatcattgaaccatttcagaaagaaatcaggaaataaagaaacatgagaggaaagagaatgagcttagtttgtgacattttgagtttgcagagctgggagatcctcaaaaggaagatgtccaatggctttggagaaatgtcagagctagagatagagatctgagagttatctacttagagaagagaaaaactaaatctccatttgctttctgtctttacattatatttatcttatccttgatatgatgctgacttaattcccaaatagagagaaaaggtttacaccacaatctgtgtttgtatttcgtgtaataaaatagcattgctgatgctttcagtgttactattctgtgcagaggaatcattcagctataaggtgagaccaatttggattcaaatcccaacttttctcttacagtgtaactgctaaaacaactatttaaccggtttgacccttagctttcttacctgcataatgtatgctcataagattataataaaaacaaatgagcttttatagctgggcgcggtggctcacacctgtaatcccagcactttgggaggccaagttgggtgggtcacctgaggtcaggagttcgaaaccagcctgaccaacggggtgaaacccagtatctactaaaaataaaaaaaaattagctgggcgttgtggtgcacacctgtaaccccagctacttgggaggctgaggcaggagaatcgcttgaacctgggaggcggaggttgcattgagccaagatggcaccattgcactccagcctgggcaatagagcaggactccatctcaataaataaataaataaataaataaataaataaataagcttttatagataaaatatttagcatagttcctgccacatattaattgctcaataaaagacaactgttactcttattcttttactgtgaaggaatttttgtctgttttaataatcaacaatagcaaaaaagtctaagtgtacttaaatgttcaggctgctatatcaggtgacaaactgcttacatttaatatattgtacttacttgcgattttaaatcctaccaagaaaagttaagggtacacaaacaaataattggtgcaaaagtataaaaagcaggcaaatcagtaaaatttttcatttttccaattgcaaatgcattttaattttaattcttttttaattgacaaatcaaaggtgtatttatttaccatgtacttaattgacttttatgctgaatatacatatgttctgccatcatgaagatgtagtgaatagcttccaggaataaagtccctggcatttctaaagtaagctaagtaaaactattgatcttgttctaattaccaacacacaggactatttttgacattaaatgttatcatcatactaacaagactaatatttttatcctgccacaaacaattatttaatgatacagtaaaaccccaatgttctgaagctaaaaaggctttaaatgagtgcacaatattggcattgacagaagaaattgaacactatttttgctgactttgttgtattttaaataaaattctgcagttatctgtcatatcagaccaaagggaaaaccttatatattcataggaagaggcagttttgacaattcaaatatatgcatttccaagagaaactaaaatggcttggaaggttagttgaattgagcaactgtgcacaatttatttccaaacatactacatttctgcaaaaccatgacaatcacctggcatgaactctggttacccaagtgaaaaacttgcctgagataatctagtgaaaacaacaaatagcagttgttttcctaattgagaagttcggtaatttgaaactgaagtgaaaaaggttttagaaaggccactgggacaagagttctctaaggttccaaaaattttagtatatcctactaatatccgagtttattatttctctcctaagctggtgatatcactcctgagtccacctcatagatccattaatcactaggtgtaatagtacaatactttaattcattttgaatccttttgagtgtcaggtgtatttcacattgttaactgacttgtatggaagactttgatttcctgtgtgatgtttgtaaattgctgtttgtctctttaaccacgtactttgaatcatcgttttctctgggaagtcaacatttttctatggccatgttcgtcaaagaatggtcactggaccacctgcatcagaaactcttgggatgtttgttaaatagcagatttctgggcccttcccagacctactgtatatagatgtctatgggttaagtttaagaattcttgagtgaaccttaaatgcattaaagtttgattatcaatgttctataggccaagagatgggaagaaagatttcaatcttttttttttctaagaagaatcactttttatttaagtagatcggaacattcaatacaatttgtattagtctgttttcatgctgctgataaagacatacccgagattgggcaatttacagaagaaggagctttaatggactcacagttccacatggctggggaggcctcacaatcatggcgaaaggtgaaaggcacgtctcacatggcagcagacaagcaaagagaggttgtgcagggaaacacccttataaaaccatcagatctcatgagacttattcactatcatgagaagagcatgggaaagacctactcccacgattcaattgcctcccatcgggtccctcccacaacatgtgggaattcaaaatgagatttgtgtggggacatagccaaaccatatcaccatttatgcagaaacttaattatttgtaatgtattaacagatatccaaggaagacaggactccagtcttctcagcacgttcagagctaaagctaatctagatgcctctccagagatgtaactgtttggttttgtgggtgataagagaagcttaaaaaatagctatagatctaattcttatgatacatgaaaacatttttaggagaaataaaagcaaatattccctaacattataggatatatatgtttccgtggctcaggaggccagggttttttacaggagcactgagaaatttagggaagtattgttttcttacagtttcattggtctgtttatctatccttcaccaggtggcataaatgctccaacttggttcttctgtctcaagattgttttaactgttttactttttttttaatttctatatgattttagaaagagcttacactttccatggtaggctgagtagtggccccaaagatatttaggtcctaattcctggagcctaggaatattatttatacagcaagagggactttgtggatttgactaagttaaggattttaaatgggagtattatcatggattatccaagtaggtgctaaatataatttcaagtgtccttataagagggaagaagagggagacttgactacagaagatgaaaaggcaatgtgacaatggaaacagagattggagtgacatggccacaagccaaacaatgctgggtgccagcagaagttaaggagaggaacggaacctccctggcactgactgaagaatgtagtaaaacaaaactctgcaaagaaacaagttggtctatatggactagtcacaaagggggttaggatgaactacatgcatcactccgtgtgatgaaagagcagaaaatgcgtcaatggaggagatcgtttcacgtatcctgactccatggaaaattattattagtactattagtttagagatgggggtctcactctgtcacccagcctgcagtacagtggcacgatcatagcgtcctgcagacttaaactccttaaactcaagtgatcctcctgcctcagcctcccaagtagccggaattataggtatgagccaccacacctagcttgctccaggggaaattattaaggtctcgtaaggtatgtgtagtggctttaagtggcagttttgccaaaaattatgcagaatattcttttgccaaaatttatgcagaatattcttcatatagttggtccttatttatgaccttagtaaagaactgagggcatttatcatggtactgtgacattgtttctacaggggactaaagtaatgacagtccacctacacagattcagtgaccaaaaaaaaaaacccacttccattttttgtgctgttaataaatggcactttacatatataaatgtaaattatttgaacattttgcaaggtagatgttgttatctttaacaggtgaagaaactgggttcaaagaaatagtttaagttactcaaagtggcagagctgggaattcaattcaaatctatttgaaacaatgtagcccatgctttttctatatttgatatatgagaatgtgttagggaaaagtatgatagtatgttctctaaattatcccatcaaatacaattggctcaatcaagttttggataagaattgaagcttcctgtacaagtaagtgtctaaatacaggtattgtgatagtttaaaagagacttaagggaaaaaaaaaagaggcctgaacactttagttaattcctttgtatgtaaaaatattgatgatttattgtgaaagttcaagatcctcttttggtattctggtgtcaatgaagagcgaattcatttttgcacaacgaattcaaggaaaatcaggactgaatttgctgcagcaagcaactttagatacattccagtgttccaataagaattcatcagaaaactcagaaatatacagcataacatatgaatgaggtggttttagcctaaaagtttttgagaagacgttctgtgtctcaacatggtggttgtacagtatttcattttaaatgcactgaagcttcactgccttccaggagccacttaatactatccctttgattggggggtgcaaaaatgatttggggttagatttagttaataatgagctgtcctttctgaaaacaattggccaggcaggttctagcttattaaaatcaaccctacaatgtgatgataaaacaatattgaagattacttcgatagaagtttatctcttatgaagggagcacacagctgttttatctaaaatctgattctcattacctaagtattgtttaagaatgaagtcgaaacatgtagttgcatgtcagttgggctggggattttatctgccaaaatgccttcctctgatacttagggaggtatttttttaaaatgatccagaaggctgggcttgtggctcacacctgcaatcccagcattttgggaggccaaggccggtggattgtctaagctcaggagttggagaccagcctgggcaacacggtgaaaccccgtctctactaaaatacaaaaaattagctgggcgtggcagcatttgcctgtagtcccagctactcgggaggctgaggcaggagaattgcttgaaacctggaggcagaggttgcagtgagccaagatcgcagcactgtactccagcctgggtgacagagcgaggctccatctcaataataataataataataataataataataataataataataaaatccagaagataaggacttggggacataatcagagattgtaacaatagttggatggtctactgagtcaaatgatggcaatacataaaataaggaaacctgtttttctcactggaaaagcatgtttttcttgagatgaccaaatatagtcaaattcagcaagtatagttgtacaactattattgttcctaaattttgtatgtctcttagagacattcatttacacattttaataatgctgagacaattgttatccaggactgaccttgatgttgttttaatttgtcttgatggaatcatggcttttggataattaagtgattatttgagtttctatacctaagaagatttactaatgtgttttcaaaaatgtaactgcaccattttgagaccagcttcctctttgctgaaagttaatgttacttttaatacattgctaagcacaaacgtggggctcatgtcatcatgcattattgcacagataggcaatgtctgtaatctttggatggtacatgggtctgtaccacattaagttgacccagagaatatccatctgggaaccaagggattcttttttcccttaatctaggattttttcatcttaaaaccaacacttcagggtagataaaccataggatgactccccaataatgctgaattccttgtgtttatgcctttttgttttgtcttccttttgaatgcaggtagagcctgtgatttgcttctaaccaatagactatggcaaaggtgatggatcatcacctccctgattagtttaggtgagacctcatcttgatggacttgagggagattctctttgagggattgatgaatgaaatggccatgttgcagaagcccatatggcaagggacttttggcagcctctaggaactgtgcttgcctccagctgatggctaacaaagagctggccctaggtcctacagctggaagaaaatgaattctgccaacagcctgagtgaggtagggaggagaatcatccccaactaaccctctagatgaaaatggagcccagctgataccttgattgcagtcacgtgagactctaatcataggatccagtcaagctgtgctgaccccaggctcctggcccacggaaactgagataattaatgtgtgctgttttaagctgctaaatttgttgtaatttcttatgtagcaatgaaacgctaatgtaagatttttaaaaatatcaagtcaatgaatgaatgtctttaatgtcagagattcgggagtaacctggtgtttttcactcctctgctcctgccatatagagaggaaagaggcaatctgtactgtgaaataaccacagaggttggttaatgtatgccaaaaataggaggatcagcagctgctgccagaggcctggcatttttttctaatatttgtagcttaaaaaacaagtgtccagtgttgtgctgcattgactagctaaagagggtgaaacagaacttgcttgttagggctcagttaacattcattatttagatatttttttagaccgtctgttttcagcagtctgactctctatacattgttataagaatttgacagattaatctgagaaaaaaattacattcaatcaagggatacttttaagatgttggagagttgagtggacagaaaaaaaataaacatacacagaggaatgcagaaaaaatgtcacgcaagagaaattttataggttgcttatcgctaaggtgcctgcaaactcaactgtgcttggtcatgcttgtttctgattgtttcctctgttacttttggcttttaaaataagtgctctaatatgtggaccaccactagtagtttgacagatttaggtttacttccttgctgtcctgcctatcttctttgagtctccatttctctaattatatattatatatttgtgctacgcatttctactatagtggattgggatataaatgaaaggaaaaattaagaaataccaattcaaagaggagcaaagatgaattgttcccccaagctaattaatctattcgttgcctcaaatatttgacttttttgtggttagaacatttaagatttactcttagttcattaggttgatttaatcattccacattatattcaaaaattatcacatcactctgtaccccataaatctatacaactataatttatcaataaataatttttttaaatgctcccccccaaatatctgagagtagtgtgtatactctttacaggcattggaaattatttacaaataatatgtgattcattatagctacgtatctttccatcctgctaattactcaaagattagcaaatcaaagattgagttggggagtttttcacagcagctaaaatcaaattatttatacattcttacaaacatggccactgtatttttcccgtattacctctctgaccttagatatatcatttgataggtccagatctcaatttcttaaaatgtaaattgagatattggaaacttattgttgtaaagttgaactgtgaattcactgtgatcttaacacatacctcacagagttgtttgaaagctgaaatgagaaaacatactttgcattgtatctgactcttggtaggtgcttagtaaatttacacgatcattcattttcttatcatttcctttgatttctagtttaattttctatttatgatttgatatggaggcagcaaaacctagacactatgtaaaaataagtagagacttccatagaaggaggtgggtttttttttctctcacaatggagtagttgcatttaacatatctatttacaaatgggtctgtcttccaaagcattataacccgtaattacaacattcaggcaatgatacccacacaggtaattcttaggactgtataccacatgacagtgaattcagctggggctttgcatatgcacacatgccatggtgagttctctctatttcctaggttgtggcaatgacaagatcatttattgctttccattgtcttgttatttattgtcacaacaatactaagcataaagcctcttcgtaattatgtagcagaggagctcacaaaaaggcattccataaatataaattagaattctcatataaattgtttccaacagtaagtggcattggccattgacgtattcattttattgcattttgaatgcaggattgattgttggtatctagacatcacctatttaacagagacatcttttctgcattgtgagtcactcacacagttttaacaaactgccaagcacattcaaatgtgtacaaaggataggtggcccaatgacatattccacacaacacagaattatttatcccacctgccataagtgtaatggaaaggcagaataataataaactgtatttcttgtaaatagggacacaagatttaagtctggagctggaataagccacatgtaggcacaatgtgttcatgatacataacagctaaattggtggatgagactataaattgtttgcatttagaagaggtgacttaatgaagaaatggagccagaataacagagtctcactgagaagcagaccccacaaagaactgtgttttgtaggcagaatgaagtgccaatgtgcaaaatatttccgaatatgacttttgacactgccatggcatgtttaaattggtggcaatttgtagcagtattggaatctagcagcaatataaaaatatagagggaagtcaactgtcacgaccaaacttggacaacttcagtgtattgcaggattgcaaaacagaacagttccagttatgttgctagctacaaggactgaaaaagtcaggcacagtccctcctggaacttcctccaggtctcagttcaaattcggaaagtcgtataagccttacccacgatctgacctaaccccgtgccttagcacttcttgctcatcttgcactgctttatttttctccaaagccctgctgcttttcttttttactaccaccccccttcactctctctctctctctcacacacacactcccatacacacacacacacactcacacacaaacttaattgtctgttttccctactgaaatatgagctccataagggctaatgtttttgttttgttcactgctgtatatacccagagcctacaggggtacctaggacatagtaagcactccaagtatttgtctaatgaatgaatacagtatgaaattagaaatcactgcatcaaattgccctatattttaaaggctggtgagttgaggcagaggtgtcatgtgcaagagtgtggcaattggtatacagtgacaacaccttggtacacgtgcttcagagagcagaaactcttgaccttctaacattttgaaggtctaagcctcaactctcctaaatacctggcagacacagcactgcccagcccagtcagcgtgcttatcggcagggaggggttctgccgatctgacagtaggaatggaatcacatcatgtttagagcttctagccatgtcaagggaaaatttggcaggtggtgtatggctgaaatgagatctctgagctcaatattatcccattcaaacgtccctttctcattaatgtaaagctaagcaaccaaccaaggggaaaacccacagttctttgtttccatcactgaagaaaagcaagtgtctttttaggggaatggttactgtagacagactcatagtcagtaatgggttaaaggtgctgaaagcccatctgtaaaaagctagaattactaacatttactgacagcaattgtgacaatggagaaagattttcttaaagctaattcaaacaatctctgagtggtcatttgtagcagtaaaatagtttgctgctgtgatagaggctttagagagatttttttttccccttatcgttgagctaaccaagcacatattgaagctcacttgggaaaggagggaaggaaatgtgggagacatatatctaattaaaaagtattcgttcctctgttctcaaactaatgtgctacgccattacttcactacataatgagtgaaacattggtgcaaaattaggcatcaccttaggacagcatgagccattaatcaaacaataattttaagggttgtcatggaaggaaggttcaggtttattcttggcttttttttttttaaagtagtgcaagctgctaggtagtgaagctctggaaaaaagaaacatcaaatcttaaaaattagaatcttttcctttaaactgaaataacatgcctattcattcttagaggttgtcacttctattcagaattgccttcaagattttcttttgggcttctcatcactgaaagtagtttagtctacccaaaagaagagataagtgaagttaggaactttaaattgttggttaaattgggtaaaaatttgggcaggtaaacttaccactttatgcttttctctcccatgtcataacctatacgaagactaaatacactactgtagcttttacacagtattaaaatcacagtttgaaggtttgaggtattaaaatgaccagttaattcagtcaaaaattaaacaaatggaatttggctgatttcattgccttgaaacttgttgatttgaaatttctaaaactactattgccttgacattttttcctggccgcttagacttttaaaatgttctcactgtgtcagtgtggatgatggaaatatctgtttcattcataacagtaaaatgccactcccatgtaagattcagaacctattgttttaattctctgtctccttccccttaagagcaaaatattattactcaattgagttttgaaatccctctgtgtttgaaagaggcccatttggtctgtttgctatggctgctgacacctctgggccctgcaactacatcagctccctgggctgtgcatatcagagctacaatgctgctcacacgagaggacagatgatttctttctgcagcacaattgtattcccccaggacagctaatgatcaatagtcgtatcttcaaagaatttgccatttgtcagtaggaagacaggtaagaggagacttgggaacactaaatggagaaaaataagttttatttccatcagtgatgtgattggtaggcagttcagcagatgaaacaagaaaggctaaaccaaaaggccgtaagttaaggaagtctgcctgcactatgttatagcaacaggagagcagcgacaggtaccaaccatagaaccttaaatgctacccagaaattgattgcagtctgttagtcaatcattaaatgaaatggtaaaaatgaccagtaagatacgttgtaatgaaagtagatctatgaagtaaaactttcgaaggagtaaatatgaatttacagccaggtaagaatcttagccaattaattcatactattaaaatttaagctaaaatcaaactaaatgaaaaattaaaaggatatcatatctggattacagctgagaataaaatgaaacaagtatgatatccagatcggtgcatttttttcaaaaaaatttttagataattagctttacataacccatattgatgggttgacatgttaccctttcctgacactctcaggaacacctggaaaatcaggccatttcttttaccatggagccttattgatcagtttaacagaaaataccacaaaatacggatttccaaaattctacgtagctgcaaatagaaagaattcaaaatatttagaattcttgactgattatttttccaaaggttttttaatctttggaaagatagaaaaacctagcaacagtgattgcctttagagagggaaactgaggcattaggaggcataattgggaaacatttttaccctatatactttggtatcttttgaaatttggttaatgggcatgtattatttatttatatgtatctttttaaatacatattatattttcaaatttatacattgaaacatttaaattatatatttaaaaatatataagtatataatttaaaactttctcaaaaatagtatttcctatctaaggcttgagtctttgggataggcttgcttctctgatccctaataggtctcagcacctaatataaaggtgaaataataaaccactaaaggctcactcaattgaccataaccttctcttaattcttctctcatttgttgacccaccttgccttaatcaatagaaaattttaaaactcatttcttttacttttgtaatatttcatgagagatatcaacatggggcaaacacacatatgcacaaatatatgcataagcactgatagatttataggcgtatgttaaatattaaactttcctttgagaaaaggaagatttggcctcttggagaaagtcaattaaggactgaaagtgggactgtgaataagtcaggtaagagtttgagaggaagcaattatatttgtctattgctacctttcacctctagaactctagtgaacttatgatgttatcaggaaattaagaattcagaagcctccattttactgtctttttcattggacaggtattatcaattcagtaggtgtgcataaaatggtagagaaagtttttaccctgtaaacataggcacttcagatcggggcttcatcgtctgttgaatctatctcccccaacccccaccaatttcctttttccttttagcatcctaaaagaaaaggggaaaagtaaaaattgtcttcacacggcttcttcgaaatctgggagtaggtacacttatctcaattttcctgggttaagattagccttcacactagtgcattcattaaattgtcaccagaaagagtacagcacagaaggaagaaaaaagcaatcttccaactgtggagattgaggaaaactgtgtgcttaatgagaaagaagagtagcacttaccattactatgatttcagaaaagaagtacagtgatgaggcacagtgacttttcgaagagcttgttatgcatggtctagaaaaaatgtcacatgtatttcccaggacaaagcccaaaatgcacagtaattggcagttacaaattagtggtgatcagctaaagtgtgtcttatttgtaaaacactatctcatttcaaacgtttcaagttgtttgcaccacttgaaacataaccaccaaggtttttctgaattggacctgccacggcaggtccaattcctaaatcagatatttaggaataaatttggtaaaatcacatataacctacacaccaaaaactatggaaacttgctcagaaaaactaaaaaggacctaaataaataaagtagtatactatgttcatggatttggaagctttactactaagaatcagttatccttcaattgatctatagattcaacacaatctcaatcaaaccccaaaaggctttttaaaaatatataaatagtgtattaataatattatacactatttataataatattataatattatttataataataatatatactatttataacactatttataatattataacaatataatattatacactattaataatattatacactattaataatatacactatttaatataataatagtaataatattaatagtgtattaatttcctattgctgctgtaacaagttcccacaaacttagtggcttaaaacaacacaatttatcgtacagttctggaagccagaagttaatgagtctaatacgggtaaaatcaaggtgttaatagggctggttccttctggaggatgcccacaaaagaagttgaaattatccttctcctttagcaataatctgtttgtttagcagtgataagccctgttcagcatgttagagaatatttgtttcataagcacttgagaaatgagctttgatgaagaattatattttagtagccctaagtatttacttatcaagattcttttaaatcttttgacatgttgagagaatcttgctattaattatggatgtaccacagaaaagttagaagctggtaagattgtagcaagtcagatcactagggaagtttgtaagaagtctatcatttccttgtaaaatgaaagttttcttaaagttgtcataaatctgtccttagtaatattttagtattttcttttaagcaatataaacctatgtttacattataaataatttttatttatgggacaactaataacatagattaattttaagctgtaaatataattccataattcctatagttgtacagcagacagaagtttcagtacataacctcatcagcagtctagattttttttaaattaaaacttcattctaaacaaaaacctgaatcttacattttcccttattaacattcctatatttaatataagaaagcacaacattattttgaattgctcttagtaaaatatcaaaacaataataattgatatgcgcagaagcagtattaaaactttttcttccaaaccacacatgccagtgagcaccacaatagcagtttcctattgcttttgtaaaaaaatactataaatttagaggcttacaacaacacaaatttattatcttacagttctggtggtcaaaagtctagaatgggtagacagggcaatataccttctgaaggctctaggacagaatctgtttccttgacttttccagcctattattactaccacagccatcaaatggaattatctaagagccacattaggatgaatgaagggaacttataattagaaaaatttccctagggtgttttaaaatttgccaccttttccccacctctttgcatggagaaatgttgggatagaaagtatgcttataatgtactgattcacaatttagatgaagtgcttgtttgctacttataaaaataaaagtgatctttggggtagaaagctttcacaaacataattgggaatgctagatgctacccctatgcagcaaatgcctagcgctttccttttgaaccctatgacagatgcaaaggaacccatcctaaaaaggaagacaagctgagccaaatacttacttggcagatctcgtgtctttcttactgataccaggacatctccacaaggacagatgcagtgcctggcttcactgtcaagaaaacgatattatacaaaatgaaataatatctgatagagaacagaaagtggttcttagccccagtatgttctgagagttatatccttcttaactatatgaaagacagaaattgattatataaaatacaagaaaacctctgaaaatttgtgaacgaagtaatgataaataggaagagatgattgattggaaaggtcataatacttttatggaaaaaatgttcaagaaacagcatactcagaagtagctttgcaagaggacttatactttcagaatagtttaaatttttcaaaatatttcagtatttattatcttatttaaactagatttattcagcctaaataagagaaggtcaaaaggaagataatgattttctattataagtaaaggaaatcaaatattaaaaatatgatcataaacctgctaattagggatggtacacattttatggctatttattgagggcctaatatgtgtcaggcactattccaggtactcgagttatagcataaaaaaagtcctgctctcatgaagcctagaccctagcagagaaagagaataatcacaaataaaaacgtatgatatatcagattatcataagagttaagaaaaataaagtagggtgagggcacagagagtgatggggagatgggggtgtctttctaagattaaattcatgtgacactacatgaaaagaatgtctaagtagttttccagagagaaatttattgtaaagtcttatgcagaaggcattaatcatccccaatcatctgtttagttaaggcatgacttttacgctctggggcttatgttttctgtatgtgagtttttgttggtgtttcttataatttatttcctttccagttgaggaaactttaggtcttcagaaattagttccaatccattaagattaaaggtaatcaatggtcttgctcctgaagaatgtcagaatcatttaagggaaacctcagttccactatatcctggttaacagtttcatagatgaatagaaagggggaattatgtgccttgaattttctaggaagaaaaaggcaatgactccaaaatagggctacgagagacactaatgaaaaaaaaaaaagtacttgaactccaattcgctctaatcagctggctggctgccagtcgcagcaactgaactgctttaagaaacttcagaaaacataaatcttttacaaataggaaactcaaagtattgcttaaaagtgaatagttcccctttggctgtacctacatcattctatgaagtagtttgcaaaatataagttttggtcaagtttcaagtggaatataattatcatgactcactttgtagtgtagtgaatacagtattttttatccttcctattttaggaacttggttaatctacttaggtgtcatgccatggaagggaaaggattttctggcatctaatttaaaaaattctttaatataagtgtttggcaagatttttagtttttgttttacattttgttttgttttgatttggtctactcagactaaaccagcaaactctgtctaggcatgcccaagttttcactctaaagacatcaattctttccaaaactgtcacggccaagtccctgctctcaatgactgattcaccaagaaacaaacttcaaagcaggtagagagaggtctttttgtattctggaggggcacattcttggaagatgtgcataatctgttggtatggagaagatgtaaaagggcatatttaaactaaaaagagtataaatgaaaagtgatgaaggtccaaaattttattgatgtaatttctattttcacattagagaaattaaaatttatgtgcataagtagactgagccatgtcaagtttcggtaatttatcacaaagtgaactagatacagtttgaattgttcccctgaaaagttttattttccttttttcaggatcagttagctgttagtaatctccacctctccctccacaaggactttctattctaggctgcagtaaggctgcccaccactgctactgccattcaatctattttccagagaaagtaaataacagaacaagcaggggaaaacacaaaattccaggaaatgctgccaaattgccctaccaagtaacaaagttaatgaaagtggtcaaggtggggagaagtgcagatttcaaaccataatgacctcgttcaaaacaagatcacattattttgaaatttgggctcatttccggaaactcatggtactgcaattaatgaattgttcctctttttcttgtggttattagagtgccagtttcagatagatcagggtttcttaatcaggggcacttttgccatgcagccatcattaggcaatgtctggagatactgacacctagagaataaagcttagtgatgtcactaaacattcacaacagcccccataataaacgctcattaggcccaaaatgctaaaagctttgagaaagcctggaataaaccatcccaaaactagtagccatttggtcttgtgccttaaagcaaaggttcccactatttgtgtctctgcttcacagaggcaatgagatggaatacagagcccaaagttactagaggaaatcttgggagtcttcagtccatagggggctgaaatcaccaggaggatcactgaggaggagaccatgggagggtctctggggaacaacagcatttacagatgacgagtagaagaggagcctgtcatagactcacagaatcataaaagccaagcacgaagtttcagaagtggcatgttcggtgagacacattttagaatgtgtgtttgcattgacagtggaggtcaccgcaacagcaatttcaaaacagaagtaaaggtggaagccagatcacagaacattaaagaataaagatcatcttttcaataattttagagacaatagaaagtataatattttgttattagaaacagaaaaatccatatttcaaagaaatatttttattagtttatctggtgtagaggagacttgaaaatgtttatagctaaagagaaggagcaggctgggcatggtggtgcatgcctgtaatcccaacactttgttaggttgaggtggaaagatcacttgagcccaggaatttgagaccagcctgggcaacacagtgagaccctgtctctacaaaaaaacaaacaaacaaacaaaaaacacacaattagctgggttgggtggcacacacctctagtcctagctacctggaaggctgaagcaggaggaccatttgagcccgggagtttaaggctgcatgttgcagtgagccatgctcatgccactgcactccagcctaagctagagcaagaccctatctctaaaaaatagatagatagatgggccgggcgcggtggctcacacctgtaatcacagcactttgggaggccgagacgggtggatcacaagatcaggagatcgagaccatcctggctaacacggtaaaaccccgtctctactaaaaatacaaaaaattagccgggcgtgttggcgggcgcctgtagtcccagctactcgggaggctgaggcaggagaatgccgtgaaaccgggaggcggagcttgcagtgggccgatatcgcaccactgcactccagcctgagggacagggcaagactccgtctcaaaaaaaaaaaaaaaaaaaagatagatagatagatacatacatacatacttacaaggagagaacttgaatacataagaggtgataactaagggaacaaggttacagagaagccaacaagaggtggtgttcagggcacagataggctggtcttgtaaggcagaacaatacctcctctaggactagataagtgtgagtatagatgaaaaccattttgttgatagggaaaaggaaaatgtattcattcaatatttactgagtatctaagatacactgtattgaaaaaaattatctgaaaccatgtttttcctctgccctcacaccacaacaatcatcaacatagaagacatctgtgacgaaatgtggggtgtagttttccctacacaccaagtggtagacgccagctagatgtccttcaattcaattccgaacctgtctacctggtgataatgtcagatcccagaggtagaaagctcagtcctcaaaactgtgccccgtcttccagacagccacaggtctaggcctctggaacttctgattggccggcttcaagtggagttcccatgaccccctcttgggttcaattaattttctgtaacagctcacagaactcagggaaacatgtatttagtggtttgttataaagcaagcttgtccaatccgtgtctcacatgtggctcaggacaattttgaatgtggcccaacacaaattcacaaactttcttaaaatattatgagatttttttgcaattatttttttagctcgtcagctatcgtttgtgttagtgtattttatgtgtggcccaatataattcttcttccaatgtgacccagggaatccaaaaaattggacacccctgttataaaggattttgcaaaagatacagatgaagagatgtgcagggcaaggtgtgagggaaggggtgtagaacttctgtgccctcccggggtgtgtcactctccagggacctccatgtcttcagctatccaaaagcttccaggatccagtcctcttgggtttttatggaagcttcatgacatcagtattccttcccccaggatatagggcaggaaccttcctgggaaggactttagaaccagaatcagaaaggtgggggaagattagagtcctgccttggggcaggtaaaaagaggataggagaaagattctgtttcctaaggcctaacacacccaacattataacaaaagactctaactaaggctatgggagttatgagccaggaaccatggacaaaaaccaccatgtatcataagaccacgtgcaccaagcactatgctatggaaataaaaatgaatacgacatggtccctgacctcaaggagctcagattctgtgagaatccgaaatagttttttaacctccaataaaaactatgagtcaaaagcttcaattggtagaatgaagagagttgattgaacagaagcctggagacaggtgaaggttattcatccagggcgtctgcagaaaaagcttttggttctgagggcccagctgaggctgaagggttatctatttattgtggtccccatattcacaaatatattttcttcagcattcttatggagtgagttgtgtttccccaaagtcatatgctgaaggcctaaccccaatgtgactgtacttggagattggggcattaagaatgtaactcgggtgttgtatgaggtcatacaggtggacccctaatcccataggtgtcctagaaatttttctctctctgcccatgcacacacacagaggaaagaacatttgaggacacagagagaaggctgccacctgtgagccagaaagaaggacctcaccagaaactaacgccatggtgccttgatcttggactccagtttacagaactatgagaaataaatgtctgttaagcacccagtatgtagtattttatcatggcagctccagctgactaataaaagcatcagttctcacgcctgtagtcccagcactttgggaggccgaggcaggcgggatcacgaggtcaggagttcaagaccagcctggccaacatggtgaaactgcgtctctactaaaaatacaaaaaaaattagctgggcatggtgatgtgcacctgtaatcccagctactcagaggctgaggcaggagaattgcttgaactgggacctgggaggcagaggttgcagtgagccaagatcacactactgcactccagcctgggctacagagtgagactccatcaaaaaaaaaaaaaaaaaaaaagcatcagttcttccacccggtcttaggaatagcaaagcacacagtagctatgatctagagatgaagtgtgcagagagaataggggatcaaggagatcctcaatactggtccagatacagaaccatggaattcatgctggatagagatggaacagacatccagagaaaatgctgcattggaagaaaatggggaagacaatgtaatgacagcaaaaggtaaaggaacagaaggaagtcgatgatagaaaactgtggtctgagattcagacactagcactattatttctgtataatggacagtttagggtgagggcaagacacaagatgtgggtttgagaataggtgactgcagtgtatgaaagtaactgttactgaagtcaaggaaacaaagttttaaaatgagttacttaagtaggtttttaaataactcaggccccagtatcctccattgaaaatatagaacaaccagtacattgataaacaacagtggtggaggtaaatggagatacacagctgggtgcatgagtgatttggtttggattagtttggtttataactttaaaataatcacctgaaagtagcaaaaggatcctcctttcctggttgaaaaagataacggaatgtggaagaatctgagtggtttccttagaaaatgctctaagaggggttgtgagttatgtcctctgagggggagggtgggaagagtaagaagtggggaagaaagggtctgtggcttaccctctgttatcccttatttcctaatctaaaaaattaagataaattttagagcaaagcagctctgcttcctacttttgggttctatgaaatgcccctttctgctttaaccagtttaagcctgtgttccttgtttaggaaaagaaaaaaaaagttaatttctgattgagaaactaaaaattatttgaaactcattgtcagagaaaacagcccagcaaaagaaagtaaaaagtcatgttggattctgctctgctgatgcctagtcttggcattctactgagagttcatttttgttagaaaccataacaagctcctaagccctccatgcgattattagtctaaggatctcactgcctagagggcataagttccaggagccatggactggtttggctgttccatgtgggcaactcacccaggataacttgataatatcagaaccatttgagacatttcacgatgcttctagtgatagttttaagttacatttcatgagaattcatcaaaaccatgacgtgaaaatagaaaacatttcttaatacaaaatgagcgcaaataaatgaagagtatatttatggccaatagtatgtaatgtattgctagattttccaaagaaatccccttaatgtttaaaaactacagtaaaattaattacatatacacacatatatatgcatatatgtatatatatacacgtgtgtactacatatgtgtgtttattcaaatatacatgtgtataattctataagccaaaagtattcattatataaatatagattagaaactagtaaaaaagtgaggaaaaatgaagtcctggaagtatggggtgagatttttcaatatatactttcatgttaaatattttacctgtgaatgtattgcttatcttccaaaaaggaaaatgaaagcatttaaatattatagtcactaaaggaaaaaagatgagatgagagatcagggcttgttttagcatttttgatttcctctggattcacgattcacatgactgcatagtttagcttttttttttttttttccttgaaaaggctacccaagcagggattgttggttttattgcttggctgagtgtttggtcagttgtttagtttttaattgtgttttcataataaagaaccatctcaggattcattattccatgcttttttattcctcattcccaagactacaccttcccttcctccctctttatctatataaatattattcctctaattcaggttccaggatcttccctttcagaattttgtatgtctctaactaaagttccaagatcttccctttcagaatttgtatgtcatttgtctcaatcccctaaaataaaggagccctatttggagacattatcgccccatgtgaaaacttactatatccctgcttatactacagcctacaagactctgaggactgcaccctgtatttccaatagtacttatttgtaccacatttgtattacatttattttgttcacgggatattcaaagagaagcattgcatttctagtattgactttgcttggtttcagttttattaactaatgttttaatcacttttaatgtgtattattttattctcatcttaatcatggtggtagaaaaagtagtctcagactcaaaaatagggatttgatctagcacaagttttcagagtcagtcagaatttacaggctgaatgatctttataaagttataacaaatccttcctgggagagtagccttggtaaaacactagcaatgcagggcttgtctgtccgaagacagtggaaaaaatcaacatcatgtctatctcaattgcagcacgccaactcactgcagtcccttccataggtgaactttatcaagtgtgaaaagcatcccgggaccatgggagacacatcagtagcagggaaaatatatatctttgctgcagctcaaggagatgcagcccattcaaatgaagataaagagggacaaacaaaagaattacaatcgaaaatttgttgctggactatcagtagaggagacataattctgccctttatcattacttgtcatgccagtgacagactataaaactcgtactgctcaacaattctgtactcgtcactttctgagccaacttttgccttggaagatgcttggcatgttttagacatatgatttattgcctcatttagtcaagcttgcacaggcaacaatgatctatatttttgtaaattacaaattagccaactttcacttattcttagtgacagaagtgatatatatacatacatatgtgcatgtgtgtgtatgtattctccgaagaacaccatttatttattgcttggtaaaaaaatttaaataatgacttctattccttctgcctgtccaagaaaagaaaatttatgcaatactgtagaacagaaatgcagtcatcctgcatcattgtttttcaatgtttattgtcttggaaaaaaacagcctaagcagattccagtactaataaacagccctgctgtagaggttattggctatttaaaggccatattacttcattttgctttccattttgcaaatacattttacactcttttgggaattccttctaaaatttgggggagctctctggcttgacagtgaaagggaaccattactcagcaaataagcaaaatgtcctggaaataatattacccatttaaaaatgactccttggacattgattaagttgaaatgaagtgcatgtaggcaatgctagtttgttgtcttacctagggagagaaatcattttctagagttcagtagtaaataggcaattcattttgacataacgaggaagagtgctgttaacagccagaggtcacaaaaagcagagatgaaaaagacctattagatcattttctccattccctggagaagagggccaaattatatttcatagtgctttttccagtttagctttcaattactcaagcaagggctttcaccacttcagactttttccaggatctttatcttgtttatgaccccagccttcctagatacattgacaaagtacgaatcttcgtcagaatcaaccctgcaggtgatcacaaaagtactctgtgctcacaattagacctgtatgtctcattttcttttctccttcaatgaatttcaaaatcatttccttggtaataactccttttgtccttccctactctacctctgtgttctgcattcttaatcacgtccctttcactctgagtctaaacgagagctgtttcttggaagaataatctgaaacaaattcctgccatttccaaaggcaaatgatcattcagaggaatgctatttggacagattaccaagaacatctcgaatgaatgaaaaagagaaatgagttcaagagagaatgagagaagctgaagtggagactgcaggtttagaaaactccttcacaaaatccctcgcaaaatggagtaggtaaatgagacagaagctggagaaaggcggagatcaaagaaggtttgctttctaggagagagagattgcaacacttttatctgaagatggaatgtctcagtagaaataccgaaaatgaggatgcagggaagagatgggacacctataggagccatgttcttgagcagacaagaaaggatgagatcctgtacacaaatagagagggtggccttgtgtgggtgcagggataactcgttcattttaacaagaaaaaagggagagcatatgaagagaggtgcttatgggcttatggtttggcaatttggtggtgtgactggtgacctcagctctctttcaaaaaagaaccgaattgattttatggcctttaatatctgcttggctactgcaagttttctgacttccatagcaaatgaagacaaagttttcagtctcttcttttttgaaataatttatttttaatttttgtggttacatagtaggtatatatatttacagggtacacaagatgttttttgatacaggcatgcaatgtgtaataatcacatggaaatggagtatccatcccctcaagcatttatcctttgtgttacaaaccatccaattacattctcttagttatttttaaatgtgcaattaaattattattgactatagattaatctgcataggctcatacactatgatgcactacttttacctccaggagtatctcctaaagaaaattacagattcagaaaacattattcacaaaaatataaattgtatataatttataatatcaatgctgtgtgcaggtaaacaatctaaatcttaaacaataagaaaaagttatgacgtatttaaaataatacatatattttatataaaatatataataccatggaaattttcaatgttagatttaaaagaacaagtacactttgaatataaacctacacaaaacaggaaaatatgaacagtgattgaacagtgattgactttgagtgataaaactcagtgatttttttttccccttctttccagtttcctatattttccaggtcttctataataattatataatattttataagcacataattccctgtattaagtctctttctacttagaaaattcctgatgaatacatttgggttccagtttgttggtttggttttgttttgtttattttctcctgacacatagtcactggcgtttattgagtacttacaatattccaggcactgttttgctgtgtggtcttaggcaaatttcttaaactttctgaccttcattttcctcatttgtaagtaagaataattttcatcatctataaaatgaggattaaataagttaatacatgaatacacccaagaatcatgtctgacaatatcataagcactcagcacatatagacacatttattattatgtccatatattactttgtcatattttgctgcttatgctgttggttctttgcatccaagaatctaagacgcatttttggtccccttaatactttcttttatagattttaaaccaagacaattcttacatggttcttttccttttcatgatttaatagcattgtcaagaaatggggcaatgccttgagaggacacatctttagcaggtcaattttatcaacaagggcagacagcccatttcctgcatatttccttctatattgcagtacaagaatattattaagaacggggagtttccgtagccttgggaataggaccaattcccagatatttaatttagttctggtctcatctaaattgaaattttgtcatagcatttttctcatagtaactgtttagaggaattcctttccaatttgtttttatttattatgaagtcaggccaaaccacacaggtcttcacggctgttcttgttagcagttattggtgacattattaaatcactaacacacattattttgagattggggaccctatcactcaacccatgtagtgtcctctcccattatttggataaattcttctgaaaaaaactgaagaaaaataatacggccattagcatgcatgagtcagatacttttaaactggaaagcaatgcagcaatgaaagtactttcaggaagggaagagaagagattttattgctcccatatgatatctgtgctgctgtatggcacctaagagtttttgtttttcttttttttttatttggagacagagtcttgctctgtcccgcaggttggcgctatggatatcggctcactgcaacctccgcctccctggttcaagcaattatcctgcctcagcctcccgagtagctgggactaggcgaacgccgctacgcccggctaattttttgtattttagtagagacagggtttcactgtgttgctcaggcttgtctgtagttcctgagctcaggccatccgcccgcctcagcctcccaaagtgctagggttacaggagtgagccaccacgcccggcctattttttggtttctttttctgagacagggtctcgccctgttgcccaggctgaatcacgcgacctcagctcactgcaacctcagcctcccgggttcagattctcatgtctcagcctcctgtgtagctgggactacaggcacacaccaccacgccctgctaatttttgtatttttagtagagacagggtttcgccaagttggccaggtagatctcgaactcctgacctcaggtgatccgccagcctcgacctcccaaagtgctgagattacagacatgagccaccacacctggccgtttttgtttgttttttgtctctcctgaattatatacttttctttactagctaaagattaatttttccttttctcagaaatcctggctttgattttttaaattactttggaatttttaaaaatagctccaaagctccaaatgaatctgtaagtcccttaagttcagtggtgggttctatgcagcttggtgatttatacatgcagcattgggttttactgggggcctgtgacttccccttactaataatttccttgatgtggctcatattcacttacaatcatttaggtccacagttctcattcctcattctggttttgtcttagaaaaacaagtaacagaaaatgattatttttatgggaaaaaaattactcttagtcccagtttttagagatgatcgtggatatggtttggctctgggtccccacccaaatctcatgtcaaattataatccccaatgttggaggtagggcctggtaagaggtgactgaatcttagaggtggatttttcatgaatggtttagcacgatgccttggtgctgttctcatgatggtgagatctcatgggttgtttcaaagtgtgtagcaccttccacctcactctctctctcttgcttctactctggccacgtgatgtgtgtgcacctgcttcaccttctgctgtgattaagtttcctgaggcttccctagccatgcttcttatatagcctatggaactatgagccaattaaacctcttttctttataaatttcccagtctccagtacttctttatagcaaggcaagaacagactaatagtaagtcattaagtcaaatcatctcccaaaaggttacttatccaagctatgaatgtgcacgtacatgtaaaaataaccagcggttaacagtaaaacagtttaaaaactatataacctgatgtttggcaaaaaacaataagaaggtggtgaagtagttggagatttgtgaaatttatgaatgggatttttcctctaaaggctttagagagaaaaatcataaatatactggttctttttatcatttttctttgttaaactaattttaaagtagtttcttcatatctcaagacaatcttgtaaaatgttcatttctgacagtcttaaagattaaagggactactgaaagataagaagtgagttttcttagaagaatgggaagaagataagatatttaatagatacattggtaaatatgggggattagctaagataattaagttgaatgttattcagctccctgatatctgatatgattgataatgaaaggaaggctaagagcgggcagagatctcaatagtcactagatgcaaagagcagaccacacagctaagatgagaagagatgaggcatgcagggaagaactggcacagacatatgcaagtctgatgttaagtactctatagtcacatagatttagactggaagctgagaagttttcaaacaagctattcttgactaatctatgctgcagtggggggaaaaattacaagttcaggaggtttttcttgttaataactttggtcccgacactttgatgtctatgcatgctatttgcttattttgatagctactatgttctatattgaaagcatttgtcattgtcaatactcagacttttctttctgtgtagaatattgggtatttagtggattgggaagagttatttgggggaatttttaatagcagatagttctcaaaatttttgctggagatttcctccacattcaaccaaaatttatctatatatacattttacaaaaagagtcaaaaggacgttaaaactgagtagacacccttgtgtactgttgctgggaatgtaaaatggtgcagtcactatgaaaaatagtatagtggttcctcaaaaaattaacaatagaactaccatttgatccagatattccacttctgcgtatatgccaaaacaacaactgaaagcaatctcttgaagagatatttgtacacccgtgtttgtagcagcattatccacaatagccaaaggtgaaagcaaccaaaatgcccaccaactgatgaatggataaacaacacgtggtatataaatacaatggaatattcattcagccttaaaagaaagataattctgacacatactacaacatggatgaaccttgaggacattgcactgagacaagtaggccagtcacataaagaaaacctgtatgataccacagatatgagttatctggagtagtcaaacttataaaagcagaaggtataatggtggttgcctgaagctgggggggagagagaaatggggagttgttgtaagggttttagttttgcaaaatgaaaaagttatggagggtaattgcacaacaatgtgaatatgcttaacactactgaacacttaaaaatgattaagaaggcgaattttatattacatgtattttactgcaatttttttgacaacaacaaagaaaaactgaatgggtgaaatgaagaagtgatctaaaataagttagagatttgttctcctatatcaacattgacaattcaaatgttatctgtgtagagtttttttctttaaaagactacattatgtggtatattctcctagaattaaactactttgtaacatttactgagtaaagccttaatagtatctttggcaaaattcttaaatatttttagggtcaaatagtagaatactgaaccaccaactttgtgtaatgctgatggtaagatatttacatttgggcatttgaactgaattatcaagtactttgcacaaataaagtttgtaatctatatagcctattttttttgcaatacatagaaagtttaaatttaataaaagtactgaatgattaaaaatcagagacatttccattgttatgaaaattgattgattatggtaagttcaaaacagcaacagtatttcatagacagacctctgagttttaaccattttctgtttacatctttcttctcctttgaggtaaaagttatgtcatcggaaaaaaaaagatatagataaaataatttagaattatagttaattttatattccccgatttggagaaaatacaaaattcttattctagattcatctaaacagaacaattataaactataaattctactcagattacttcattttcatttaatctcggaagatctttaattacaactatttttgaaaaatataaaatacttaggaaaaaatatataattgaaacatcagacaaaaccagttcttaaatagttcttaagaaaatactgtggaaagggaaaaataaaattcaaatatttcctttctaactgagtatgcattaccttttcaaaattgaaataatgaagtaatgaacgtgcaaatcaaatttgtaattaattagctgaagtaaaagcttcattgcagatatgctacattttttgcataggtgttgtttagcctattaccaaaatgccaaaatattttgtgtaaaataatctattatttgcctcttcccaaatgcattctaagagtagatgctctataaatacataagatgacaaaacaaataaatcttttaactatagctctctctctccccctacctcttacacattgtcttttttctgaaaaaggtcttaacttctttatgcatggtggcaccaataatctttttttcatttcagggaccttatctataaggtattgcccacataactttgatatatgagccttttatagaaagaagaacacacccatgcacaatcctaaacctgggaaaaagctttccacaaggcacacagggcactaggtctggggctgtttactactccataaggggccatgccatggtgaatacataggtgctgtgttctagatgaagacttggtgttttgtttcttttttgtttctaatattttctccagaactattatacattcaaagctatcctgaaaatatatacagttgccccttgaacaacaggggtttgaactgtgcaggtccccttatgcatggattttcttctgtctctgccacccctgagacagcaagaccaactcctcttcttcttccttctcctcagcctacccaacatgatgataaggatgatgaccttcatgatgatccacttccatttaataaacagcaaatatattttcccactgaattggttgccatgtttcttaagtgtctcttaatattcaggattccctttccacttctttttatccttataatttatttattgaaaaaaatcaagcccttggtcctgaggaatttcccatcgtttggattttgccaattgtattcctgctgtgtcctttaatatattctccaatccctttatatcccataaatctgtagttatgtggcaggccaagtattaccagcagctgaacaggcaggcctccataacaacagtttcagcactagctgagtggttaggttaaatattaaagctgaaagagccagtgcttttatacaaaggctggaatgtaacaaaagcccaccaagagttttgcctaggcctttcttgggccttgaagcacgacaagataataaaagaattcttaacaggacctgtttaggattaaacaagtttttattgggggtctgaagaaactccccagacctccacaaacaagttgtattgagagtctaaaggaactcttcaaacttccatgatttaacaggagacaagataagggggccgggcgcagtggctcacacctgtaatcccagcactttgggaggccaaggtgagtgtatcacttgaggtcaggagtttgagaccagcctgcccaacatgttgaaaccccatctctactaaaaataaaataaaataaaattagccaggcatggtggtgcatggttgtagtcccagctacttgggaggctaaggcaggagaatcgcttgaacctgggaggtggaggctgcagtgagctgagatcacaccactacacaacagagtgagactccgtctcaaaaaaacaaacaaacaaacaaacaacaacaacaacaacaaaaacgagtaatcacccctggcacctggaactatctagattaagtaaatttactgaagttccagaggaaggtcttcaaaattcagaccttagttatagattagaagaagttaatgacttacgtttttagacgaatgcacactgacatgtagacatatagctcagatggtatataagctctgaaaaactttgtaattttgagttggtctggcaatattttctaggcctggttacagattgtacccaattacaggaataaactctcttctttcccagttcatctgcatctcgttattgggcagaaagaataaacagcctgatccttggactgttctgagaacagttatacctaaagctggggtccccaacccctaggcagcggaccagtacccatgtgtggcctgttaggaacctggccacagcaggaggcgagcagcaggtgagtaaggattaccacctgagctctgcctcctgtcagatcagcagtgccattagattctgataggagccaaactctattgtgaactacacatgtgagggatctagattttgcgctccttatgagaatctaatgcctggtgatctgaggtaaaatagtctcatcccgaaaccatccctccccagcccccatggaaaaattgtcttccatgtaactggcccctggtgccaaaaagtttggggaccacttatctaaagaaatgattaaattcagattcaatgcatttgacaagaatacttcataggtggtgatgtgtcttcctatcaggaaacacataataagtgatcatcactctttgtgtgatgttataagcctgtaatggtttgatccattaattcattaggagttgcaaaagggtgacattctaattctttttttctttttatattagcaaaaaatatattttatctatttatttttttcccagctatttcccaaataacttatgatgctttgcatattcaaggaatacaaataagacatccagagatagaaccagctgaaatcatactagaagcaattaaacatggtttcaataattctgttcctttcttagatggacttttttgtgctccagagataattgtgaaatgcctatagtcaaatgctatcaaaagggactgatttagtgtgttctactaggacacgaagagattgacaattttctggaatttaactagagacttaaaatatttatgtttctccagtgtaaagaatatagaaaatgtctttataggcctgctaagtagaaagttatccttaacatttccacttgcagtcaaaatatatacatgacatatgccaagtagattaaaaaaatttaagaatatcttatattctttagttgtaaagtattgcccctatcactctggtaaaaacctcaaaatacccagaataagagttgcacttaatagtacattcttgttgtgtaaggattaaccagcaaattttagatatgtttgtttctgtgtatttataatccattacatttcagaactcatagctaagtatcacccgtaataactagcgtatattctacatgatcttatggcaatcagccaacaccaatgtataaacatcaaagaaatttcctcaccataggtatgtacttaaacatagaaatccatatctccagatcaatagtgtatcctggcccctcttgctctctccttgagatgtaaattaggaaattcaaatgaaacagaaagaactaagcaactagtggctgggcctccataccagctgctgagcctggggcagcggttggcatgacctttagtgagtcttccacttagcaatgtcctggccaggctctctaatactgatggtcactagcttgtcagccctctcgggaacaatccctcaaagctttctaaactgtgactgcatttttctgacataataagcataacttattgaacagatttaaatctttgatgaactaacagtgcttcagtcattattctgacattagtggcagtctcatagacagtgaactgtacaagatcagatggatcccatagtgaccagagaaaatgcccttgagtttgttttttgactagccctgtggtacatattcactttattttgatttgtctctttcaaaagtgagacatagccaaggaaaacaccaaaataccaaccaatgggatgcttttaaaaggaaaaactaaggatttgaggggactgaatctactcagtaagtaaaatatcacgagggaaattatagaattagaaaactagaaggaataattgagatgagccagtcatacacccttcatcttatagctgaggaaaatgaggtcatatggtgtgaaatgacttacccaaagtcacgcagccagtcagcaacaggactaggactcatgtctttgactcttctgactatgcaaattgctgaaggttagtatttttggtgtttagttgcttccctaaacactaaattcactaatgaatggttattctccatataaatttatggcacatgagtaaaatctctgaaaaaaaggaggaaaatacattctacaaaactgctaaatttggtattcacagtaacatgatgtcaaaatttcattggaatacaactttttatctcattattccctcacagtgatacaataagccctggcaaaaactgctatttttgaagttgtattcatttttccatatcatcaggatatacgggtgctcagtggattttaacagtaatttattcactggttgtctggaccatggaccaaaaaaattatacagagttttgcaaatgtctcaaagtcactaggcagatctgcctggcttataaataaaaccccgtaaatttccttggtgttatttaaaattaaagaagttcaaaagtgatcttcaaaaatgcaatacttgaattaaaataatagaaaattatatttaaaatcatgttaataatattttagaaatgaatctaaaccctctccagagaacccttgactaaaatatggtcttttgtctgacatttgcttcaaaataagagaaatggggggagtaaattggcaaatagatggggcgcaactgaccatgggttaatggctgttggggctggatgaaggatattttttaaaatcggagtaatagtatctaattttatgtatgttcaaaattctccataataaaagttttaaaataagaaaaagagaaaaatgaatctgaactctgttcatactaaagaaaggcaaaatatttttaatttaaagccatttctaccatcttcagtaaatcccttgtatgagagttgaatttgctaattagactgatgatacctgccttcatcatgagttataggtaattggatgttacaatgaactactaagagagaaaggacccctcaaagtgcagtcaactagatcattatctgaggcagagcaagctaattatcaccataaatttcaaactagaagaactgatctaaacatctaatggacactattgaagggtcaaaccccttatgcttagtgaattcacactaaacaatctttttagtaaattaaaatgggctttgatatacgaaaaatatgcagtatcagaaaatgtgtacagaaaaataaaaaacatgtagagacagccctcactgagttctagagaatttcttataaaccaaagaatacaaaagtctaaatccaaagttgggacaaccattctcaggtgacttaaccctttgactctcactttggaagacctgggaagttagaatattctagaacaactccctgtaatggagctataggaaattactcatttctcctcctctctcccaagagaggcccctttagtccttgggtgtcagggaggaaaaatgtaaatgcatcttgaaatgctgaggtgatactcatagtgtgacatttgacatatgaatagtgaagggaaaaacatattttagtgggcctaacaaatattgatgatctgtgtttagtccccagtgactgttgagacactatttccatgagacaatatcttttgtggtccaaaaaaccgatttacaattaaacatatagaatgccacttgtttataaattgatgatatggaaagatttcaatgcctaaataaattacagtaatgagattatacaattttcttaaatatttattattgtgggtaatcctgacagcatgtggccctttcaagacgctgacacataacggcgtccttgtattggtcactcatcgcttagtcattgcctttgattgtgcagtggtgtcatttttgtcttctttagtcccctggcaagagagtaaagctacagtcttacacacaggcagtgtgttgtatagccaatagaatctttcttggcagcttgcacacagtggagaagggaggccatcatgttggggagcactgagcagaggggcaggagcaaagaggcacacagtagaacttgcctcctggttgagatagcacaatactgcttatatactcatatttgttagtctgtggcttgccacaacttcttcctttaatttgcaagagatacaagatgatgaattatcaaaatctcaccaggcaaaagaaaattctaaattttttgtcatttgggctcagcattcaaaggcatttcttcagataaaaatgctgtttttattcatacatacaagtgacttactagtcttcgattattggcttaatacataaaagtttgttgaatgaacactgaccagtctcactcaagcctaattcaaagcttgactgtccaccacattctagaagggaaaaacaatcccctaaatcctttatgttttataggtgaggcttttcaggcttcaggagtctgcatgacctactcatatgtatcaccattgtggagctccctcccaggcctactctgattccaaccctggaaaaagagtttgcttttcatagtctgatcttcatatccttgttacttacatgaagaacaaaatagaggggaacatattttgagctaaaacactctcgtggaaaatcccatctgtatttgtttgtttgtttttgtttttgttttttcggagacacagtctcactctattgcccaggctggagtgcagcggtgcgatctcagctcactgcaacctccacctcccgggttcaatcaattctcctgcctcagtctcccaagtatctgggattacaggcacctgccaccacgcctagctaatttttgtatttttagtaaagactgggtttcaccatgtcggtcaggctggtcttgaactcccgaaatcaggtgatccacccacctctgcctcccaaagtgctgagattacaggcatgagccaccatgcccggccccatctgtattcttgtacagtgaaaattagaaagccaaatattgttttcattgacccatttgtgaaacataggacagtcaataaaaagggaaattaagattttataaaactacactagttaataagaagtgagaatgaacctctgtgcacggagaaactccaatacggagtaattctgacatctgttacattggatagcaggaaggaatcacaaatcctacatgaacccctactgctacagatcatgcaaagagacttaataatattgcctttgattgaagacatgaagagaacgtttgaaaagtgaaaaatacagagcatacagcatactaagattccacttcaatgaatactagactatacctgtcagagattccaataaaaccctcataatgtcttagatagggcagaatgaaagcagaggatataaaatatataagtacataaccccggaaaggcagcaaatgctcttatttgacataataagaactgagagcttgatgcattttgtcacagacagtaggaaatattttattctgtgaataaattatccgatttgattttgtttccactatttgtttttaattaggcaggaaacatttccaaatttaaatagctaagaaatatttccgaatctttaataggtaagttccaaacgactgtatagtatttcatctgcagccagtcacctttccacttcaaatcagaagccaggtgttaaactttcttgctagtttgctattaacttctgggggaaaaaatctgtttggttcttgttgatatgacagatatttatctttcctgttgttttacatatattattttcaatacacaaaatactaggcaaagccttgctgtagagagctcttttgttggaaagagcccatttccaggattttcatctgactttacccagcaggaccagagggcagaagcccatctttggagtgttggctaggattacacgctgcagctgtcagccagcagtaactgcataacagacctctggcatgtcagtgacttttgtgttcaaaaaagggcaatatttgcagtttacaaagcattctggaaagtgtaaaatctaaaaatcttactagtatctcccatctagatgaggagacaagaatgttaccccaggattcatcagtcacatactctctatgcacaaacaaccgtgaataattcagctgcaactaatgttttgcgttttttctatgcattctctacttcctacctagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcagtgagtacaggttgctaagcaccatcctgggatgcctcaggggaactgagcggtttgcttctatttagtttgcaatcagcaaacactagaggtcccttctacaagttttccaggggaagccttgaattttatatttaccactgctgaaaacagtttactaggtaactgttttaggcagtattctaggtaatgccataaaattggcattttaaataatatcaacttcaatctaacttacagtttagaaaaggtttcatttatcttagatatcctcctttagtgtagtcacattcactgggtgaacactaaaagaaaaacgtgtcccaaaactcttttataatcctgtagctacagcaagattaaaatacacacacacacacacacacacacacacacacacacacattgaacaagtattacaggattgttaagaaaagaggaaggaaaattattcatccccagaatacagttaaagtagaagcaccttgacattttctaggatttaaaatgccgtttcttttctgttattctctccacttctggcaccatcctatagccctaaatatacagttctttgtatttacatagattccttctaacacagtgcagctgtccaggtgctatgtcttaaatgctcacaatatggctaagctgagggaaagaagattatgtcataacacacttgaactgttagaaacacgaaagaactgaaagtaatttaagctagaaaacatacatgtggttcagttcaagcttcattacttttgttttaaaatgaagtaaaatataaagtccagttgtagataagaaataaattgtcagctcgaaaacaaaaaaaaccctccttttaaaaagttcttggtgcacacagtgtgttctcctttcccactttgctaaatcaacttttattgtaaaaatatccctggccttggaactaaagtcactagcaactgccttcacaatagctgtctcagaaagaacaatttgctattgactactgtgtaggttttcagcaagaaccagcaaagctcccttagtaaaagatgtgaggcgggggggcggggaaatcaattgaaactgtgtaggatttaaaacaggaaataaccagcacccaacaccctccaccacattgcccagccacatacgcctgcacaggtaactgcccagttatcctaatcaactgaatgttttggtgcccctgcagtcagagactcctctgagcctttaattaaaagtaccttgtccaaggacacagcaatttagagcttcatcagcaacagtgagattccctcaaacagaatttgacctatatggtgttgaatactcaaggaagtcagcaaaaggcctaatttatttatgaaccaaagcaaatccctaaatgccaattattgagtctctgattgttcactatgaatctaactaaaaagaagaagatagaaaaaaaaagagtaagagaaacccacaacccacattttctcattaaagtatttcatttcctgtagtcctgatggataagaaatgattcaagctcaggatcactatctttcttattttcctctatcagtgtcttgacacatcatccaaagtgaaaaaacaggcagagccacacagtttcttggctcatttttcaccttgggattatacctgaatttcagtttcccattaagtctgtttgtttgatccctggaaattgaaatgtaggcacaagccttggatgaaaaattagtcatgctgctttcaacctaagctaggacagctggataagagtgaaaaggaaatttgaaggaaaagttgacagttactttaacagacacattctctttgggtcaccttgggactccttgatggtcaaggaacttgtaaatcaacctgattctgaatttgattgaagaaagtcactgaaaccttaatactaaaatacctgcagggatgagagaaaaaatattctggacccagcaacaatggtctcctctgtcaaagacatctctggggaaataccattcagtaaaatattactgaatagaaataccattcagtaaaacccattataaggcttgccctggtaaaaaacaaatgcttagccatcccttggtgcagattaactagaaatggtgctggggggtctcttcatctgctaattaaactaaagtaagacaaagcccacttctagctctctgtggcttaccagggccatgctctaaaatcgcaaccctttccacactccagtatcctgcattccccttcccctgttttattttttccaatctcatttatcacctttgaaacactatataatttagttatttattatgcttattaattgtctttgcttcattcctgaagacagaaatttttgtgatgttattcatcatggtatccccagaacccagaacaagtgactagcacgtagtttctaatcaataaataattgttgaaatatgaaaagaatgactggatggataaatggatggatggatggatggatggatggatggatggatggatggatggatgaacagacagatggaaggatggatggatggatggaaaggcatatagaccgagaggggaaagttttcacaaaattctgtggtttccatcccctgcttcatcagtgtcatcgaaataaagccacttcttattataaccagtaaaaccttatactttttatcccatgcttaagagaaacttctgaagcaaacggacagtttccttactgcaagaactttatccccaacacaaattacatttactccacaatctctggggaaacaaaatatgttatggaaataaccaaacttcgtaactgtgctaaatgatatctgttgtttatttgtttattgtcacatctaaaggtcttccgaataacaagaagttctgcccattagacagcattggtctcttacaataaatattaactaaattcacattcttggaaagaaagatacctcacagatagctattctagctaaaccaaaggatgcaaatgccagtgccctttgccagctgttaatgtcatcacaataaccttagccacacaggaaaggaaggtgttggaactgaaaaaaaaaaaaaatcacctctctgctaccatgagaagcacaatggaacactcgaaaggtcaggtttaaaattggattgttaagcagaggttgcatcttggttgttgctcccaaaagctgcataacccttaacaagttatttaatttccctaatcttacctttctcgtacataaattggggatgacaataatagttaccctacagggttgctaagagtattaggaatagcatgagaataaatcactttatagttgttcaagaatttaagagtagcagaagtaatcgcagtagtataatatcacctaatactttttcgaatatgatgagggaagaaaatgtatagctttgatcaacagagtttagcttcaagaacagtggcaaaataggacttggaaaaatctctggcaaacctgagagcaaagaattctatgtatgatctgtcagcatttataggggagcagccaccatgattgttatgaaattagatgctacaaaaaccatgaagttaaatatttactttttggaacctccagaaagcaggccagtattttctcagcaggctccagcagtatgcttgaaagaacacaataactgtttatactctgcacatgttcgattcacgataaaatgacagactggggacaggtcagggcaaaaatgtgacagaggtagagctaaatggacttctgcaagtctctctgggacataactttcttaaaggaaaatacaacaactctaattggacctaatcgctgtcccatcacattaagtccagaattcagagattcctgaaaagggctctaaggaggacagggagccacggctgcaagcattatgcattagtggaggactgtaggcttctctttgctgaaaaatgatagatgacctaggcaggcatgtcatttcctattttgtgctttcatttttcagaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtgagtagcagccaagggaggggccgagggggtgagggcaggtaactcattgcagtgttaaacctgggctcaagaagacaattatctctaacaaaatggaataaaacaggcggcaacaatatgcaaaacatcacagaaaggtcagacctacaccctgtagaaaattacaagctgtatcgaattcatggaacaccccttcttaaactttgctaagcatgaaactgtacagatgaaagaaccaggaaaatgcataaacagaaaatacatagaaaaggaaggcatgttcccttcttagatgctttcttattttcagttgtttctgttcttttgacttttccctaaaggattactgaaaacaactattttgtttttcttttattagaaattgatataaaatatgaaccagtgtttaagcctactttctataccctgttgaaattgtgtacctataacggaagcgtgctcctaagcaggtgttcccacaactgaaacatggggaattcaatcaaagtgatatacccagagtcaattatctttgataatcctgcccctaatttaagtacatcctgtacagagaagaatgtacagcaatgatctaatgattaatttctaccaaacgacatcctgttttttcagtgtggacataagaagtatgcatttaaagaaaaagaaaaaatatgtatagtttagtttgacagactatcaagacctttcatagtgaatggtaaactttttccaacagttagcccagagattatccaaggtatactatatatctattccttatactgcaccctttgatatcattaaaattgttattttaaaactattatatatgtttttcttagtacaagaaaaatgtctgtgatcaaggctttgcacactctgagtccatttaaaatgcattaaaaatatcgtcttttcatcaataatatgggccataaaagtttgcagtaaagaagctactgagtacgaaaaccacttccttgacactaacagtttaaattacaatcaacatttcataatgatcaggaaaatatttcctacacttctagtctttagaaaaatgaactcctggggaagcaaagggaatttcagaagacgttagcctgataccacgcgagagaagtcgtttcttttgtaaaatgaagcgctctcattaaatatccagagcttctggagttcagcctcttttgacgtgatacttactggagagtttttgaaaagaaataataaaggacctttgttacttcctcaaatgctttggccaaaatttcatgggtattcaaaactactagaaaatctttttagtaatctaagcaaagtgtttctaataagcatttgaagtgagcttagctgagagatgttcttcagacttctctgaaggcaaccatctgaaagtcttgacagaggggcttaaggtgggacgagtgacaaggttgtgaggtgatgcatatgttaattagcttgatttagccattcgacaatatgtacgtatttcaaaacatcatgttgtacatcataaatatatacaacttttatatgtcagtttaaaatatagatgagaaaagaaaataaatttaaaacgttttaaatgtaaaaatttttaaaacatgcgtgtggagaggagtacaaaagggccttaaccgtggtagaactgttattaggtgctggcccacagcagaagagccacagttcggccgctatgatgtgaaagtacacattttaagggctagaactcacccaggctggctttccaaataccgtgatagtgactggttataatgacctttactttatttgcactgtgatagcagagtaggggtcctgcttcctgaaacagtaggatcaaaatgccgtcagaggaatctgcagtggagacagttataaaagtattctcagtgcctgcactgacagtcaacatttttgtcaggctgactctgactatggctattacaatatcaagcaccttgcttaaccacagagctggcagaattggtaactttcagaactaggttacctcttgtttctgtcccctacgtaggtggttgttgaactgtcaaaatttgcattcatctattgcatattactatctttctgccttaagtcttattgattcctaggaatgtggacactttagcctcttgtaataaatgtaacttgcaggaggtgtccactttgatcttataaaccgtgtttgccttcctgataataaaagaatggttacccaagcagctctgagcagcgtatcggcaatttcattatcacggcagtcacctgaatgtgctcataaacagacaagctttaggctaaaacttgcttctctagctgtaaagctttaaggtacacagaacgaaggcagtctatctatacagctttcttatagtcttccacatttcaagaggctgccgccaaagtgtatggttttctgtgggaagacagggagaggaggctgaaaggctaggaagaagggaaacaaagaagaatgtgcaaacgtatctcaaaccccagtatttttcatacaataaggatgcaaaaattatctttctgtagcaagtttatcaaatgtcttaagtgacaagatttgaattatctaatttattctgccattacttgaattttcagtgactattatagcagtgattatagcagtgttttccaacctgaaaattctgtgaaattagtggggcattaacagtatttaattattaattaattggattgaattcaattgaaaattttagaatgttatactaatgggtaggtataagtgtcatttctcaaatattcaatttcagttataaggcatatatgaacctgatgtggtataaactgtatttcttcacatagactacacagtcaaagtggtcatcatgtaccaactttctaaactaggaatcaaggccttcaacaatctgactagaaaaggaaaactcatggataactttgagcattaagaaaatatttactgatatttacaaagggatcctgtttttcaacaaactgctactagaatataagagaaaaggcagcattcatgattcaaattattatatggtggtcataattcctgttggattggatacatttaagaaatattttggctgggcacggtggccgcgcctgtattcccagcattttgggaggctgaagtgggtggatcatttgaggtcaggagttcaagaccagcctgttcaatacagtgaaaccccgcctttactaaaaatacaacaattagccgggcatggtggtgggtgcctgtagtcccaagctacttaggaggctgaggcaggagaattgcttgaacccgggaggcagaggttgcagtgagcagagattgcaccactgtacttcagcctgagaaacagccagactccgtctccaaaaaaaaaaaaaaaaagaaaggaagaaatattttggggccaggaacagtcactcacacctgtaatcccagcactttgggagaccaaggcaggcagattgcttgagcccaggagtttgagacgagcctgggcaacatagcaaaaccctgtctctacgaaaaaaatatatacatatatagtggggcatggtggtgcacgcctgtagtcccagctacttgggaagctgaggtgggaggatcacctaagcctaagaagttgaggtttcagtgagccatgatcacaccactgcattcaacctgggtgagaccctattgcaaaaaaaaaaagttgaattaaaataaacaagaaatattttgggttattattaaggaagaaaccagaatgttccctctttctggtggcttttatcatgatgtaatgctttgaggaaattcttgttattcatggcttttagaaggttttctcatgactggtccatcttgaattcagggcacttagcaatgaaagacttttctgtgtgacaaaacataatatgctccttcagccatgatgacaaagagaaagatgttcatttgctttctaaaagtttagagtgggccctaagaaattatcttgtccaaattcccttcaatgtgagcaaccactaaacaatgtccaagacaggcatccaacctctgcagtaactcatctttaaagtaaatttcctacctcaaaagatagtcgtttctgttagacttattgacagaaatgttttcccttgtatgaagaaaattctgccttcctgatcccaaattgtcctacttgagatacgaggaatatctaattggtctttaatgacagagctattagaaatatttgagaatagttgccatgcctatactgcccaagagggaaaacaacaaaacatttttcttttccaggctacatattttcagttctatcaccatgttttccaggtctactagaatcttgtaaaagttcacactcgttgatgtaatggttcaatacatgtaaattcacttcactgctgccaacgtttctccaacttgtctccaagggcagcatgaaatagtccatccagtatatcaggtacccaggccctaatacatgactctgtcaactataaaaatcaagttaatttctagagaatttatgcaggttcctagctatcatgcttccttttgctaaatagaaataatcgattcagcagtttattcaattttgcaagttgattatatttttcagaatccacctctattctgtctttgtgattgtggagaaattatttttgcactgccagtcttcctcagatagagcttcacaattccttaaagacttctagaactaagagttttaatcaccatcaatggaattcttgcctagacttattagtgagaactgacattctctattttccatctatggtatacatcaatttccaaaatgcttaaaataaatacatatatacagcagcggggaaattcacaggctaaaatcatccttttttttggagacaaagtctcactctgtcacccaggttggagtgcagtgggacaatctcggctcactgcaacctctgcctcctgggttcaagtgattctcctgcctcagcctcctgagtagctgagattacaggagcacgccaccatgcctggctaatttttggatttttagtagagacagggttttgccatgttggtcaggctggtcttgaactcctgacctcatgatctgcccgccttagcctcccaaagtgttgggattacaggcatgagccaccgcacttggccacaatcatccattttattctctcagaaaccactatgttccacagacatatcagtttgaattcagtaattcctcatccagggccaatatctagccttcaaatgtccctaggcatggatagcaatagccgtgacccattgccaaggacctcaagttaggcacttcagacatgaaagatcctctgacatgggccaaaggtgagatccttatgagctggttctgcagtccagaagtgtgaggcatagcccatgctaaaatggggaaaattctacctctttgctacagagagttgtaacactgtcacatgaaagtggaatgctttctatagatttactgatagtaccttccattgttcttccaaggcacacagtgcagaacttgcagactctctttcttgtataagaatgtgagaaagtactgataacaacaccgtgtgaaagtcagtggttcttaggcaacaaatataactttctgctaaatttaggcttagaataaaatcagaaaaaagtacaaataatcataaattcatcaagctagaaaaaaccatagagacaattcaacttatttttacaaaaaaggaaacctaagctatacagtctaaatgacttacccagtgtcaccactagctaacttaacagctactactagaatctggggttgctgactcatcattccatgttagtctttctttcacacgtgatgaaggggaaattaacagttgttaaatgtctactgctatgggtcaggcactttgctaggaaatttacatatcttctaacccatttaatccttatttcaagcctatgaaatatgtaatttttacaaatgagatgattcaggctcatagaggttaagcagttttcctaagtttacacagcaaataggagtaagaaagcagagctaagaattcccacgattccatggagattttcacctcccattctacttagagaagacacattctctagtggttaaggaataatcatactcaaatagggaaaaaaccttcagagagtacaattacttcttccctaaaacacgacaatgcagctggtaagtgaatatcgcaaagccaaaacatcactgacctttaccagtccttacagcaagtcttatttcaaaacacgttcaggacactgggtcaaacaaaatcactccaggtctgcctcacacagatagacttgtgcctgcacaagggtgcccagtggagagtgtgagtaaggctaagatcaagcctctgttcataaagccgtggacccaggcttgggttgactaatgtggaggaagaggggctccttctccttggtgggcatagaagcttcactttattaacacaaaggagataacaacagattgaggatcaacttacttgatgcctagaataaactattagcttttatcagaaccttattgatggcactaattgaccttcaaaattttagcatcccacttgggttaaatttcattgagggttagggttaccttaacctattcaaaatttgaaagtaaagataatctattttacacaaaactctttccacataagttttgacccaatattagtaattctacatttaatcaaaatcagtaaagcatgaaattgatttcccacagaaaaatggactggtcaaactgagaatttaatatagaatataagcttagaaggataactttgggggttttctccactttcacctctaagtttaattagatactgttcattctcccttttattctctcccatccctattaggacaactccagagcctggaatatccatttggtagagtgggagaactttgttcattccctgcttctcaagtcaagtcaatattctcacaaattttgcatgatctccatgcaattgctacaaatcttcctccttttctcctcaaaaaatcaaattgatgcataaaaataccaaaagatgtgctccttgacctcagcctccaaccacataattctctatgattgaggtttcaaaactgaagtttcaaacatttgagggattagattagaatctatgttcatcagtttagtctaaagacaagttccaggagagttaactaggtcttcagctctccacaaccacaaccacagatcttgccggaacttctcattattccagaagcccctcaattaaactggccaaagaatctatttcatgaaacctatgtagtatgtaatacgaaaactaacatctgtttagcacttcaccgtatgtaaagccctcactatattatctaattaactctatgtaataatcccttcaaatgggttaaagtagatactgtggttttctaattttgcaaatagagtgagaaccaaagaaatgaagggactatcgtgatgaataagagacaaaatcaggactcaaatcaatgccttcattcattcattcagatttcaaatcttagctttaatcaatggtctcataggactcaagttaatgccttctttcattcattcagactttgaatcctagggttaatcaataattttcttttactctccttgtaagagaaacttaggcacccgctaagtgaagtagttttgtcaattaatgtttcatagtgagttcataataagagcaggaaaggaaacagattgccttgctccccatactgtgttcttatcattagaccaaactagagctgataggttgaaaatgtcagctttcagttactaatgaagggaaatgtcaacaatgccagcttctggtctgtttataacaagatctaattcaatatttaacaactgcaaaaggacaaaatgtttagggaaaagactgtcaaacttttaaatggtgtcctaatctacagaaggtgagaataaaggagcagaaaatggctcaagtgtttaaaaaactaatcaaaatattgaataagatcaatctcctttgaaagcccagaataaacactcactgaagattttttaaatgtaaagtaaaatagtataacatgggcagagatgttccaaagcaaagttgtaaattacccatctctccttttgaagccccctcccccattgcttggctctggaggcccctggctgccctgagcccccagtctccagggaaatcacatctgacaaagaaattctccgtaaggggtggcaacaatctcttttcctttgtcagggtcagaaatgactgcttctttcttccctctccctatgggtgtgatctttacctcaacaggatgttccctatgactttctccttcatttaacagtgaaaatgacattaataaaattaatccttaaattagcaatccctgttaattattctactgtacctccctgcttttcttcagtttgtcttggtctcttgagatctctgggttcctgggatagcttgggctttgagatctcatctttctggttcctgaccatgtatccagcttcttgaaccactttttttctcactgcgacttctgtaagggccattcaatcataggtagcctggtaggttatgtgcactattttaaaagatggtgagacctgttcatccatcctgaaagaggtgttcactcttgcataccagccactcaggaccatggtctctctggaactccagaatgcactgctcttctctacccaaaccttacggtgacttttgttctaactatcctctgtgtttctttggtaacatcgcctcttaaattttggacttctgatctcattcttggtcttgcttcactgctgccaggatagacagctcctccgtagtcaggctagggcttgaattcttcatgccaaccacccctagacctccagtaccacccaatagttaaagataaaacagcaccacctaagacatagcaatggctgcctatgtgttgaactgtgaagttcatgaatggattgatgactgtttttcgtaggggtttttttggtccatttacctgttatatcaactattatccactttgttctgcttccccaactggtgtcctgagtctgtctgtctgtctaatgtgtgagggtaatttgctgtgtcccttccctacccttaagatgtgacttgacttcatctcatttattccttagctgggcattttcatgggttctgtcctctaggatataatgccccactctcttctttctggctccccattcttctttaactgaaatcttgctccctttagctaagggagaaacttccatgcacctgtgaaaataactgtcacagcccccttcccagcacctgaagttcagcaatattgactctgccccaataacatgataccagagcatggcagaattaaacagaatgttctgccattcacctactcttcctcctccctccctgcagacagggatataggcccgaggcctatatattagcttcatttcacttcattttctcacccaaagcttcattgctaaaatatcaccttcagctctgctctcctctttgctttccttctcaattcaacaactcttcttttttcctaatcatttcaacatcagtattagaatgtaaactccataagggcagggagctctgctttcttccatttagtcagtgctgtgtcactagcatctagtctctgtgcataaaagacactcaacaatatttattgaatggatgaaataaatattaagattggaagaagtggtcagataaggttgtgtatatttgaaaaagggatgacagtttttcagaaaaggatgctagctgcagagaatgttgtggcaggactgagcacaattatctgtagggtgtgacccacagagcagcctaaatggagcataaattctgataggggagtggtagaaagtaaagaagaaaaggaagaaatgaagaagacagcagaaggcatttatccagtatgtagaaagaacaaagatgataaataaatcttttagaaaaaatagaaggcattcctgaagtcctttacaccatgaatgaaaattaaaatcatttttaaaaccacaacctaggagataacatctttaacaagggggccaggagatgatattgatcttcagttctgtccttttctaacaaataacaagatgctatgagcatcttgtgctgtctagattctagactccacctagagcccaagctgttgggggcaatgggcttcaagagagttcaccaaaaatccatgctcgagagcagggctgggaagggccagtgggcttgttggcgagtataatcttagaactcatatgtgtagactatgcccttagaatgggagggcataacaagcctgaacaatatgtatagctctaaagtctagcgaagaaaactaagccttacatgtggtgtgccgttgaagcctgcagtatttatatttaaagaaatgatgaaaactgtaatctgtgtccaggggtcagcgagcagtctctagtcctgaattactctctagtcctgaattactctgttactctgccacagagaaagaacagagttggccacaagggctttcagtcagaacctgacttccatggtatagtgtgtgtgtgtgtgagtgtgtgtgtgtgtgtgtttgtgtgtgtgtgttcatgtgtgtgtgtgcacatatatgttataataataaattgggatcaggttatttatatatatttatattatttatatgtgtatgtgagtatatatattatttatggtgtatgtcaatgtgtctgtgtatgtgtaaattttgcttgtaaattgcttcaaatgtaagttgcttttttaaacaaagtggatacatataaataataggagtgaaaaagaaacaaaatctggctttgagtctatgctgctgtcttctcagtggggctgattttgttcaggatcactcgtggaggtaggtgagattggcttcaggtgagaaggcttcagaaatgagagaattccctatctcaatcctctaacaaagtcagagcaaaactttttaaaaataaaacagtaccgcacatactcccctgatgtaaatagagttgagtgacactagaaaagtaacagactttcatgagcttatatgtgacagaagtcattagtctttactgtttgctgcttggattatttatttggatctaagctcagtatctgaagtgaggctacatccacagaggcactggttttgacaagatcatcactcccgccttcaacaaaataatcaagaaatgactatgatgctaaatcggtgggacaattcttttttcttttttttttttttggttatcttttctttctttctttctttctttctttctttctttctttctttctttctttcttcctttctttcctttttggtctaatacttcttggtatagatccacctggaaatacatttaagagaaagaaatgtctgtttttgtgtcctggagtgccaatgaaaatgagacaaaatggagtcttgcgggagggagggagattatatggcataattcagtggaaaggctgaggccaggctgccagtggaaaggctcgtgctggttggccactccaggttgcaaattctgattcaaaagtgaccttgagggcaccttcccactccagccttcttcactgatggagctcgatggtaacacaaagatgtttgccgtttctgtgtcttcctccagcatgttagcgtgtttttctatcagtgggaactaggttggaagccccagactctgcccagatcctgcttctgggattgaggtgagccagggcaggagagcaggagcttaggatctcccagcctgcactggattggtgggaaaactcatccaaggccttctagaagtggtacacaaagggagaaattgagcaaagtggtggataaggtaaaagtacacatgagagaaagaatgattacatcacaagccacaaaaaaaaagaaagcaggtttgaataccatgtaagaggagggaaactgtaggggaaagctgtgcgtagctgagagaactgggatttgcacatacagaagctagtgtgggatcaggccatatttccctcctccccacatttatcccccagccattccaccaatttaaagttaatgaagaatacagcctagctaaatgttttttcctttgcttaacactgctccaagaatttacattttaactttttgtagtaatagaaaccatctcatagatgataattgtagcatatggagcaggtttgaaacatacagttacaactcaagtgggcatgaatgtaacttttttttatctccataaatgagccttgcaaagccctggagtcctgcttccaccgtgagcagcaggctggctcccaacacatttgggcccaggacaagagtgcaaatgaaggctcaggtggcatatggctaagtatttggaagtttataaactgagctagcaaactactgggttctgctctgtcctcctttcttgatcaatataccttcaaaacaacccagagagtagggatgcatggagaattgctccttagcgtccgttcagctgttgcagcacctgcggacaggcaggactgtagcccacagcccacaccttcccttcctaattgttctgtgcctccacagcccatgggcacacacgatgcaggtggacaaggaagcccacacatctaattccttctacaaaaatagccatcctttgcccaacccccagccctaaggatataaattccaaaccacgggaaagcagcccatggaaaaagaatcaaataataatggaatgactcaggcatttgaagcaggctcagaatcctttgtgcagggaataatgcagtctggaaaacccagttcacaaaaggtgtgcagcctgtggggatggggggaacgggacatccctttagcctccagactacccatcccgtagggagaggaacatccaaagaagaccagagcacggccctctttcctgaatctcaggtcactggacagcagtgagcccctgatgatctcaccaattaaatgtgtatttcttctgatccagaacttggtctcttatgggtagattctcagtaaattcccaattcaaactcagtcaattcaaaagtctaactccatgccgggattgttttcctttccaaactgctctgctcacctttcctccattctcctccactctcaggatggcatcttgatcatgggccaagtcacagtggggggcaggtgtcatctgatgctttatctttctcagctagcctcagctagtttcagattggatgcagcagacctttcaaaagaggctttgtcctcacttgatagagtgcccacagatgtcatgtctccatctgctctcttgcatggtagggtcactctcccactgactcagctctacttaagttctaagatctggctaaggactagtccaagaggcccggttgcaggcttttactgagccctagctttggtttgttcagccgcaaatctcagagatgagtcccttcaccctgcttcatagtgcaggttctctagctttcaactctcatctggtcccttccctccaacaggcaagaattccaccctttgcgggttacagagaaccaagaggccctatctcagactctgtctgcctaaccacaccatgccactcattctattataatgagcttcctcatgttggcatagagcatgttacttagaggtatctgcaaaccatgaattctagggaggaagtggggacaatccctctatgttctggaatcctaaagctgatctggagtctttgtctccctaccacactccacccaccacaatccattagaactgggccaaaacctcccaactttgatttgttggaaccaacacctcatgttcccgctttcaacaaatcattgctcttgcaaatgaaagctctgtttcttcgatactatgttattttgaaagccaagctgagcagtgactttcctattcttggtggtgcactgccttcctctaaagcaaaagaagcctgagcttccatgggtggaaagccaaatgcaacaagaaaaataaagaagaaaaattttatcaataatactttctttcaaaaatactatctcactatacaagttttttttcactgcattctttaagtggtagagcaaggaataaaaaataagcagccttctgcttgcactttagacattgaaggaagaaaggaaaggcaattctgcttaggaggaaaatacagaggaccaggcatggtggctcacgcctgtaatcccagcactgtgggaggccaagccaggccgatcacctgaggtcaggagttcgagaccagcctggccaacatggtgaaaccccatctctactaaaaatacaaaaattcaccaggcatagtggcaggcacctgtaatcccagctacttgagaggctgaggtgggaaaattacttgaacctgggaagcagaggttgcagtcagccaagattgcatcattgcactctagcctgggtgacagagcaagactccatctcaaaaaaaaaaaaaaaaagaaacaaacaaaaaaaacattgaagtgctctaaccctgactaaaccctccttattttgtcaattgctttccctgcaccccacgtcccacagggagggaaacctgcctgtcatcctatgcctcccctcactcaggggccacagtcagccctgctgtcagggaaggaccatttccatcaaggtattccacaccacatacccagacacaggatcctatgagcctaccagtcttttcttcaaatgtatgatctgatcaccatcatgtgttaaattagcataaaaaaagagaaaaaaacagaataaaccaacagaacctagaagaaacaaagatacttattttaaataatcaaattatcctcatccacaatctagaacagtttctgtgtagaaagggaacaagtacaattctcatgtatttaaaatatgataactaaaagaaaagattcaatggatgaaccaaataatagaaggaaccaggctaaagtccacgctggcaatctggaggagaaagtcaaggaaatccctcatgctataaagcaaaaaagatggaaccaaaatctgggctattttcctagggcttccataacaaagtactacaaactgagaggcttgaagtaagtgaaacttgtctcacagtcctggagggcaagaagtcctaagtcaaggtgtcggcggagctatgcatgctccctctgaaacactggggaaggatctgttccaagcctctcttagcttctccaagctgcatgcattccttggcttgtggaagcatcgctctggtgtactcccgtgccttcacatcctctcccttctgtatgtgtatgagatgcaacctgagaaagaagagttacaacacaggacaaaggcatgcaagatattcgccatccacctacatgcactcttcggagcgcaaaacacagacaggagaggaagagaggcagggttcagatccacaaggatgtcagcagagagcgtgtctgcctgttcctggctggaacttcacacagtgactcctcatggtacctactatttgttggatgaaggaaagagtttggagtcagtattggtagggatactctgggctatatctttctttctacccatcctttggcacctcattgcttcaggttctggaatctgatatccatgtttgagcagcacaatgaaagaagaaggtaaaatatttactagaaagtaaatggggatgcagggcatgggatctgtagtaggaagattcctcttgcctctagaaggagaaaatacaccaaagaacttcaaatgcgtatttagacacaagtgaattggaataacctaaattgcaagtatttattcaccataattgaacattttgcaactcactgtcttttctgaaaacaaaatgcagtagacatagcctttaagtaatagatttctaacttcctgatgtacttccaacctttgcttcttggtatctaaaagtttaactaggcacatcctgcaaactacttcttggctcctgagacataaaattcatcttggtctgatgaatactttcttccagttttatttgagaaattccctagaagatatggataattttaaaagtctgagaaacgaaatcaaaggaaatctaattccacaaagaatgctgagtctaaaaaataaattataattctggaagattgaaataactctttgaaagacaatatccccataagtatacatatatctagaatgtgtattcaaataaattccaccgaaagcctatttttctcatctgaggtcacaccatagcccaaataattttatcttagctaacataatatagtgaatttaaagtaacaactaaaaattcattaagatgaatgcacatagtaaaatagataaagagaatttttcctaaagatgctcttttgttttatacttttgacatggcagagataaaggaattcttatatataatcagggccaaactttacagtttgaaaaaatatatgcgaatggctgatagtaaaaagatgaccaatagagcaaatctttagaaagattctatttttaaattcagaattattgtagaaatctaggccagaatgggactgctattgcttgtgatgctgaagtgagcctaaaatattaaaaacgacagtttactcaaacttttgtttgtgttatactgccactgccaccttctggtaaaaaagtgaattgtttttaaaagaaaacggacaaaaggtcaaaatctttgtttttgcaaaggaggctttaactcctaaattaaaggtaatgtacacagggaatcaagaggaataacatccaggccggatgcccaacgtgtccctagttgagaggtatgaaataaaccctaactgtaaggtcatcaagcagccacaccgtggcattatttataggtgagtagattgattgagaaaatctttctggtctctcctctaactgaactcccatgaagggagtgcactgtcactctccattgtgtaagatgtggggaccagagaaagagatctcagagattctcaagggtaggttaaaaaggtatgtggagataaatgtctggggcctaaagtagatatgaacagaaaacaagattcacaatcaggcgggagcagtagcgcacgcctgtaatcccaacactttgagaggctgaggcaggtagatcacttgaggtcatgagcttgagaccagcctgaccgacatggtgaaaccctgtctctatgaaaatacaaaaattaacagggcatggtggcacatgcttgtaatctcagctactgaggaggctgaggcaagagaaagcttgaacccaggaggcggaggttgcagtgagcggagatcgcaccactgcactccagcctgggtgacagaatgagactccctctcaaaaaaaaaaaaaaaaaaaaaaaaaaaaaaaaagattcagagtcaaaagacacgggcttatttatttaccacgcaaatatatgggtgctggctgttcagtcttggaagctgcagctaatgcagagtggcctagaacccaagcacagtaatagatgaggaaagccttgtctctgctctctgagtggagatgcataaacacccgcaacacaccaggattcaccgagtgtactgcagatgctctgcaaactgctccaaattgatctgcccaaagggactaggtcagaaaaaaattggagaggggcgtcaagaaaagcctcagcgaggtgagatttggactacaccttgaaagatcagcacaaataaagaaaggtggtggagatggggaaagaaagatgacttccagggtaaggaaaccgtgaaagcaccaaggggaaaaatcacaggtttggcaactgacaggaaccggaactggatgtggggtctggctgggtctgaagggccttgctatgacctaagtgtttgtatccctgcaaaattcatatgtcaaagcctaaagccccaacatgatgggatttggcgtcagagcctctagcaagtgatgaagtcatgaaggtagagctctcagggataggattagtgcccttattgagggaataaagagaccagagttcaccttctctctccaccatgtgaagacacaacaagacgtctgcagtctgcaaccccaaatgagggctgtccccagaaccggactgtgctggcaccctgatctccgtcatccagcctccagaactgtcagaaattaatgtctgttgtgtgtaagccaccagctctatggtactttgccagagcagcctgaaccaagagaagccttgagcctcatattttcctctgagtcgggagccatcacagctttcggcaaggataaagccctgcgtggacactagatttgtcatcttgaggaaattgctttacttctgtggaccttgggcttctcggtaaaacaaaatgaagttgcggaaccaagattcacttcttgatctgtctgactccactctctgccacagcaaaaatgctaacatctgcctatctcagatgttgtgtggggatggtgggaagttaattacttactcccagatcatcaacaaagctgaactaggatttcacacagagacagaaagtacgcggttccaccaactggcattcaatgtgtagtagcatgctaaaatattttaaattagaccatcctaatgcttttggagactctaaaggtctttctcatttaacacctgttattatctctaccaggaagaaacccaaatttaatgatctgtgtctgtgataaagtttaaattatcatcattcttcttctaagctgcaaagatgtgtgactaggcaggctcaaaaatttctctccaaagagttgccctttgaagagcagaatgaccttgggccaggccccggtagactggcttcctccatagtgtgtaattcaccccaggagcagacagcctgaggagcaagggggtcagtgggctcacacagcccagtgccagaaaggccagagcctcacacctggaacaactgggccgcggtcttgaatatcacctggacccacctctgtctctcgtctctctctcctatctgggtggcttcatcctcccaggccttgggttttcactagacaggacaaaatcgtggccacaggtggtgcttgtctcaccatctaacagctctgccatcagaaagaaggggcggtgatccccaccagctccagctagaaaaacgtgaagggaagacctatcttgtgcaggcctatgtcacagccacttccacccccatggctctggccaggtgggaagaactgtgattggcagccccacagaaccatatggtgagagtgtgtgtgtgttatgtgtgtgcgcttgggggtggggggtagggagtgttacacactagaacatgggcgttcttccgggatgacccaataataaatatccattgcacctggccgcaagaccagaccataagctaagtatattgcatccagcttatacaagttcttcggtaagccaaatttataaagtgcccactattttcttttctcagtaattctggaaaccttatgttgatagtttgtagaaaaactgcaatttaagggagaaatgataaccatttatcattctgaagatactgctgtgagtggatgccaaagagcccttaagttgaagaaaaactggggaaggcatcttttcttatcattccaacagtgctctagacagggcgaaataaggcaactggaataggtgaaatctgcctacttcacccctccatagctccaataagctgcatctcctggctttcctcctctgctctctgcctttccaaaaccttcattccctcacacttgagctccataagaattaggaacaagggctgatttgaccaaatacccatcatttatagttagtgtgactttaggttatcattctctcctgaagtaagcagctaaccccaactctaatgccccattctgcaataagagaatattattaaaaacagcatttcttgatatcttggagttacagtgaaagtctcaaaactgaagtcagtggatggcaaaaacttctttccacagagagatgctaaatactcaagacagaagggagtagtcaacttccccaacccctcatttacaagaaaagactcccctttgggaggccgagatgggtggatcaactgaggtcaggagttcaagaccagcctggccaacatggtaaaaccccgtctctactaaaaatacaacaaaaatagctgagcgtggtggcgcatgcctgtaatcccagttactcaggaggctgagacgggagaaatgcttgaacccaggagacggaggttgcagtgagctgagattgcactattgcactccagcctgggcaacaagagggaaactccatctcaaaaacaataaaaataaaaataaactcccaagaatcccttaacaagaaggactgacaagaggaaagacatctcactctctgtttggagcctcctgaggtatagagaagtgtggacccaccctgggttacctctggactggaaagtaaaagaaacgctgagaaccatgagagccccacatggcccaggagtttagaaggcctaagtgaagagagaaggtgtctgccctatatgtggagcagtcccaaggctggagtatggatggcgttgcccattacagcgaggtaagcatgggcaatcagggagaagctggtggtttgaccactcatgccactgacaggacaaggcacttcccaataggtcaagagggcagagcaccaagcttgcaatgtctttgaaggactgtgcccgagagaactgcctgccaaggaaagaagaggatgggctgcccttccagcatgggagttgagggaggtggaaccaagagatcagctggacaggaagacatcaatcatgtcagggtggcccctgacaaatgcacccttggagagggccaatatctgggcacctgccatgacagaggaaacccaacagccaagagagatctagaaagagcaccagctaatcaaatggccattggccgctttcctccactgtctccttctctcaccctggaggagcctgaagcaaagcagggagaaatggtgatatgaggagaatgacaaaacaatgttctctatcttcttcatggcttgttcaagaaccatgagtgagaactgtgttgagggtgacagaaagagaaactttaaactgggggaaaattatagtttttattctgattgagatttctgtaatgcctgaagaagacactgttctcctttgaattcatctatacctaaggttctagaacctgctcaagatgtcaccaagaagcaggagaggataagctgaccaaaagtgtttgaaagcagtgacaggagagacacagagcaggttccagcttctgccctaccaaggtcgcacaggtcaataaagtgatgaagctgcactgacaccttccattatgcagtgaaaggctttctcttgataaaggaatttgaaacaaagtgagtgagagggaggagcatgttcacaaaacaaaaagtgctaacaacaacttcccacaacctggcacgagagaactccagctgggaattgctggcacttgagggagacctcgaaggatgaggaggttttggaaaggtggaggaagatgaagctattccaggtatagacaataacatgagcagagtcgcagagacaggtccagagaggaagaatgatctagttttaacagtcttggctccatggggagttcttgtcagtgttaaaaccagaaatacagtgtggagtccacacacggtatgcttaaatctaatctttaaaatgtggattttattctttaaataaaaccatgagaggcttttgggcagcaaaccaccattatactaatggtatctgtgttttaggaaaataactctggtgacagggtgtaccatccggaatagtgagagtagcaagaagccgaatgcactccgattggtcaggaagtgaataccatgtggataccaagagacaaaatcatggctgtggttccagaaatggaaaaagtaagactgagtaagcagataagttagaggtaaggtagacaggactgaccgcagcaatcctcatagacgtgtctctgaatacattactgcggtttgaacattttcccacaggacttccaaagaaattccctcatttcctagggaaacctagagacccccaaaaggccagccatgctctatgatgcccaaagttcagcccggctaatgaagagtgaacctccacctgctgatggggcttttgcaactcggggccactgtttcctcaggggtatggggtcatctctgctgcctggcagggcaatggcagaaacagctctgcctccctctccaagcccccagcagagccagaaaggatctctattccagtcccaatcaggtagacagcagaaggctgaagcagcttattactctgcccacttggttcagcatggcccattcttgcttctacaatagcaggcagaaaagagaaacacctgaaatgtatgttactgtgataagttttcccacctgaagaaaaccctgtgactaccacagccaggaaagagcacgatctcacaagctgtcagctttcacttccctttcacatccagttaaactcctccacagatgtcattacctgggctggggaagtttcctacatattcctcaaaaataatactttatgcagtgccatgctccaaagcatgatttttatcaacctgtgtttggagatgactcccagttacccttacaaaggcttcctatgagttgtggcagttagatcaagttggatacagaagcccagacattctgaagaggaaaaaaatcaatgtaaatacatgtaacttctacataaaatatgcttttacctaattgaaaagtcattatcaattagccaaatgcaactttaatcagacatgaatgattgaggaattctatatttagaagaacacaggttggcatttgaaaaccttcatgtctcatgccattagccttgaaaaccttttgccaggtaactgaggtgtgagttttaattcccagtatcaaaccaagaataaaattattttaattatggtcaactgggtaaggaacattgatgatctaattgccgagctgtaattctgtattctgtccccaggagacacacacctcagccaagtgcttcaataattcattaaagcacttccctgtgcatcaattatcaaatcatgtgccttgattactttacttggggaaagttacccttgcgaaaaagacttttaccaattatcaaaacacagaacctctaacctacattatacgattttcattaaaataatacaaaattctacaatagctctcagttatctatgtgccaaaaacaataggcaaaatggttacaagggccatagcctgaccagctttatacaaaattatgaggtaggtggtttggggttttacctccctaattctggttttgccagtagttcatcataaagaattgtttcaattttctttaaacatcaaaatatttgtggtccaggattagatcgtatcaccttcatattcccatgatgccaaactccatgctttgaatatagagtacatagcagatcatcagtccgctcttttccacaggtcatttgtgactttgatcatccatagttattgttttatatatactgttttacccaaaaattcaaatgaaaaaaaaatatgaaagaaggtaaaaaacagtgaacaaatgtataaataagagtctataaatagaaactaaaaataagatagtctcaaagtgtatttccttagatacatagagaaggcattccataaatatttgttaggtggtaaatcaacaaaaaaattagaagagaataagaggggagaaagcctccattttcagcttagtggccaaagattttgcccttacagccaataaaaaggagtaacattcaatgtgaaatttaacttttcttcctgtactgatccacctccctatgataaaagcaattctaaacagaaaatcactggattaatgatggccagagaaatatagatgaggaaaggacaattcactgattgaataatcaatcctggatagctaaaaactaccttcatggggtttactaactcataataataaaaagcaatgagtatatttatcctctgtaattatttccattaccaacactcttcttgatactgtagttttaggaccaatatgaacactagaattgagcacaaaggtagtgtatctcagtgcaactgttttttattatttttttctgtacctactatggaaaggaatgcctccaaaacaggaacttaatgtagtgcatatttgtcagtgtttgctcgcacagcatggaaacatgatttctatgtttggaaatctaaggtgagggaagtgggggcagttgagagatgggggggcacagatctgagttctgcctcctcccgtcacacctcccacctcccacactgcacttgtgatccagtgattgtgaaggtgatcaggaattttgaatcttgaaaggatggggcatgggcagatgtagacaaagactattcactgtagcagcagcggtgagggtggagtcaagagcccagcaacgtggcaggaagtgtccggtgggcggagtccagacacgcagtgtgtccacagggatgtcccagggtcagctgtcctgccacactgttcttgtgggggtggcagaggagtcttgcccatgacttcaatctcttctttcccacctgcttaccacacacagacaattttgtgagccacctgtggtgcttgtaacaaattccttctctgtttaagttagacagagcggctttcttttgtcttgcaaccaaagtccctgctttgtaggagaataaaatacaatgtttaaaggcataattttctgggaaacgaaacaggtgcaaattcaaaaattagactcaagtttagaaatagcatgctttccccatctttcacccctccctacttacaaaaacttcctctgatgtatataaataactcatataggcaccaaagactccactcgacagcctgtttaccctttgaaaaatactttttgcctaattataataaaaaagtcttaaatttggtatttagataaattcgcaggtaatcaggttaacccatcaccacagggcataaatgaatgagggggagaagaggagaatgccaaattagattatccaactagagcatctgtcaataaatggagggaaggtgaactaatttagagtttgttttattttacagactttaaaaagaccaactggctttttaatttagaggtagtcattccaggttgtcataacagccagagagttcataataaagggactattacagacataagattacgttttgcttcaataaaaaggtgagaaggcacaggggtgaatgtctgcaacccacaccctttgggaggggccccaaggttgcaggtctgagccgaaacccaatatgaatgtagcagttaccgaaggctgccagagttgttatgcctgatatttcatagaggatgtaaatattgaagactgagagactacctgaagtcactaatctaattctcagacaatattaaatctatgtaatgacagttacagccttgaatcctcagatattatgcctatagtatcttaatatcactatgaccttctgcaaggaaactgactaatttaaataaaaattcccttaatgttcctaacagtcttgattaaactgtgagccattataaagtcatggccacatagaggtgtgaagatagtgaaaagtgagtgtgagtgtgtgtaatatctgaagtattatctgaaattgtttttctgaaaatctgcttgagtccaggtttttaagatgccatggtctgatagatttaatcattagtaaaggtctttctacaatacagaattgatatatcttcagtccttacaggagatgagttaagtaaaagttctagcatgcttagtcctaaaatacaatgcctgtttgaaaatgttgaataacctttgaggcaaagagtttgttctaaaacttaaaacttctaaccagagaaaaattatcttttcctcttttgaaaacaggaaggatcttggcaagtggcacaagatccttttgaatgaaacctgaaaagcaaagattctttttatgtgaacatatgcaatttttcaggaagattttaaacaaaacaaatacataatgttgacagtcaaatttctgaagactagttgtcttaccctatagaggtatgatcttaactcaagttccagaggcaaatgcttcaaatattttcaaagttttaaatatttttagcactaaaaataaacacatccacagtaagtcagctgcacaaaaaaaggaaccctgtaaaataaatttaaaagcatccgcaaatgttcctgtttgtttttctctgtactgcccaaattctaaagatatgaaagtatggttaatgatgtattttatctcaaaatgttgagtcactggaactgttataatgttaaggcacttcttaattcctaatcagacggtcatcatatagaaagtctgtaaacactgaatttaaattctatttcaaaattagttttaaattcatcagtggaatcgattgtaggcccttattctcagtctcaagtcttctgagcattcctctttcccttccgccagctgctgggccctgaacagcagttctcatattaggacaagcaaatctggataattctcttctatcattgctaatcctttctctgaaaatttcattatgaccaccatcctgctcaccattcatccattcatttgttgactcacacaccaacatttattgaacagctaatgtgcaaggccactattttagatacttgggaggcaaagataaatgaaagcacaatgaacaggcttagagttcattgtgcagtagcaccatgtatacagaaatgccaatgacacacaatatatagatgtttgaaatggcacaaatgtaactgattcagtgcctggcaaataaatattcctgtgagagacaaagatatgtgctatcgagactgtccttcaatcaggacttgctaccccagctgctgggaggctggaagtggatatccattagctaactgcccttcagggactggctcaacactcttgctcaagacatgccctctccagatcaatccacatccaaagattgattaaaggcatgagcatttatgcccaacacagtgctccctctggggccagcagtccttcaggtgtgcatgaatctcaattctctgcctgctcaatcctgcctcctccaccattctccttccataggtcttcattcctaggatacttcctaaagagacatgctgccacatctgcttccagggaaactcaactggcaacatttcttaaataagtttttaaaataaactctgcccttagctttcttgcatttccatgaagcctcagaaatatgctactggaaatggctgcattaaacagaacattgataatggtaatgataataataatagaatggcgaagatttgacataggatttaccctgtgtcaggcactatttcaagtgttccgtgcatatcgcctcatttaactgttgcaacaattctacaaatcaatactatcgttaatccctttcaactggtaagtagagagaataagacaaatacctagctccaagttcatgcagctactatttggttcccaggcagccccaaagtgtaatctcgtaactactgtattagtccattttcacactgctataaagaaatacccaacaatgggtaatttataaagaaaagaagtttaattgactaactgttccacatggctggggaggcctcagaaaacttacaatcatggtggaaggggaaacaggcatgtcttacacggtggctggagagagagagtgtgtgagtgcacaggaaaaactaccatttataaaaccgttaggtctcatgaaaatccactcactatcgcaagaacagcatgggggaaaccacctccataatccaatcacttccctcccctctacgtgtgcggattacatttccagatgagatttggatggggacacaaagcctgatcgtatcaacccctatcttctgccatttctcttattctctagcatcctaacaaatatcatagcatcattaatacctgccatggaattacacaccttagaaggtcttttagataataacagctgccattcactgagcccgtatcacatgctggctctgttgtgagtccttataacttttacttatggtcatgacatccctgtgagttaggccaggcttggttattcccatttcaccaataagaaaacaggctcacaaggatgaagtgacttactcaagtcagagttcacaagtagcagagatgttctcaaatctagcatttctgtctctaaaacaaagtatctcgaagttatctggatttatttaaactgtacttaatctatgaactatatacttaacctaaaatggcttaaagaatttaccatctttaggatccatcatttttcattgtgccaccttagccactctctaaacacatcagaaatgtagaagacagaatatggccctctgtccattaacacagctatagctatgatctggaactttcttttataaacctagattacttaaacagaattattctctgtattctgtgaagggcttcctgaaggtctactagagcttctgctcaaataaagaggcatcatattctttagtttaagcccaagtgctatgaatgcaccacattttatgtttgattatatattttatgttttaaggcattgatgcaaattctaggaaatcccagttcacaaggtgtaataatatgatgttatatctgtgctttgaagataattttagttttgaaaagaccaccaaggcctttggcccatgagtaattgattaaattcagcaagcagaagtcattcctgtaggtaacataatggactggggagttaggggaaggagggagagtaagagggtttctcatatgtcattttttttttttaatggcagtgaaattacaagaatttttcaccttgggaaatacaaaattataaatttctcctgaccaaaaaaggacccctgaacagttttactataaccaaagtgagccgtgagggaacagcggctccaacacacagtgcacaatgccagcttttggtaacaggaacaaatggacagagaataacgacttccgcaaggcttgctccttgatgggggaaatgcactcactctttgtctctattatgtgctgcctgacaattgttcccagcagtgaaaggcaagctcaccctctgggaatgggttcaaatataaatgactaagagccctgtcaaaggtcctctgtagctgacacccctctcctccacccctcatcccctcaagggcacttcattttcactttattacttttttccctccaagggcagattaaggttcaggaaaaaatgccattataaatggaggttcttgattagaggctaaaatgtctgccctatcttacctcccactcgctttacttctgttctgcctctttccaagattatccttttctgcaattgcagaatcccagtccccagttttgatatttgagagtggcttcggtaatggctgctgtaaggcctctcatgatcgacccctaatgaacatgcacaaaccctggaaagcgttgcttcagtatccatttactctgctctcagcatgacagctgacagcctcctgcactgagggaaagaaaggccatggcttctgaaagccacagtttactttacttttccttccttgtgaaagtcaggttcacccatacaacactcttttccatgctctggtgttctgaaaatagcagtcatttggctttctcgggagagttaaaacaaagaaatcacaatggcaggaggcttgctgttccaaaactttaaaataacaaaaattatggaatgcatcacaaaagaaatgacagatgtccttgaagtgacccctcatgacacagttcaacagccatttaaaaataatggtcaagccaggcacggtggctcacacctgcaatcccaggactttgggaggccaaggcaggcagatcgcttgaagttaggagttcctgaccagcctgggcaccatagtgagaccatgtctctaccaaaaacacaaaaattagccaggcgtggtggtgcacacctgttactccagctatttgggaggctgaggcaggagaatcgcttgaacccggaagggggatgttgcagtgagctgagatcatgtcactgcactccagcctgggtgacaaagtgagactccgtcttgaaaaataaaaataaataaataaaaataatggttgacagcttgaattgggaggagacatagatagaaaagaaatggcttaaattccacaaaataaggttttggctcataccgcgtacattgagccatgttcaacgtgctttctgacagagaaagtaacgttttccacggtgggaagggctgggaaaggcactggctcaactgcgtgttactacagctgacctttgaaatctcaaaatctcttcacctctactatctttctcgattctcacaacaaccttctgaagttggtgactgctgttaatatcttcatttcacagagaaaaaacagtgatgctcagagactaagttattgctcaggcatcgacagctagagagtggcagagctcgagcacaaactcaaatctttttcttccaaagctcatgtgtttttcactcctcacgccggattttagtggcatggcaaattctcagagggtttcaagttaaaattaatttttctttcattatgttaaatctgcttccttataatgcctaaaatgaggaggtctcttttctttggcaggcaaaatggtgaccacgtggttgtcagtgtgttagaattaacattcttttaaatgagaagttgatctaccaaacatgatgtcagttaaacagatgcgcagtgtgacagtgttctcagggtaggtgccacaggtcaattatgcaagcattgcataagcagctcattgttgccagtttctaattagattcatcagggacttattaacctctggaaaaagttacaagttttgcatagaagcaaaatgaaaagaaaaaaagtcctcattcacacaaagtaaaatatgaaggaaaaataaaataaaaataagattctggctgggcgcggtggctcacacctgtaatcccagcactttgggaggccaaggccggcaggtcatgaggtcaagagatagagaccatcctggccaacatggtgaaaccccatctctactaaaaacaaaaacaaaaattagctgggcgtggtggcatgcgccagtagtcactgccactctggagggtgaggcaggagaatcgcttgaacccaggaggcggaggttgcagtgagccaagattgcaccactgcactccagcctggtggcagagcgagtctctgtctcaaaaaaaaaaaaaaaaaagaaaaagaaaaagaaaacagaaaaagattcaccttattcacatactcatgagaatcaattgcgtaaaaaactcctatttcctgggcctcagagacattaatccaatagatctcaggtagattccaggaacacagcattttgtgcactactcttatgtagagagtaccccaaccgcacttagaaatgtactggactgtgggtgggaggacatggggaggaagttggattcctgataaaagctgcaattcagagtttgcaagatgagacaaagttacccttcctgatgccggctttgaatgagagcattgttagcagtaatatataattaagctctgccttcaaaaatcattgagactaataataacttggtagatagtaatttgactagttttcagttttaagtctctacattgcctcttactgtttgtagctagaataaaacttcattaataaagaaattaagtggactgaagtgaacctttatactatttttaaatgatttgtaaaaacaagaaaaaagacttttttttaccatcaagtcagcaaagggattttttttatgttaattctcagtacaggtgaggcaggtaagttcctaattacctgtaggaatgcaaatttgtgtaatgtttaaattgttctggaaagtaatttggaaatgtgtataaaagttttccaaatagtcataacctttggttcataaatataagttctatcctaatgaaaaatgtgcacaaagatttatacacaaataacgtttataacagtgaagtttttgtaacaatctaaatgtccacaattggaagatagatagccaatttgtgatacatttctattaagcatgtcaagttacaaataatcaaatgtatctagtgtccttctcaactgagccctggccccagtagggaagagcatgtgttcctgacatccccagttggaatttggaatgcattttcctaaagaaaatcatactataaatagtcaatgtgtttgcaggccaactaccagaagcctatttaaccaaaaagcttaaaactttaggaggaacatgaaccttagaaaatataatagtgctatttcaacatcaaatccaaaaatattataattattacttgaaaaaatacattttcactgctaaacaactgacttataaactggcatcaggaacataatcatctcgttatctgtcttctgtgtacatacacagaacataaccatatgccttttgaatactttccaagataaattctcaaagaattaggacaactgtcaatttaacccccaaatagtattattcaacaataatagcaatagatttttttgtaatatggcaaagaaaaatgaggctatcctgtaaagtggatttcagtttgttgttttaattaagttatcatgtggaattggtagtctagtagcatgagtggacctcagcaatgaacctttcatttgtgaagaatgagttaaaatcattcctattattattgctaatttacagatcaataccacaataatgtatttgttgccatgtacactgcaggcactactgatgaacaggaaagtttaaatcttaatatgtctgataaatttaatctcaaatataattctgactacatgaattttagaagtcttacattgtttataacattacctgagagtaattttattctgtcatacaatatatcaaattttttctttgtttctttctctcgtcctcgctctctttctctctcttcctctccctctccctttgtctctctgcattgttcctgacataggtttttgaggactacacactgaaaacttgtccatgaatatatgtcacaatcacctttttattcattggcatgggaaggcaataaaaaagcgattacattttcttttgcctatagctttaaagcagccacttgacctatggcaaacatgaaccaacctttatttcagaggtttgcaatttcaggggtaaacgtggtgctgcatctcccttgaagactttattaaagagaactctatcacgcttatttgagttcttatcaactatcttggcctcaaatgtatgttttccctttattactcctctttggaactagcaatacattctattccattatagagccctctttttaaaattcatattttcatatttcttccacccaggtagacaaagttaagacacgtgcacaaatgagaaagtttgtactgatcaatttttttgtaaacagaagatgaattttctctgtgtatgcttgtgtgtatatgtttatatatatatttattattattttattctaagtaattccgttgctgaaacatttaatcctactttttctgtttaagttgctatattattcccaaaggttgtgatggatgaatttattcagcagacattcactgtgttcccgtatgggccaggcactatcctaagtattaggaattgggtgagcaaatgagacattctctgccctcattaagttttcagtctaacaaagaagatgaacattcatgtaatcttcacataagtatctttttatattgcctcacttttttgagggtatgaggacatctatgtaaatcagtttccaaacttacaagacatgagggatccctaaactcccagggagagtgcacaactaggggtcttaagattgggttttcacccagctttcttcctctactaaccattaagtatgagagctacttagagctcagtctgagagaccctctatctacatacacctcaccctccccataggcaattgtattatgtacatctagaagctttaatcattatgtatacaaaggtgaaggtgacacccatgtttatgtcttagtccaaaattttttttgaactagatttctttggattggattgacatatcctacaaatgacttggcttcttctcttgggatatctttaaatcatctcaaaagttatgacctatgtctcgtgtacatgaccctgaaaacctgctcctcttccagaagaaatactacttcactgaagcttttcagatctgagcttaaatgtcacctccctagggtagactcatctaagcatccttcctgtcattaccttcttttataacagcccgtgtttccttttcattgacctgtatttattacaagtaataattctatactcgtgtgaatattcatgtaattaacataataatatataaatattttcagaaagctctgagtataatggagctgctattatagcctcaatatttcttagaatagacacttaagaaaaatattagctggatgaatgaatagacaggggaaacgtctcagttatctggattcagacccttctgggaaaagagaagtagttgctggtttctttggctctctgagcaagtttaagacctcatcttgagtcaacaagaagtctggcacagccaagagagttaggggatagctggaaaggatgccactatctaatgcacattaaaagggttatttttaaggttctccaaccttgtcctccaaataactcattctgagaacttctttggactgcaaggcaaaagttactggaaatgatagggagtaagggttcttctccagctgccagtggaaacagatgttagaacttcctggacatggtttgccactctagcagaagctactggaagactgagagcagttaccatctgaaaggagcagccactgtcatttgttttcaacaaacaccacagagagtagctgccagtgagaatcttcatcattaaaatggtcactgaaagtctgcttcagaagccacagctgagggaagccaccaccaagaaatactgttgggtgccatccccatcccctgaaagcaactaaaaggaaaaaacgttaacaagttgaattgggggagataccaagatttcagtccttgtccctatcttagtttatgttattttactattgacctgtaggacaagacagatttcagttctttcaatataatcctctttttgtaaaaggaagacaatttttcaaaggaaacttgatgaagattgagagccaaaatatctgaagaagggctcacattaattctcaggatattgaacaagacactagctcatagaatcccaattgaaggtgcacctcagaaaataacaaaagaaagtgaaaaaatgtctcattcaaaatgagggagaaataatcaaatagactctgagcattagttctgtaaatgtaagactgacttattcaccattgtggcccaagagttcttagaataggctctcaaaaaatgttgaatgaatgaatgaatgaatgggagagtagatggatgaatgagcaaatgaatggcatccatttaccttaagatatattaactaagaatagaaaatatgattcactttaagtaaacacaaataaagtgaatgtgttgaacaagccagctatagtttacaatatgataatatttatttcccccaaataagacactttctatttttctatgtttttaagtttttatgtaataaaacaataatttatcttgtttttaatctacatgcaaaacctagaggtctatcacagagagtttgtcaaactgtttgatttgtcgtgctgacaaggaatcattgaaacaattttttaagaaaaacaggttaggtacagcatgagagtatgtgtgaggctgaggcaacggagaaggaaaccatatgctcactcaggttgtcgagaatctttaacacttggcaaaaatgtcacttaatttcttgctggaaaggtgcgacctcctaaagtctttcctcttcatactacgtgagagcatcttttggaagggaaaccatggattaatcttacttgatctggcatatttgggtttgggagttttttaggcagtcctaaaagcctagaagatgaaaagaatgagggccagcagctgtctacaggacagagcactggacagaagcaaacatggacctcctagccctcacatcaccttactgtgagtctccttggcatcttgtgtaggacaaggtatatttaagattattggtctttcagtattatcttcaagaagagaaaataacaattggccacagggaaatatgattgaattggaggttcataaactttgttagactcaagttaaaagagatcacttatagaaccagtctatagagcaggataactatggattacacttgacaaaggagtccagaatatatagggtaataacttttcttaaaatcctaaaacatatgtgtattagaaagggaaaaacaaactgttttttcttctacattcacgcttatcacggaatacttcaccgcttggtcactaaaatatacgggaatttctcctcaccaacaaccaattctccagtagactccagatgggcgtcctgtgattctactgattctgacactatctacctggagatagcaccagatccaacaggtgaaaagcttagtcccacaagactgtctcccacttcagacaccaatcacaagtcttatgttgtaacctgtacttcctactagccagcaataagttgagaattcccatgaccccttttacgggttctattactttgctagtaaggctcatagatctcagggaaagattttccctatgtttacccatttatcataaaggatattacaaagaatacagctgaacagccaaattaaaagatgtgtagggcaggggacaggggaagaggcagggagcttccatgtcctcaggtgcaccatcttctaagcaccacatgttcagtgattcagaaactctctgaaaccacatggttcaggattttttatggcagtttcatcacataggcatgactcattattaactcaatttccagccccccttccttctccagagaatgggggtggggctgagttttaagtttcaagcttctaatcgtggctcagtctttctggtgaccagcccccattcaagtgttgccctttagaacaaaggaatctactatcacccatgaaatatcaagggatttaaaagctctgtgtcagatgctcctgttcctcaggaaattacacaggtcttaaaagctctgtgtcaggacctgggatcaaagaccaaatattagaacctaagattctcctagcacccttatggctcaggaaattacaagggtttagaagctttgtgccaaaaatcaggggcagattatatatatatgtatgtatgtacttacatatatatatatatacacacacacacatatatatatcacacatatatatcacgcatatatacatatatatatcattatttcacaatatatgactactgtcacaactactcacaaataaagacgtgtgcttcagttcactaactaaaatcaagaaccttctttaaggccaggatcacatatttattataacttggacaggtatggccacaagccatactgtttctgtagcaatgggatcgttgagaatgcacagaagataaaaggaagttgggcaatgacttcattataggatcagtcacaagttggagacaaagaaacccagtttagtttccaaaagggcaaagcatattctggtttgattcacccacattggcatccaaagagactcatcttgtcaggggtagggagagagtgctgggtcacagcaacatgagttctaagtagccccaatatttaaggtgtttagatagtgttcaaatgacaagattctggatgctctgcctgattagaccaggacagcagccagctggtggtagagaggcaaagaaggtttaggtaaccaaggagaaaggacagcaaaatctcaaccccagccaatctgagccatcttcaggttcagggaatactctagtcctagccttggcaagtgtgacagcttcaggattttccacataagaagtgtctaggcattgcccactggttggggacttgtcttaaagctacatttacagagcatattaattacagtaaccctagtagcttctatagtaaaccccaaaacctcagcagctcagcatattcgaagtgttttttcactctaattccaactgagtgtttcaggggcagccttatttgaggggcctacatttgagtcccaggttccttccattttgagactgcatcagcccctgtagcctcagagtgttcatttgtgatagtgaagggaaagatgatgtggtagatcacatggaaaaattagcaggccaagacttggaaatacattacctctgcccacatcccgttgacttaaattcagtcacgatcacaactaagcaagacagtgctaggatagagagtttctgggtgagcagccaccttccagcaataactctacactgtgaaagggggacataagtttttggtgaaaactagcagtcttgcagcattgagtttacctagagtatatgtttattcggggtaagggagatttgacaatgagaagtcagtggatcatagagatagtaagtgataataaaactgttttccggaaaggcaagaacactaatgtgtttatatacataggactattataaatttttgtaggttggatttttcattagcaccttggtattgtaatggagttataggaactaataccatgttgctgataaagaaaccggatcaaaaaaagaatgagtaccaaaaatgatataagtccagttgcacctatcccatgggtgtgttatgataaaccatgatttaaagaagagccaaggaaaaatcacataaaaatatatatactagaggagggagaaaaaattaacacttattgaacaattactttaggttaagtactaagctggacctgtcagttacccagtgctatgtaatccaattttcacaaaattaacgacttaaacaacacccatttattatctcatggtttctgcaggtcaggagtctgagcacatcttaatgggatgccccgcatagggtttcacaaggctgcaatcaagacacaggccaaggttgtagtcccatctgaagctcagctgggaaagtatccatttgcaagcttactcaggttgttgaaagaattcagttctgtgtgactgaaagcttcagctttttctgggtgttagctggtgagcacccacacttccttgccatgaggggtgccccaacatagtcacttgctttcttcagcaagaagagagaaattccagcaagctacataaggctatctgaggtaacatagtcacataatcacatcgtgtacctcctatcaacatcactgtatcctctttaaaacagtctggatggcccacactcatcttcccactatgcagtttgacaaagttgtctttaaggttccaccttcacctctgcatttgggtgtcccaggctttcgtactgattcttgcaaagatggtcatgaatatctgagctctcaggatagcacctcatatttggaggccttaactcttccccaacaacccattcactcatttaactgccttacaaagtgactgactagctaatcagatcaactgaattgtgctaatagcttattgcattctgccactgaggtaacatatttgtattgttgaaagggcattacaagagagaatacctgccagatttatattcctaatataatttttatgtctttgctttatggaaacctgctttccaaagcaggtctgccaaatattctatgtagtattggcaaagtaatttagactcttcataaaatgaggagagaagattcaatgacctctaatatcctctccaactctatgtttttatgtttttgttttattcttttctcagtaacctccaataacttcatacaaggcaattgccaaactgctctccaggcattcaagatccaatgtaatctggcccaaattttccttcctagatgtattcactgcaggtattctatatttaaggcaaactgtcttactcaagtataccacatgcattcactcccagaatgcttctccttttcctcattgcatttccttgtcctacctttcttcaagccaagaggaagactcccctcctcgttgacaccttcccatccactttggcccatatcctactctaaattctggtaactactcaatctccacactcggtgggcctttggtttgtctaagtttcctgtgactatttaattttaagctctttcagcacagaaaatgtctactgtatttttgtatatgtcatagaatataagtataaatagtttgaattcaaaaaaatctttattaagcaaatataaaccaaagaattaaaatggatggtaaatttcagccagctgtgtgagttagaggggaagatgtatggagccttttatgtttttataagaatatacatcattatacattgctgtatgctctcctgacagagacagtttcaacaccctatactcatcctatcagaatagcctaaattttcccatctcccaaaagtcactcctttcaactagaatgtctttccccattctatatccaattgtaaaaaaaaccctctccattcttcaaggccaaactaaatttctccttcttctatgaaaatgttcctgaccttctagttgaaattaactctttctccttgttattgctttttcactttctgttggtgttgtactatagtgagttatatgcctctccaagtcatcgcaactagacggtaaactctttaaaaatgggaagtacttctatcatgtttttcttttgtacctttcagaataccaggacagatcctgctgtaagtagtaggtggtaaaataacagtaggtggcaaaataacagtaggtggtaaaataatatttatgaaattgacttgggaaagatgcctcagtaaatctagaacacatttttacaaaaagtgactgatgccttactgagctttcttctacagacagaatttaaaataatccatcatctaagttcaagcaaagctatgttttatttaaaacaaaaacaaaaagcaaaagaacccacctgaagagagcaaattatgcaagtggaaagctagtcaggatcctgagaactttgaggtgaaaaaaaaaaaaaaagaaacacacagagaatggttttacaaatagttttcctaaaatgtgattcacataccactgtggtgcttaagtttgtctaagtggtagaaatttacagtttttatttttagtattttgtatttattttgattgtaatggaaagatatatatacttaataatagtttcaggggtattttgctcatgatgaaactcaattaatttaagtttaaagaaagaagtaaataataaatagttcaaatcctacgggatgtaataaaagttgtgagaagactacagaaatgactgcagcttgagaaagaatgaccaatttctgtgttctaatcagtcagtcaaggtcatgagagctcattggaacttctgatttctcggttctcctggctgatctcaggccactgtctaaggctctctgaatgtaaatcatagatttccctcaagagttttcagcccttgagtatttgctttttaaaagactggattctatcactggccacattaatacaatttctaccaacaccccagaatttcctcagcatgtaacatttcgtttttgcacagctgtttcccgaggccacgggctcctgttgcaccctggagcttgagtgatgaggattctgtgttgttgctaaagtgcctctcttcttctttagagaggcctggatgtcgatatgcagcaaacgtcccactgtctgtggtgcaatcgacataggtcaacttgtttcgaggctgggtctctgaagggccaggtccaggctgcattttcctcccggttgtccaggccaacgatccacattgtactgcttatgaaggacagttgaccttcaactgtctcttcaagggctatggtttctaaaacaatgccagccatctattgaaaacagcttcatcagttgcattgttatcctcaatgattttcagtttctcatcaacgtagttggtccttcttgctgattcttaaataaatgatgatttactattcttcttctgacaacttgaagattcctgacattatctttatgcaatgagtgactggaacaactcacatctgaaattaaagccagctcaaaagcacaagtcaaatcagaatttgataaaatggacaataaaaaatggtgagaaacagagaaaaattgttttagtataaccttccacatacagcattttttcccacaaaccttcaaattattttcaaacatctcattatatgggtacttattttccagccttttcactttttttgccttcttccctatccatgctttaaaaggaagtaagaaaagacattgcaaattcaagaaaacacaagaagtcagggccataattgcacggcaggaccattattgtttgttgctgttcacttcctagaaacaagaaaacaatctccttctttttgtggactgataaaacatgaaggttcattgactgtggtttctactcttctgtctggctttacaacagcttcaaattaaaagcaggcaggacaaggggataataaagtgtccaacctcatcagctttcagcttttttattctttatggtaaaggggatttcagtgtttctttgtcaagcctatttttaagaaaccactttcacagcttttacaagaaaatgtcactgtgcctctggtgcaggcaagggggaatctaatttcattacagttaagtgcctgactccccattaccctccataatagtgtaacatggtatattataggactttaataaataggaaggatgtgggttgcagcacattttagtagaaaccaaattactttgggccacacatctgcctcctcagttcatcctatttgccactgtttcacaacctaattacaggattttctggaaattgctgtccagcagtaactggatgacctgctttatgtggccgagacaggcagctccaccgacttcagtcttcatcactgtcaccatgtaattgcattggacttccatgttaatccctgaaggcgggaagcaaatgaaatattataattaccttttattcccttgcccctgaagcctggattagggcagtgtgcatccaaaggaaagaagtggggactgcttctaagagtattagcgatggtctgatcaaaagctgaggatggtctcatcttcagcttttggcctgaacacgggccacatcattaaagccctatgtctcatccacttagcaaagtgtgtggcccccatctgtttaatgcaggatcactatgagacacgttggaaagatcctggaaaaaaggcctattttatcaatatgtatgtgcaaggcattggaatttgaaaagacttatctgaaggaaagggataggtgaactaaacttaagaagagaactaacattttcagactattcccctgaaaatataaaagtgcactgctgttctttttgagaaaattgtattggggtcacttaattgacatatctcactaagaatgacctgaattattgaaaaggtacatgaatttaaggctaaagttttctagtcttttttaaaaagtctttaaaatccaatgattctttaatgaatgggataaaagcaattctctgaatttaaattctactcatgagcctgtaaaagatgtaaaaataatcctcaataaagcaaatcttgactttgaggaaggaaatggctctttgctgtgtttcatttaccgtggtaggggtgggttgagtgtaactggagactaatccatggtgacctgttgtccctgattactctgcaggcaatcctttgaaaataccttaaacatggagttcacttaatttctacttccctcctgaagagttctaagctgggacaagagtctgtgtccttgagaagtatctttggagttgcactttatgggaattattgaatagtactcaatttagatataatttcccaaaatgcatttttcaatggcacagcaggaagcatgatgaaaaaggggtgacattccctttaactaggcaactcctccgataatagaaacaacacttctcaattttaaactgctgctttcactgtatgccaactttatcattatgtccagagctgaggacataggaacaaacaaaatggcaatatgtttgtcttcttggagctcatactccagcagaaaatcatgcagaaaagtaaacataacctgcaaaaatgtaagatctgtgagtaaatataaagcaaggtaaggggacagacattacaggcagaggggttgaaggagttattttcaatagggaagtcagaaattcttctctcatatgatatcatttgagcagaaacctgaggcaatggagcaacccatgcaactaacaagaggtagagaaaatccaaagaaaaactttggctgctggcctggcatagtggctcatgcctgtaatctcagcattttgggaggccgaggtgggtggatcacttgaggtcaagagttcaagaccagcctgaccaacgtgaaacctactgtcatggcatagtgttgatgagaaagcactaagtagactaaaatctaagctgtctactgttcctgctcatacacatggtacctactcttcaatgtccagcagcctaacgagctgacccaaaaaaaatggccccactcaaagatgaacaaccagataggaacgtgactgggacttgcagtagataatgcagggaaaagttgtaacaaagacaaatgaaaaatatacattagaaaaactatacccacaaagaaaattaaagatgaacaaacccatctccatgaaatcaaagaaattatggtctcttgaaaaaaaataaacaacaaagtttaaggattcaagaagataatgagtcaacaaaatggaatgaaatgcaagctggagtggtcaggaaaaaaaaaaaaacaatgataaaggaaaagaaaatggggtcaggaatcatattaactacaatttattcattgcaagcaacagaagtggactcaaaccaacttcaacgaaaatggaatttaatgacaagatatggcagagctcccaaggtcaaaggaaagactgaagatcacacaaaggaacagcaagttccagaggccttgttgaaggaaaattattatagttttacctggtgtcacccctgtaataaatgcatgaaaggtgactctctagcttcatccttgttctcatccttgttcaagattcaagattgcaggagattaggtcatgtcctggctcttggttataccaaggcagtacatgaagcgcttcagtataagaagcccatagagatcttttccacatctttgttagaaggtaagaatatattgatttatcatcctccgagacttgcaccaaacaggggagaggaaattccttaaagggaaataatgctgccgttcgttaagtaaatgatagaatgcaaaaaattagtaactatccactataactatccactacagagacaggatagacaggtttgagaaaaaaattaacaggggtagaataaaaagcaaaaaatgaagggcttagcaggaagtagaggccagcaagcgaacaaaacttcatttgtatttacaggcactccccattgcttgcattactgcctgagctccatctcctgtcagatcagcagcagcattagattctcataggagtgtgaaccctattgtgaactgcacattgagggatctaggttgcgtgcaccttctgagaatctaatacctgatgatctgtcattatctcccatcacccccagatgggaccgtctagttgcagaaaaaataagctcaaggctcccactgtttctacattatggtgagccgtataattatttcattatacattacaatgtcataataatagaaataaagtgcacaataaatgtaatgcactcaaatcatccccatacccccttgactttggtctgtgggaaaattatcttccatgaaattggtccctggtgccaaaagttggggaccactgctcaatgatacaaacattgtgttttatgctttataggttctgtgtatacttctgtgttgcacatatattgttcactgatgagattgtaaccaatttgaggacacagactacttctgactcaaatacttatgatctgcagcatattatactaaggaatatagaattcatattttaattttgttcaggagctgaaaattagacagcttttgtttttaagaaaattgagtgcaagcataatgacaaaaactagcatctaattgcttccaaatacattaagaccaaaactggcaagtttaagacagactaaaattggaccttattaatctttatttcacaacaacaaaaaagtacatttattgaggttaaatatccccagccttttacttaaaagaaataacctctatgactcagaacatctgagtcttagatactctaccaaaaagtgctgcaaccagatactctaccaaaaagtgctgagaaaactaggaaaactaataaagattgcatagaaaataaactctatcttactataatgcttataagtgaagtaagagaagatgcttctaaataatatttacgaggaaaatatatatgaaaatgatgcctaaaattgttactaaaatgtagcagctaaaaccaaatcacattaatgatgcttaaatcactggcatcctactcagccattagtacattttataggtgatttttacactgctacttcacaataattacttatcaacttggaaacaatctttccctgataattctggctgtttttgtttaataagtgctatgcttaataagtgcttaagtggatacagaatcccatatggcctcttcctataaatgtcactctgtccatcagcaatattgataagcttgagaaaaacaatctacagctcaaggcatcgtgcttagcttacagaagagaaacttggatgctattttcttttgtcttgtaaaaatgaagactatgttcttcataatgattgataggacatacaaactaatatttagaaacttcatttaacagagaatatattttagaatgcactgggttaggtgagatttgaggataagctggtgagaaataaactttttgtttcatcagtaggttatgcctaaactctcctgtttctggaaaaactttgctgtgtaagggtgttgtctggcttggtttttgcttacatgtgtgtgtgtgtgtgtgtgtgtgtgtgtgtgtgtgttctgtcagtcatttgagcccatttcaaagcatctaccctgaagaaactttcacttccttgattaatccaggtatagatcataaggacttgaataagacaactgtggttaccataatgaaatcagtgtcttgttcagattatataggaagataatcaaggtggagattacatgtaagaatgagcctgggagcatgcctgctgtggattttaactttagctcagtcctaccaatatggtttggctatgtccccacccacatcttatcttgaattacagcacccataattcccacatgtcatgggagggacccagtgggaggtaattgaatcatggaggtggttctttcccatgctgttctcatgatagtgaataagtctcaggacatctcatggttttataacggggagttcccccgtacacactctcttgcctgccaccatgtaagacatgactttgctcctcatttgccttccatcataattgtgaggcctgcccagccatgtggaactgtgagtcaattaaatctctttcctttataaattacccagtctcaggtatgtccttattagcagtgtgagaacagactaatatagtaaattggtaccgatagaatggggtgcttctgaaaagaggccccaaaatgtggaagcgactttggaactgggtaacaggcagaggttggaactgtttggagggctcagaagaatatagaaaaatgtgagaaaatttggaacttcttagagacttggagagctcagaagacaggaagatgtgggaaagattagaacttcctagagacttgttaaatggctttgaccaaaatgctgatagtgatatggacaataaagtccaggttgaggtggtctagaatggagatgaaccacttgttgggaactggagtaaaggtcactcttgctgtgcaaagagactggtggcatttagcccctgccccagaggtctgtggaactttgaacttgagagagattatttagggtatcaggcagaagaaatttctaagcggcaaagtgttcaaaaggaagcagagcataaaagtttggaaaatttgcagcctgacaatgggatagaaaagaaaaacccttgggaggccaagatgggtggattacaaggtcaggagttcaagaccagcctggccaatatggtgaaaacctcatctctatcaaaaatacaaaaaacttaactgggcatggtggcatgcacttgtagtcccagctactcaggaggctgaggcagaagaatcgcttgaaccctggaggtggaggttgcggtgagccaacatcacagtactgcactccagcctgggtgacagagtgagacttcatctcaaaaaaaagaaaaagagaaagaaaaaacccattttctggggagaaattcaagccagcttcagaaatttgcataagtaaccaggagctgaatattaatcaacaagacaacgtggaaaatgtctccagggcatgtcagagaacttcacagcagcacctcccatcacaggcccaggagcctaggaggaaaaaatggtttcctgggctgggcccagggccccctgctatgtgcagcctagggacttggtgccctgcatcccagttgctctagctgtggctaaaaggggccaaggtacagcttgggctatggaaggtacaggccccaagtcttggcagcttccagtggtgttgagcctgcaggtgcacagaagtcaagaactcaggtttggaaacttccacatagatttcagagggtgtatggaaatgcctggatgttcaggcaaaagcttgctgcaggggcagggacctcatggagaacctctgctagggcagtgaaaaagggaaagatgggatcagagaccccacacagagtccccactggggcactacctagtggagctgtgagaagagggccaccgtcctccaggccccagaatggtagatccactcacagcttccaccatgggcctggagaagccacaggcactcaacgccagcctgagaaagcagccaggaagggggctgtaccctgcaaatccacataggcggagctgcccaaggctgtaggagcccatctcttgcatcagtgtgacctgggagtgagacatggagtcaaaggagatcattttggagctttaagatttgactgccccactggatttcagacttgcatggaatctgtagcccctttgttttggccaatttctcccatttggaatggctgtatttacccaatgcctgtacccccattgtatttaggaagtaattaacttgcttttgattttacaggctcagaagagatttgccttgtctcaggtgagactttgaactgtgtacttttgagttaatgctgtgaactgtggacttttgagttaatgctgaaatgagttaagatattgggggaactgttgaaaaggcatgattggtttggaaatatgaggaaatgagatttgggaggagccaggggtggaattatatggtttggctgtgtccccacccaagtctcatcttgaattgtagctcccataattcccatgtgtcataggagggacccagtgggaggtaattgaatcatggtagtgggcctttcccatgctgttctcatgatagtgaataagtctcatgagatctgatggttttataaatgggatgcacacaattcccctgcacatgctccctcttgcctgctgccatgtaagacgtgactttgctcttcctttgctttctgccatgactgtgaggcctccccagccatgtggaactgtgagtcaattaaacctctttccgttataaattacccagtctcaggtatctctctattagcagcatgagaacagactaatacacctaccaacaagctgttgcttcctaacttaagaatcccagcacatgcttccttctcagaccctttcccattcatctgctccttatccccttcctaaaagcacacagtaacccactcatagcattcatcaatgctttctcccctgtcctagccagaatcataaataagtagaatggagctcacctaggaagctgaagaacagcttacagtgttggaaaaaccctaagaaagaagaaatagaataatttgagaagtactagaataatctgtgaaattaatcaagaatgctctgtccctatttagaaggtggcataagaattttcatgtgggtccattctgcttatataacagtttgctgtttcccttggagaagccatgatatctctatttcagtttttttcacttataatatacagtcatctatttttagggctgcttaagataaaatgggaaagtgatgattaacagtatttccagatccttaaaagaaacttagtttaatctattagaaatctcaaagttacatgtgatgttaaggcatatcacatatattagattgggtttatagaatatttgtttcctcttttccttgacatggtctttgatgttctatttctatctttactatgtttgtatatatgcctcttattaaaagtatttaaaattattttggaaggggacaggtgtcaacataaataaagtaaaacttttagataaaggcaaattatcaggggaacaatagccatagagtgtcactgttacaattatagttgcattattggatctgcttgcctgaaaggatttgggttttgttatcttcctagaaaaaaaagaagttgagaaactattaacctttgataacctttacaatattttttcaagtttgccatgtgccaccaagggaacatttccaagcagagcagaaaattcattagacttgagtgtttcaaatatctatatcaaggacaaggacaaaactgctgtcatagagaaaaggctggtgcactagtgcacaataacttcaatttttcttcatctgggtctagtgacccattccgtaaaaatgccaacactgcactatttgatccagaggaactggggtgatgacatcaagataaacgctgtttgttcagaaagtcccatgcacagcaccacaagactacagtcctgataatattcacagtctcattcagtagagtccaaagtgacatctggtttggatgacttttgtggaaattttggctgaagtctttctgtttcccaaaagcaaaaactttaaattaatgggaacagtaaggttaaattaaggtatattttatagtaatcagataatattagacgtttgattaatgaggtgaacaacaactataattgtgatatctttatgtaccaatttagctttgcaaacttttaaaatatacacataaatcactgtttaattattttctaaaaatactttagcccattttatatcacctcctctgtctctgtctcttctcttggcttctgtcacgtgattttgtcctgactttcctcctgtctctctcttctctccctcatgagcctctagtttcctcatgccctggggcctcttctgttctcactccatgtttatcctgggtcttttcatctgattttatgctgatggcttttatgtcaaatcaaacatgccccaaaccgaactcataatctcacctgtttccatgcccgactctcagtttcagggaattgcactgccacctacctgatttccaaagacacaaaccttctaagtgaaaccacattttcaatctctcttttgacttcttgtgatcctatgtgctcacaatctcttggactctttccttcttcccatccttactgccttcaccttggatcaggttctcacccttcccacttggatgcctgtaacagcctcttagccttcccacctaggatacctgttcaggtatcctgctccaaactttgaatcccaaatgtctccctacatagcctctctaaaatagaaatctgattatgccatttccagcttaaacccttcagtaaatcctcgttgattctgggatggtgtgtgtgagtgcatatacgagagagaggaaagaggtggggagaaagagagagagagaaggagaaggagcataggctaggctttggtgtcacactctcttgattcaaatccacacaacaatatgacatcagtcagatcactgaaactctttaacctgagttttttccattgtccagtggggataagaactgtatctaactcatagggcgagttgtgagaatagactgagttaaaacatgcaaagcacttagcccagtgtctggcatatgtttagatgttgattattgttggttattgttacattaccttacaaagtccaaactcctcagcattacacacggtccctccgctcaaccagcctgcacttactgcctcctgacttcacctttgctctggccctcacaccctaagattctgccatgtcctgtggtttctcctacctcttgcagtgaggatgctgctgcgctgtctgaattgccctgccttttccctggccaattccctctcacccttcagggccctaacaagcacatttttctctagaccattttccctgacccacattcctgtctgtagtatgggcttgtgctatgaatttaataattacttcaatcaaaaacttagtgcattctatgtgtcagtcctatggcaaatgagaataaattgatgtctgagaatccagatcttgtcctcagagaggatataggttagagtggaatagcaaatagacaggtgtgtctccaaacttcatggaaatatgtagaagcggtccctcattcagtctttaaaagtctgagaaagctatctggaagaaatggaattttcagaatcttctgagtatgctaatcttgacattcattaatttgttgcccaaagggagaccctcctaagaataaaagagggtgctattaatcattaccctgggcaataagcataaaccaggactgcctaggacaaaaagggtataacatcccccctacttgtagctatgttgtaatgagtatgtctgccaccagtgctataaagtgacaagtctactatggagtgcacttcctgacatagcttagtagatgctaagtaggtgtttgtggttttagaggacagaggtgggacatctgaagacagtcagaaaaccgaagagggctggcaggtctccagagcaagaagaagcctctatccttctgcatcagggcatagcagcatggtggcaggaagaaaaatgagagaggaaaataggcttcctaaacagcagtaaagtgaaatcttcctggtgttgctgatttgtccatataagtctcagcctacatcacctgtacaatgtggtgagggcaaaggagacgaaggtgcacaatgctttctgagcacctcatgttcttcgccactaaggccaacagcaaagctttaattctccagacaatatcaggcttcatcacatggccagacctccctatctttgtaacacaagcaggtatacctgtgacccatgacattcagcaaaattaatggctttctctttttcagctatagggaacagggaacattatgaccacacagggaggaaagcatacctttggaatatggttatctgaaccatccaattggagtggcagcagaataagaacacctgaaacacacagttaagttcagccagtgcttaacataaattgatgcacgggcagaaataagaggagagtcctctcttgcacacatagttgcatatttagtaccccaagggaatgctaataaacatcatattacagaggccagaagaggatcctttgggctctgtttgtgtattatcagaacatagcagtgaatagaatgagctacatgcagttttctattctatttacagccaaaaccgaatatttagaaaccaggggtgacctggtgactgcaatttgcaatgcctgaagggatgcataaatatagatatatgattcaaatcctgcaaagtccatcacaacactatgcaaaaatcacaggcttttagagctaataccatccagcttaaatggagaccctgcctccacataaatcaaagcacatggaagatcctttttcacactttatcttctcagcatctttgggagctaggaagaggaaaacattataaaatttagagagatgaaaaaggatatgaatacacgatataaaaatctcctaagaagaaagaatccaggcagttgaaatgttaattgtctgcctttttataacagagaaaacctgcttttaagatgcatactattgtacttcagaacaatgcaccagtggatctttgcaagctctataaattccaagaattactagggcaagtagaaatgtaaatttatctagctatttcactggtagaatataacaggagcaccaagctgggaatcagccaatctgcattaggacctgtctctgaaactcctaatggaagcaccttgtgctgggcacccgtgggacccaattcctgtatgagagtaacactctgtacttcatcactggtctaagcatcagatgaaattgtatatagaagatttggccattcatggagtattgcacaaatctaaaatactcagcactctttccttttcacttttctttcctatttttaatcctgggactggagggcactgaacaaatgaactgaggaacacagtcctgccttctaaaatttgttctggccattacctctcagcacaccataatctatcaggctgacatgctgcatgacaacctgctaatgtgtagttatatcctgtgcattccactaattgtgcagacattaaatactagatctaattccaaataattgatttctttgctgtatttgagaatattctatgctggaaggcatagagctatctttaaaaagcagaaagtgtgggtggataagaaaattgtattcagtcaaggggacagaagaattctactgcaaataatttctggccactagtaagtttaaaatacaaaatatttaagaagacaagcttaaaatgatgaatataaatcaaatccacctaatataaatttctaaaataaacaataaacagtaaggaaactgatataggtggagttgtctgaaagcacagcttgaaacacaaatttgcgtatatttgatttcttagtggagtgtgcgtcaggaaagatctacaagggagccggagaaaaagacagaaaaaggaaaggggccaagaagggcatgacctgattcagaaaggtctggagcataaagtgtatgcagaggtgggatttctccacgagaaaagcggggtgggcttttccatccccacatccgtctggttcccaagtctgggctcctaaccactactctacattcaatccttaacactcactgtcaacataatgtgaacttatttccaatgtcatctaaggtagaattacttgtgagaaaagactatagtatatttccatttagatgccagcctacatcctttcaccatcttctggtaccctcaccctgatttctctctgggaacaattccctcctccacctcattctctctagttcccatgaagtggactctaccctctgctctagaaatggagcaatcaacccatgcataaactaatcaatacattcacatgtgttagtcaccccttcttaggctctggaaagactcatccaaagagacaaagacaagacatagcccactcatgacacagagtggattgttcttaacttctttcgtttcctaattcccttcttcttttccctcagtccacacaccctggtatttgctctgaaatacatgggtccaggtgacctttactgtcatcatcatcatcatcatcatcatcatcatcatcatcatcaggtgtttataaaaagatagaaattccagtgtacccctaactattttccctgggaaccacaagaacatttaaggatcataaagagcctaggagtcaaaaacagcctactatttgaacaaatttatgtttaaatttttttaattttttatttgcttgtaaagatgggtctcagtatgttgcccagacagattttgaaagcctggccttgagtaatgctcctccctcagtctcccaaaccactagtattgcaggcttaaaccaccacgtccagcctgagcaaatttctatattgtccttttactgctgtaattgtacatatttttgttaccggtgagtttaaaattgtcaagtatttttttattatgtcagggcaaagaatccgtttcttctgtattttacaacacaagactatttcaggtaatagcctttcgctttggcccagggcctgtgtgcatttctctctttggtctcttttatgaggaatagttttataggtttgacatgaaatgaaaatttgctcctcaaaactttaaggtgcaacacaacaggttacagggcagtgtgagctacagagcaaagcagatcctgctctgatttggagatagttgaacagttcagaccggcctaggacagagacacctggtttactgatgacaaatctttaatgacactacaagtacatgataaattcatttcaggattattagagaaatgtgaccaggattaaaataagaaagtacttactcagaaagtgtcatggagtaaattccatgtaaacttgtatggtattctctggacccactgaaaaataagttggaaagagacaaggacaattgagggtacagtttcatactgacattaaatgtggatattcttacaaatgattttcaaacatgttttgttcagacccagagtgtttcacctgctggctcacagagttgggaggctacaactacaaatgccagaaaaaaatttttttaagtaagggggtagcaggggaaggctttgcctctctctcttcacagagtttctgctccataccctaattacttctggtcccaagccatgccaagggccaggccttctaaaacaactccttctgactcccagcttttgtcccttcctctggagataataaagatgaaaataaagcttttattttatttccttcaggttcttgaacattcaaactggcctccccacaagttgaacatgttcttatctggtttcagaaactccactgtgagtgatgaatgtgccccaacagaaacagggttacgtgccctcctgtgtctcagtcttcccaagcaggaaatggacccaggaaataggctcttcagatatggctatactgatctacttttccttcattctttttcctcactaataaaatagtgaggaaaatgtcatagacttatgcatgcatgttccaggcttcacattcacactttttagcccaacagagggagcagtaggatctatagtctctgactctggggggggtgtgtgtgtgtgagagtgtgtgtgtgtgtgtgtgtgtgtgtgtgtgtgttatattgtatatataaaagttgagaaataacactcaaaattgtccttcaaggcaaatggtacaattctttctcaatgatcagtttggagatactggtaaagtttagcatagttttttgtttgtttgtttgtttgtttgttttttggggtttttttggtgatggagtttcgctctttcacccaggttggagtgtgatggcgcgatcttggctcaccacaaactcctcctcccgggttcaagtgattctcccacctcagcctcccgattagctccgattagctgggattacaggcatgcgccaccatgcccggctaatattgtatttttagtagagacggggtttcaccatgttggtcaggctggtctcaaactcctgacctcaggtgattcaccctcctcggcctctcaaagtgctgggattacaggcgtgagccactgtgcccagcaagtttagtatattctaaacaaaaagatacagagatatttggggattcatttctgctataacaacactgatttttgtccacagtggtcataagaagtagagttttgattacatgtatcctccatgctaatttgcagaacagaaataggaagcaattatgtgatcgtcagggcgggggagaaactaatttttttcctcagattatttttaggataaaaatgtgaatgaaaacagcatcctatacttctgattttgatgaattttgactgcccttcccctcaattaggacaaattagtagaagtttattctaattaccttctgttcatctcaattattttaagcatttctattttattgtgatttctaaatcagcatgcttgagttttaatgtaaataccttctcctaaaaatgcaaaatgcattacaatgtagtgagactttaaataaagaaaaatgcagaaatatccatccaaataagttatccttcaaaaaagaatagcacattgtttagcctcaggagactgttccaaagagtaactacaagaaacacttttggaactcattttcccagattacttttggagtctgcttaagagtcaaaccagaaaagaaatctcactctttgtaggcagatcttactttctgacccaaaactgtaatgttagcttgatcttttctgcttttgttacacctgcatttcctcttttcttgactagttacaggcctatcccaccccacctctcccgtcaatcactacctcctgccaattttatctcttaaatattcatcctatttatctttgtttccatggcactagcaaaagtgcctcatctgtcctggactgccattacctcctaacggggctctgtgctctggtgttgtcaccctcaaactcaccctctctatgccatccgagtactccatcgaaaacagaaatctgcatgtattattctcctgattaaaattcttcagtggtacctagtcacatactggctaaaattattaacccaagattcataaactttcttggattggccttccaggagcatctataattcccttgaatctttatacaaaattttgtgtttgcatttatgcaaggaaagactcttccaccagtgtccctgagggaggaaagaataacaaccgaaagttcccaatcaaagccatgctacttaatgtgttacaaagactctcaacattcagtgcttcctcctagcctggtggcttccatgtaggctgaattctctcacgataactcagagctaaaagatcaaatgttccaacaaacaagacaggagctacatggtctttcataaagcacctcagaagtcacagggggtgaagtctgtcatcctctatgggtcagagcacccacaatcccacctagattcaaaaggagggacacagaccccacttctcaatgggaaacagtttaagatcttgtgaacatgtctcaaagctgccatagatcgtgagggagacaggtagaagtagaacacaacaagggtgctgtttttccctcctgtcagagttagatgaaacttctttgtggataggcttgacctagaggggcaaataaggtgatgcttttttccagacttttgataagttatacctgtagactttttgcttaagaactcttttcctcaggtcctgtttttttgttgttgttttgtttttaagaaattaaggtcattaagcagggtgtaaacgtacagtataaatttattaaaaggtaaagggctgatcagaggtattaaaaaatccatgccacatgcagtaaatttttgcttgatataaagtgtcaggaaatgagaccaaaattgcctttgagttgcaatcagtgctgtagagaaaaagcacattttgccttccttactaagatgaaggagtaatgttttcataagaagaaactgtcaaatgtgtattaaataaatgaagcataaaacaagctttcctgcagtttcaagcatgcttggattttaataacaagcatttatttatcccatgaatgaaaagttatatttgtgtccaagaagaaaggctctccactctccgctgggtattttcagcttttaacagtctccattacggatgaagtcactgatttgctctgccatttcacatcacattttgatgttggtgtttatgggagagataagagcctggactaaagaggggagagcaatgggaaaggatccttccagggttggatggagagtgtaagggaatgtggaaacagatagactagaattaagatgggatgcagaagctaaagcccagtagtgtgcactcatcaacattgtgtcagggtctcagggacccctccttgccaaattgtggatttagaaaaggggcaaaggtcatgttggaggacaaatgaggtgggaaacaggagggtttcagagtccccatcctgatagtgttataagatctaatctatgttttatgtaagagaagttgggtacctttgctaagcccaaactgggattcagagactgacagagctggtgacaccctggggcatccatttacatgtatcgttaggtgtgtggttggcaatttttttaagctaaagaattagagaagcatttgggaaactgggagaggagcaaaagtcaataaggagaacctcaaggtgacacgatggcgtctgctcccgtctggcctgagagactgcatggtggcccctgtggagagcaaggtgaatttcaaaagagaaagagttgttttgacaaaagactttgtgaagctcgggacattcgcagtgtggctttagcactcaagcctaggacaggacacacggctctaggcctaggtcccagggcaaccttccccagaaaggccactccaggggactagcagcagggtctgaccatggctggcagagcagctgccagctggagggggctggcaacaggcaccatagcaaggtgacttaatgggtcagaggagaaaagcacgagcagacttgtttctgaggatatggtcacatccctggggactctcagaaaaccaggaaaatccaatgggcaaaacactgaagcgctgctatcacacagatggacccaaagacccttgtcatctggctattaatgttaatgtgacctcacttctcctctcaggcagggtgagtttgcattgagattgcattagaaaatgattaataattgaaacattaccaaggtcattatcctattaagtaatgtgaatctaaggccgcttagaaattagaaatgaatgaatccaataagaattgctgaataattagactaggggcataattttggaatataaaaaggaacccaaatctatactttagccaaggttccaatccttctcattcctcagagagaaatggacaggaaatgacttaagaaaataagccatcatatttacattttgtatgtccccagacatctttgaggagatttcttcaaaggagacaagatgtgttctgccatttttaggagtggagtgtgggtgaccccagcagattgtttaccatccacctactgaacagcaggaaagatcagctctattcaccaggcgaagctatctatcacttattgtaggaatgacgaagggaattttggaaccctccattgttgttagatcctccctttgctcatacataaacacacacacacacacacacacacacacacacacacaaataagaacaaaacatttttgaccacagaaaagtaacagagggacaaagcatcttggtcacataacagaagactaagactgaaaaaagctttacagcatcttatccatttacctcctgtacccactaagatattgttgatgtaggcctttggcatccacagttttcaatttcatctcatgtaaagatcagtgccaaccactgaagatatggaggcagcaatattctgagctacttcagaaccaacaacttaattgaaacatcaaaccaaggccctcacacaatatttatggctatagtttggtttaatgccttatataattggtactgacatacacaagatttccatcaagtctttatatcctttcacagaggagtctactattctacatatgaagtaagcagcaaaaagcatattcaatcttataaaaccttttaaaccataacagtattatatgtcattatgtgtgtgataaaaacagaattataaatcatggtacaaaatagcacaaaatttgtaccatgatttataattttgttttcttcctcatcttatccaaaaagctgagaagtcataattctgccacctgcttttggataactagttggccttattccttttctactaactcttttctaaacatttgcatttgcatttgtaaatctaggaaaacagagagctttttttatttttaaggagcagcttccactttcattttgagaagctctgaaatccagtaaatccagttacgcattgcaatataccctggggtatgagtgcagataacttttcaaaatgacccccagcccaggaacagcttctatctttgcccctagagtgatcatctccttgcataccaggagaatagtcctctcttatccccatagaacctcgtgacaccataaaaagtaaacaaattataaaaaatggtaatttctagacatgaattatacaaatgaatgtatctgtagttatttagccactcttttcaaaattctaatgtaagcaatgctttcatacttcaaagtgtttaaaaagagtgttttaacctgaaatatcattttactccacaattgaattctagttgaaaataattatatttttagctgcaagtgttttgagtcatgggccaactaaagatttctggttatataattgaaaattatgtggttcatctatatgtttattgacttggattgactgagtcctgggggaaactgtgccgtttcattgctgatcaaattcacattgcaagccacatgtccagaatgctcactgtggccattgaaatgaatggaaattgtgagccagtttattttctaagaggccaaattggtagtctcctttagtttactgaacctaagttttaatagtaagtaaattttttaataaaattctttatgtatgtttatctttaaatatgatgtcttttttattattctgacccccaaagattatacaagatgcattaaaacttgaaataatgtctgaaaatgtgagaaagtaggcaagaataagccagagaaatttttaattaaactccaccttttttttcatttatggcataaagagtcaatatgtgaaatagagaatattaggaagatcagcaactccttagaatactgtaagagtcaccaaggctacaagcattaagtactgtatcttggtttagagaagatgatcaactacacattttgaaaaatgcattcacaaatgaaaacataaagaatgttttcctgataccaaataaagaatggttttagtacactttaccttatagcctcattaatttaaaatttagctaagtttagaatataaaaattgctatagaaaagtaaactagtctaccatatgagtaaaaaggaaagcatatttattaccttatttaacagatttaacataaaatagaaaattgatttccattaaatattcagaaaagtcatgtatttctatggcctgtagaaaaaaaaatcttcagtaagaacctgttgcttcatgatcatattaattttaaaaggcatctcatggataacaggtttgtattagtagcaaaattcaaagcctgatttgtgatattgtgagcaatattcataaagtacattaatatgttaaaagttacatggacacagagccacattaaaacacacctgcaatgtgttaacattttcagggaaacaaaaatagcaagaatattttgcaagaaaacaaacaatgtgaagataaacaagtgggagattgtaggcaatagaacctatggctaaagtttcaagtaattaatattatattttaagcgaaagactggtagaacatgctcaaaataataaactactctttttcatttcctctaatgaaaaaacaatgtgacacattaaaatcttttatctgtaatgaatgagggaaactgtcatccttgttaacttcagtacaacactgcacaatagttaactcctgttttggtggtggagtatgaatttcaatccacaaactcagttgtgcataatacatcacaatttaaattttccttagggccacttatttccaacagaatagagaaatggtgttcataatataatttcatctatataaaacggtgttcaaaataaaatattatttaaatctttttaaaagttaattggccaattaaacaaaaataataataatacaatgtgggatttaaaacgtgtaaaagtaaaatgtatgataacaaagacataggctgggggaagagaaatagagccatactctcaaaagttttttatagtatatgtgaagtgacataatatcgcaacataaattgcaataaaagaaaggtatatgccataaaccattatgataacaaagaaaccacttaaaatgaagaaacaaggagtttttttatgtcaaaaaggacaataaatgaaattatgaaaaatattcggttaatcaaaaagaagacaaaaaatggggaaaggaaacaacaggtgagacaaatagaagagaaagaggaagatgatagatttcaacctaaacacatgaataatcatattgaaagtaagtgatctaaataatccagttgacatgcaagatgcaagtatatgttacctataagaaaactattttaagcataaagacacaaatagtttaaaagtaaaaagatagaaaaagttataaatactagtatttagataatacaaatccaaataaagctggagtgactatagtaatatcaagacaaaatagatgacagagtgaagaacattattagggataataaaagtcatttcatagcaataataaagttaattcatcaagaacaacaacaacaacaaaaaagcctgaacatttatgcacctattaagagagctacggaaacatgttgcaaaaaactgacagaatagcaggaagaaataaacaaatccagaattatagtcatagatttcaatacccctctttcagtaattgatacatcaaggagacataaaatcaataagcatataggagatttgaataacactatcaaccaacttgacctaataaatatttatagaacactgtacccaacaggaatggaatacacatccttttcaaatacacatggaacatttaccaagatagaccatattctaagccattaaaatgtcacaataaatttaaaagaattcaagtcatacaaagtgtattctctgaccacaatggaattaaattggaaattaataaccgaaggatctccaaaaaattccccaaatatttggaaactaagttatatacttctatataacatataggtcaaaaaataaaagagaaattaaaaaatattttgaactgaatgaaaataagaacatgatgtattcttatatttgtagtagtctgctaaagcaataggtaggaatagatttatagtactaaacacctatattagaaaaaagtcacaaatcagttatctcagtttccaccttaaataaccaggaaagaagagcaaattaaatccaaagtaagcagaagaattaaaataataaagactaaagagaaatcaatgaaatataaaacagtaaaacaataaagaaaatcaatgaaaccaaaagttagttctttcaacagattaataaaattgataagcctctagccagacttactaggaaaaaagagaaatgatacaaacactttaacattattaataattatggaaatgcaaaataaaaccaaaggaagataccactacacacctattatcatgactaaacttcaaaagactgaccataacaagtgttggtgaggacatgaagtaaatggaactcaacactgcttccaggaatagaaaatggtacagccactttggaaaacagtttggcagtttattgaaagattagacatacctactatatgatctagttattccacttctaggaatattcccaggagaaataaaagcacacatccacacaaagattagtacacaaagtttatggcagtttcatttgtaatagccccaaactgcgaacaacccaaacgtccatcaacaggtgaatggataatcaattgcagtaaattcatgcaaatagaatactactctgcaatttaaaaataatgaaccattgatacacgctatagcatggatgaatctcaaaatagttatattgaatggaagaagacagaccccccaaaaaatgtatactgtataattctatgtatatatagttgtagaaaatgccaactaatctacagtgacagaaagcagatcagtcattgcctgttggaaggaaatgagaagagattacaaagagacatgaggaaactttgacaaataatggataggtccattttcagtgatggctgcacggagataaacacaagtcaaaacctatcaaactgtacacttaaaatatgtgcaatcaattatatgtcaattacacaacaattaagctgttttaaaactcacgggcaaatatgagtaaatacataaacacagtaaataaaaagtttatttcttaacggtcattcacaccaatcaagacaggagatactaatttatttaggtctttgtaggaacatcagtaaaggtacagaagatccatttgaatttatgttattatatgtctaaaataacctaagatacactgcatgggttttgtataaactcgttaagaaaacaagattattgtgtttctgacaatttgtaataaaaactcaatttagaatttttcttgcccaatatctctaacactgtatctatggtggttctagttttgagattcattgtgcacagtgtaagttttggtgccctttgtctcatgttttacacaatcaaatgagaatatgtttgtatgacttgggacctttctatttgcagttcagattaaataagactgagaatttctgactacttataaccaacacttgcagaagtaatgcttacaattggtaaagtgttctttggggaactgcactcgataaatgttacaatcctagtttgttgcagcttcagttgtaattccactctgaaattcagtgggtgaaaaatgggaaaagatcaggctgctagagagagggataaagtaaggcacatatgattctaggatttttattacaaaacaaaaaattacatgagagagtgtctttatattattttctgaattctgcccactttcctggagaaaaacctaaattcctctcccagtcttgtaatctcttcatctgcataaagcctacaccttcaaaacaattcctagactgaagtaattaaatcaagtaccatcttagcatgcaaactctttgaaatatataatacacttagacagattcaggtttatgttccccaagtgcttcataaagcattaccaagactaagttctcagttgttcaataaattggattggtgtctactatggttatgcatatctttttgtgtatatcaacatttgaaatgttgtactgttatttataaatatcctttgtttcaaaaaagttttcaaaactgtcacttcagttatgtgtttttatcgatttgcttgatctgcataagggtgttctctgtttcatatccatttgtatatagttatctcttttgcctctgaacattgaaacagaaacagtgttgtggtgaagagccctagcgcagcctcaccacgctagcctcagccttgggcaacattccacctcttctgcgtgattcctcaaaccgtgtgcatagggaggttgttcacagggttgttgtgaggatcgatcaaggtaattaggtatagatttttatcctttagaccagcacatagtgagcagtccaaaaaaaaaaaaataaacaagagcacctttgaactgcaaaaatatttagggcagggcctaccaagtggttataattatcttattacatgactgaaatgcatcctagcaggagtggaatacttgaaaattattatttaatcaaaattaatatttcttaggcagagaaggcctaaaaagaatagtataaaatgaaaagacttagtttaaatttcaactttggcacattaaacaactaattctggtttcttattttattctaacctgccgatctgtagtttgtaaattggacatgacctgttcatagtagatgcttagtgaatgcgtactgagagattactcaaagatattgtctacaaaagcattttcaatacttttatatgtctgatagtataagatccctttagtttcaggaaaaaccataaaattgagtgatatttctcactttatgggtcattattactcatgtagtaatatttctcactagtgataaacaagtggagcaaatgtgactctgcagggcaattgttgcattaaaacctgaactgcaaatatttaatgctcacaagaatttttctccctccccatccatgtccacttcagtgagagacccaatgagaaccctatatccacttacagaaaaccagtgctgaaaagttccacacagctgaccactaaaacatatcttgaattttacttttttcccaaggaaaatgccattgtctgtaacgttcatagtcctttaaagattattttgttcatttcacaggtctcctgttatggctggaggtctctttgctgtggatcggaaatggttttgggaattgggtggctatgatccaggtttagaaatctggggaggagaacagtatgaaatctcttttaaggtaagccccaagaccctcttcacactatatctgtataattttgacaattctgatagaatatcagcatgttgctctgtgacctgtgttctgggatgacttaatggtaatagatgtatcaccttcccaagtgagctcttgtagtttctttcttttttggtttttgtttttattttttcttgatatacaatcattatacatatttgtggggtacatgtgaaattttgaaacatgtatacaatgcataatgatcaaatcagggtaactgggatatccatcacctcaaacattcatctcttctttgtgttggaaacattgcaattcttctcctctagctatcttgaaatatacaataaattattgtgaactataatctccctacttgtataaggccatttttgcattgctataaagaaatatctgagactgggtaatttacaaagaaaagaagtttaattggctcacagttctgcaggctgcacaagaagtgtggtgctggcatctgcttctggtaagggcttcaggaagcttttaatcattgtggaaggcaacagggagccagcatgtcacatggtgaaagcaaaagcaagagacgcaggggtgagctgccacacacttttaaacaaccagatctcacgagaactcactcaccagcaaggggatggcgctaagcctaattcttgaggaatccattccccatgatccaaacacctcccaccaggcctcacctccaacactgggggccacattttgacataagatttggaggtgacaaacaaccaaattatatcactacagtactatcaaatactagaacttatctcttccatttaactgtatttttgtactcattaaccaacttctttttttgccgcctccccacccccactcccttctattcccagcctctggtaaccaccaatctaccttctacctccattagaccaacttgtttagctccccatatgagctaggacatgggatgtttttctatgcctgatttatttcacttaaaataatgaccttcagttccatctatgttcctgcaaatgatagtatttcattcctttttatgactgcataatattccattgtgtatatatactacattttctttatccattcatccagtgatggacacttaggtaactattgagaccattgtcacaaaaaaatgggaatgcagatatcacttctacatactgagtccctttcttttgaaaatatacccaacattaggattactagattatatggtagttctattttagtattttgaggacgctccatactctttcccctaattgctacattattttgcatttccaccaacagtgtaggagcattcccctttctctgcatccttgccaggatttttaaattttttgtctttgagataatagccagtttaacttgggtaagatataacctcaatgtggttttgatttgcatttctctgataactaaagatgttcaacatttttcatatacctgttggccatttgtatgtcttcttttgagaaatgtctattcatgtattatgctcatttttaaattgaattatttgaaggattttactgttgagttgtttgagttcattatatattctggttattatttctttgtcagatagatagtttgcaaacattttctcccatcctacaggttgtctcttcactttgttgattgtttccttgctctacagaaactttctagcttgatgtaaatttgtctatttttgcttttgttccatgtgcttttgagatcttagccaaaaaatacctgtgcccagaccaatgtcctgtagtgtttccccagcattttcttctagtagtttcatagttttgggtcacatagctaagtctttaatctattttcagttgatttttgtacatgatgaaagacaaagatctaatttcatttttcttcacatggatatctcattttcccagcatcatttattgaagaaactgtccttttccccactgtatgttcttgatgcctttttgtcaagaatgagttggctgtaagtgcaaggatttacttctgggttctctattttgttccattggtgtatgcatctgtttttatgccagtaccatgctattttgattacaatagctttgtggtataatttgaaatcaagtaatgggatgactccagctttgttctttttgttcaggactgctttagctatttagggccttttcttgttccctacaaatttttggatattttttccgtttctgtgaagaatgtcattggtaatttgacatggattacattaattatttagatcatttctggtagtgtagatattttaacagtattagttcttccaatcaaagaccatggtatatctttccatcttttgtgtgtcttcagtttctttcatcattgatttgtacaggttatttcacttctttagttaaatttattcttaggtatttttaagctattataaatgggattgttttcttgattgcttttcagattgatttctgttagtgtatagcaactttatagaattaatttatcagttccaggaacttttggtggagtctttaggtttttctaaaagtaagatcatgtcatctgcaaagataatttgacttcttccattacaattttgatgccctttgtttctttatcttccctaagcactcaggctaggacttccagaactaggttgaataaaagtgatgaaagtgagcatccttgtcttcttctaaatcttagtggaaaggctttcaattttccccctttcagtgtgatcttacatgtgggtttgtaatatatggctgttatcatattgagatattttctttctatatccaatttgttaagagtttttatcatgaaggaatgttaaattttaccaatactttttcagcatgtatcaaaatgatcctatgctttttgtccttgattctcttgttgtgatatatcacacttattgatttgtatacgttgaaccatctttgcatctttgggatgaagcccacttgattatggtgaatgttctttttaatgtcttattgaattatgttttgtcgagggtttttacatctatgtttatgaggaatgttggcctatagatttttttgtgtgtgtacctgtctagtttagctatcaggataatactggcattatagaatgagtttggaagaattccctcctcttcaattttttgaaatagtttcagtagaattggtattagttcttccttaaaagtttggtagaaatcagtaattaatccatcaagtgttgggcttttctttgatgggagactattactgctttgatttcattattccttattgatctcttcaggttttctttttcttcatggttcaatcttcataggttgtgtatttacaagaatttatctacttcttctaggtttccaatattttggtgtacagttgttcaaaatggtctctaacaatcctttgtatttctgaggtctcagttgttgtgtctcctttttcatttctgattttatttatttgagtcttctctcttccattcttagtctggctaaagagttgttacatttgtttatctgtttaaaaaattggctggacgcggtggctcacgactataatcccagcactttgggaggccaaggctggcggatcacaaggtcaggagttcgagaccagcctcatgaacatggtgaaaccctgtctctactaaacatacaaaattagttgggcgtggtggcgcatgcctgtaatcccagctactggggaggctgagacaggagaattgcttgaacccgggaggcagaagttgtagtgagccgagattgcaccattgcactccagcctgggcaacaagagcaaaaaactccatctcaaaaaaaaaaaatcaattttacagttcattgatcttttgtattattttattagtctctatttttaagttcaacttttattttagattcagggggtacacgtgcaggattgttacaagcaaatattgtgtgctgctgcagtttgggttataattgaatgcatcacccacatagtgagcatggtacacaacaggtagttctttagccattgaccccctactccctaccccctcttgtagtgatcagtgacttttgttgtcatatttatgtccatgtgtactcaatgcttatcctcctcttataagtgaaaacatgtggtatttgattttctgttactgcattaacatgcttaggataatggcctctagctgcatccatgttgctgcaaaggaaatgattttgttcactttttatggcagtgaagtattccatggtgtatatgtaccacattatcataattcagtccaccattgatgggcacataggttgattccatgtatttgttatcatgaatagtgctgcaatgaacatatgagtgcatatgtctttttggtaaaatggtttattttcctttggacatgtacctagtaatgagattgctaggttctatttttagaaccagcaaccaaccccagcatggtagttctatttttatttctttgaggagtctccaaactgttttccccagtggctgaactaatttacattcccaccaacagtgtataagtgttcttttttctctgcagccctgccaacatattatattttaaccttttatttatttatttatttatttatttatttatttatttatttttgagatcgagtctcactctgttgcccaggctggagtgctgtggtgcaatctcagctcactgcaatctccgcctcctaggttcaagtaattatcctgcctcagcctcccatgtagctgggactacaggcacctgccaccatgcctggctaatttttgtattttttgtagagacggggtttccccatgttggccaggctagttttgaactcctgaccacaggtgatctgcctgcctcggcctcccaaagtgctaggattgtaggcatgagccactgcacccggcctctatttttactttttaataatagcaattctgaccggtgtgagatggtatctcattgtagttttgatttgcatttatcttacaattggtgatgttgagcatgtatcaatatgtttcttggccacttgtatgtcttcttttgagatgagtcctttgcccacattttagcagggttgtttttcacttgttgattcatttaggttccttatggattcgagatattagacctttgtcacatacatagtttgcaaatattttctcccattctgtgggttgtttgtgtactctgttgatagtttcttttgctgtgaagaagctcttaagtttaataggccccacttgtcaatgtttggttttgttgcaattgcttttgagatcttagtcataaattctttgccaaggccaatgtccagaaaagcatttcctagattttcttccataatttttatagcttaaggtcttacatttaagtctttaatctatctcgagttaacttttgtatatggtgagaagtaggagtccagtttcattcttctgcatatagatatccagttatcccagcactatttattgaataggaagtccttttcctattgcttatttttgtcaagtggatatccagttatcccagtgctatttattgaatatggagttctcttctcattgcttatttttgtcaactttgtagaagatcagttcattgtaggcgtgctaccttatttctgggttctccagtctgttcccacgctctatgtgtctgttttcgtaccagtaccctcctgttttgattactgtagtcttgtagtacagtttgaatttaggtaatgtggtacctccggctctgttctttttgcttaggattgccttggctatctgggctcttttgttgcttccatatgaatttgagaatagtttttttctaattctgtgaaaaacgacattggtaatttgacagaaatagcgttgaatctatagatagttttggatagtatgactattataacaatatctgttcttccaatccatgagcatggaaattttttttttcatttttatgtcatctatgatttctttcatcagtgttttgtagttcttcttgtagagattttttacatccttggttagtgtggtcctacatttgcttttgtgtgtgtggctatcgtaagtgagattgcattattgattcaactctcagcttgaatgttatcggtgtataaaaatactactaaattttgtacattgattttgtatactgaaactttactgaagccatttatcaggtctgtaagccatttggcagagtctgcggggttttctaagcatagaatcatatcattagtgaagagcgataatttaacttcttttcctatttggatgatttatatttctttcttttgcccaaatgctctaagtaggactaccagtactatgtcaaataggagtggtgaggatgggcatccttgttttgttccagttcttaatgaaaatgcttccagcttttgcccattcagtatgatgttggctatgggtttatcacagatgtcttttattattttgatatatatttttaatgcctagtttgttgagggtttttatcatgaaaggataatgggatttatcaaaagcattttctacatctattaagatgattatatgggctttgtttttaattctgtttatgtggtgaatcatgtttattgatttgcatatgttgaaccagccttacatccgaggaatgaagacttcttgatcatggtgaattagcgttttgatgtgctgctgaatttggtttgcttttattttattgagggtttttgtgtctatgttcatcagagtgactagcctgtagttttcttttttcattgtgtctttgtcagattttgacatcagggtgatactagtttcatggaatgagttagagaggagtccttccttgttgattttttggaataattttagtagaattggtagcagctcttcgttgtatggttggtaaaatttggctgtgaatccatctggtccggcctttttttgtttgctggtttttcattactgattaaatatcagaactcgatattcgtctattcagtatctcaatttcttcctgactcaatcttgggagtctgtgtacttccaggaatttatccatgtcctctagattttctagcttgtatgcacagaggtgttcataacagtctctaaggtcttttttatgtctgtggaatccattgtaatgccttctttgtcatttctgattatgcttacttggatcttctctctttttttctttattaatcttgctagcggtctattgatcttgtttatcctttcaaagaaacaactttttattttgttgatcctttgtattgatttttgagtctcaatttcatttaattctgctctgatttcattatttatttttttctgctaattttggggttggagtgtttttgtttttctagttcctctaagtgtaatgttagattgttaatttaatgtaggtattcagagctataagctttctttttaatactgcttgtgctgcgtcccagagattttgatatgttctgtttctgtttccatttactccaaagtcattcaggagcaagttgtttaggttccatgtaattgtgtggttttgagggatactcttagtgttgatttttatttttattccactgtagtctaagaatatgctttgcatgaatttgatttttttgaatttattgagacttgctttatggctaggcatgtggttgaggttagtgtatgttccgtgtgccaaggagagggatgtatattctgtggctgttaagtggggtattctgtagatgtctactttgtccagttggtcaagtgttggatttaagtccagaatttctttgttagttttctgcctcaatgacctgtctaacactgcccatggggttttgaatagtccctattattgtgtggctgtctgagtcttttcataaatctagaagtacctgttttatgatctgggtgcttcaatgtttggtgcatatagatttataataattgtcttgttgttgaattcaaccatttgtcattatgtaatgaccttctttgcctgtttttactgtttttggtttaaaatctgttttatctgaagaatagtgacctctgctcttttttgtttaccatttgcataatagatctttctccattcctttcctttgagcctatgggtgtcattacatgggagattggtctcttgaagacagcagaaggttgggccttttttttttttaatccaacttgccactctgtgctttttaagtgaggcatttagaccaatatgcgaggttttgattctgtcatggtgtcaatggctggttgtttcatggtctcaattgtgtagttgttttatagggtctatagactacatacttgcatatgtttttgtggtatctggtatcgatttttcatttccttgtttagagctccctttaacatcttttgtaaggcaggtctagtagtagcaaattacctctctggaaaagattttatttctccttcacttttgaagcttagcttgaggggatataaaattcttggttggaatttttttatttaagaatgctaaaaatatgcctccaatctctgacttataatgtttctgctgttagcctgatggggttcccctcataagtgacataaccctttactctagctgcctttaagatttatttatttgcattgaccttgtaaagtctgatgactatatgtcctggggatggtcatcttgtatagtatcttgcaggagttctctgagtttctcaaatttacatttcaacctctctagcaagactggaaattttttatagattatattctcaaatatgtcttccaaattgcctattctttcttcttctctctcgggaataccaaggagtcataggctttgtctctttatgtaatcccatatttattgctggttttgttcatatttttgattcttttttatttttgtctgactgggtctttgagcctttacattctttcctcagcttactctagtcttttgttaagacttccaacagtatttgaaattttcatagtgaatttttcaattccggaagttcagtttggttttcttaatatggccatgtcattgttcaagtcttaaattgtttttctggcttccgtgcattggctttcaattttctcttgaatttcattgagcttgcttgccatccaaattctggattttattgttgagcttccttgccatccagaccctgaattctatgtctgttatttcagacatttcaatgtggttaggatccattgctggggagctagtgcaatcctttggatgtaaagaaatgctctgactttttgaattgcctgagcccttctcatatgaggaggctggcaattctttttcctttttaaattgctctactatggatgaggccttttgtttttatatattccttttcccttgagggtttgactgtggtgtatgttgtgtatagttgattgtcttcatttctgagtgctttcaaagggccagggctctgtatgggctacttacttgtggatagtttcctgctttgggtttcacaggtgttgggtgttgaagaaattttttctttagtggtgtaattcaggatgcgaaccagtagacggcgcttaagagtaagggccagcagataggctcttagccaagctcctcttggagcttactgttgtcggctttgttcatatttttaattctttttttttttttttttaactgctgcatatgcccttacacctttttttgttgttgttactgactgctgcatatgccatatgcccttactcttaagtggtctggagatgggagatggggggcaagagatgactccctcaccaactccattcctaggtcttggtagagcccttttcaattattggtgttgcctccatgatttcttagtctcaagcgaaacgctggcaaactgctttccctcctccctcaggggcagcccaaggcaaggtttacatcaccaggaaatccacaattatttggggacctactggtcctctgagcttggcagagtcagaacaggttgtggtgtgtgtctgcaggtggtctggtgatgcagtgggtcaagggcagaggatgcccaggcaggacagtaataccatacatgtggcacccacggcctgctgttcttatcccagcagatggctgtggggccaagccagctcacacttacccaacccagtaagtctttctgcagcgtctgccccaggagtgggcctgaccagctaggcttgtcccaaaccttctgtgccaagattgctgggcagttccaggtgttccacgctgtagggatccctgaggaagaaggtgctactggctaataggccacacccttcccaaaacagtgttgttgagagaggggcacccagctcccacgccagcacacaaacctgtgtatcactcttctaagtgttctgagagtggcggggggggggtcttccccttctcaaactcaagccaaagatctcagctccaaacccctggacagtgtgctcgaatcctgggagttttgggaccacacctacagttttgtctgctgacccctcagggtccagtgctggctgtgcagaaggagccaaactactcccaggcaaccagcaaaacactcaggcaggacaatgaaagctgtgctgtaggtaccttcctgagggagtgaccaggcaggcagtcttgggaagatctggtggacaagggggcacaaagatcagatgcacccccgtcccacggaagaaatagccaagccctgctctctcccagcctggcagaaagcaggagctgttgtcactcagaacaagatggagagcctggggggaagggtacctatggtcacattttgttgcagctgcagtgtgcacggcaaaaccttctgggatccatgcaggtttgagctcttcctctgccttatctccaggcagttccctctgccaattcaaatgtctctgaaggtcataggatctcatgtatctaggatcccagatgtccacagtgggagtgtggagtcccggagctccttcactcgccccttccttaggacctagtcaggtttgggagctggtcctcagcattcaccaactccaggcaagcttcccagcttcttccctcttcaaatatggtgtatatgtcacctatcaactttcagtattttctttcagaagatctgttcaaagtgtgatggtttactcaatattttgtttcctctcagtgggagaggtgtctcagctatgtctaattaactatcttagttcagtcactgttttattgtctcagtttcatatatttatgttctgatctttattatttcttttattttgctaattttggggattggtttgttcttgcttttcttgaggtgtatcactaggttctttatttgaagtatttgaagtttgtctattttttatgtaggcatttattgctatataaacttccctcttagtactgcttttgctgtatcccatatattctggtgtgttgtgtttccaattttgtttcaagaaatacttcaatttccttcttaacttcttcattgacccattcgtcattcagggcatattgtttccatgtactggtacagtttacaaagttttgctttttattgattctggctttattctattttggtcagacatgatttcaacattttttaatttgttgagacttgttttgcggcctaacatatagtttattctggagaatattacatgtgctgatgaaaataatctgtattgcatattaattggatgaaatgttctgtaaatgtctgttaggtccatttgttctagtgtatagttcaattatgatgtctctttgataattttctgcctaaatgatctgcccattgctgacaatggggtgttgaagtattctactattattgtattgcattctatctgtccctttagatctgttaatacttgctttatatgtctgggtgttttggtattggtattgggtgcacatgtatttataattgttatatcctcttgctgaattgatctctttatcattatataatgatcttgttttttttacagtttttttttttttacttaaagtctcttttgtgtgacatcagtatagctactctagctctctttttatttctatttgcgtgagtggaataaatttttttcatcccatcaccttcagtatatgggtatctttatagataaagtgagtttcttataggcagcatatagttaggtcttgtttgtttaattcattcagtcactgtgtcttttaattggagaatttaataaatttacattcaatgctattatggataagtaagaatttactagtatcattttgttacttgttttctagttgctttgtagctcttcttttcccttcttccatttttcctgtctttgtggttaagtgatttgctctgatagtatttttcatttgttgctttttactttagtgtatatattatacacttttcatttttagtgtttttgttatatatatatatatatattttttttttgctttcagcactctgaatctatggttccactccctgcaggcctgtaaggtttctgctaagaagcctgctgtcaggcatattagaactcccttaaatgttatttgcttattttctctcattgctttcagaaattttctttgccttttacctttgtgagtttgattataatatgttttagggtattcttgtttgggttgaataaaattggagacttttcactttcttctgtgtgggtatttatatctttctcaaggtttggaaagctctttgttattagttctttaaacaaactttatgttcatttgtccatgtcagttccctctttaactccaataaactgaatatttgcccttttgatgttgtcccatagatcccataagctttcttcatttctttgtattctttttcttttttctcttctgtccgtatattttcaaatagtctatcttcaagctcactgattcttttgtttgatcagttctgctattgatgctttctcttgcatttttcatttcatgcattgtatttgtcagccccaggatttctctgtgatttttattattatttcaatctctccgttaaatttctctgataaatttttggattaactatctgtatttcctttaggttcgttgacttcctcaagacagctattttgaattctttgtctgagaggtcacacatctccctcattttagggttgacctctggtaccttactttgtttgtttggtcatgtcatatatcccttcatcttcttgatgcttgtggatatggaacaatgtctacacattgagggattaggtatttattttagtcttctttgcccagttttgtttgtgcctgttcattttccaagggcttttcagagattctaagcaaactgactattatgtttcctgagtccagctataatcactgcagccatttcagcagtaaataaccccctaagcccaggcattctacaagtctttaaaggactctcaggttgatgtggtttctcagtccagacagacctggggaatgcccaaagaagatacttgtgtggaaactccgtacagggctgtgtggaaactctggacaggggttcaagcctagaagactgtcccagtggcccagacaagcatgtctcccagcagatccctgcacaggcaggatggatcctcaattgcaacaaggagaacttggattgagactgggatccctcaggatctgctatgggcaggaaaattgagtcacattggctcaaactgtacatgtttcctagcaggtccctccacagataggatagttccctgactgtagcaggaggggtcaaagctgatactaggccctcttgcaatttggcatcagagactggaaaccccagtctcagctcagagggtgcaggtaacacagcaagttcctgcacagataggacagtttcctgattgccgcaggagagctgggagctgatactgggcctcctagagatctgctgtgggacagtggctagcatgcctgtcaaaatggctcagatgggcccacctctcccagcaggtccctgcacagatgagataattccccaactgcagcaagaggcactggagctgagaataggccttcttgggaatcttctgtgtgacagaggctagaaccatctccttggttcagaaaggcaaacatctcccagcaggtctcagcacatacaggatagttccccaactacagtgggaggggtgaaagctgagactgagccccctcggggagctgctatgggtagaggctggaaagcctggtctcattggctaagagggacgtgtgtctttcagcaaatctctgcacagacaggatagtcctctgattgcaacaggagggtttagagctgggagtaggccctctagagacctgctgtgggacagagactggagagtctattaggcaggctcagactctcaggctgcaagatatgggcaattcgccctctgggcccttgtgagagccactctgagctaggacctcagctgagagaggctggagcaacaccatggcaattttcggattcactgcctaaactgatgtcagtgggcagatgagcctttcacccaataagctaacgtgcgagggtccttccaaaccccttggcagatggttttttattataggctcaaagaaaaatggggctataaccaagttccttgggggacaggtctgtttccatgcttgaacttggaagcaagattgatgggacaaaacacgtacgttggtgttggtccacactatcaaaacaaacctcctaggtcttgagctccattgaggtttcacagactcctacctgaatgttgaggcttcttcagagagacttttgactgtggatgggtgcagaatatttgtttttgtagggggatgtgagcaggttgccttctattttgccattttggtgatgttgctcctcccaagtaagtttttgaatgagagaaactacttccttccaatctttcagtgagatgtagccatgccatatgcaaaaagaaataattcaagctttcatttgcagggaggaaacttggtattctaatagatctactgttccactaacaagtgcgttccttctaaagcacctaaaacatacagatagaagaattaagacaaattaattaaaatgaaagaaatcaagttattgcagctttttatgtttgtattttttctagaaagagtaggccagattttgatcttaagcaattatttcaaaattgcaataacagaagaggaaacttaaaaatacaaataacagtgtacagctcttcttcatatgtctcatatgaacaatttttttattatttttatctgaaattgcccagttctctacttactttgatcagtaaaagtatatactttattacacacacacacacacacacacacacacacacacgtataagataaaatatcaaatttcagagcttataaataaaaataattacgataacatatgaagatgctaaccaaaagaaaataaagagcaaaaggttatactccaaactatcaagatggtatttaaaaaaaaaaaaaagatctcataaaataaaacttttttctctttttccttcattacagtcattatttattagaaatgtaggtggattcttgcaacatttcccatacagaaatctcttaagtaaatcagctgtttctaattacttctattataaaatctaaccagttattgctgagggaaaaaaatgcattctgaatatagtacaagtcaaatgtaagaatacagctaacttttaaaatgtatgcataaaaagcaaatgataaaactgattttattaaactgtaacagctatattcaaataagggaggagaacatccctcatattatcttatgcccaatttctgcctcaaagaaaaagtaggtgttaaagaaaagacagaagtcaaatcagtagtcagacagcccggcgctgcattccaggcctggtagttaaacatcaacccctgacctaaccagttatgttatctatagattccagacattgtatggaaaagcactgtgaaaatccctgtcctgttctgttcccttcagattactggtgcatgcagcccccagtcacatagccactgcttgcccaattgatcatgaccctctcaggcagacccctctagagttgtaagcccttaaaagggacaggaatagctcattcagggagcttggtttttggagacgtgagtccaccagtgctcccagctgaataaagcctttccttccacaactcagtgtctgaggggttcttgtctgtggctcgtcctgctacacaacgtgttaagagaaatgttatgttgtcttcaaagtgtcataaaataagtgtcaccaaagagaaactcaggaagcataattgtaggcttcagaacatctagaaatttccctctcactatggtggcagtaatccctgaaataccatctattaaattagtgcttgttttccccatcactcaaacgtatctaacgtcaatctaaggcacttttaagacctttttgtagatgcatttttagaaatctttgaatttactaacgtcttttgggttcttctgttgttatatcaatagttgtacactttgttacagtgtgtgtggcaggaggtagtactgatagtactaataactatagaaatagcatctactacctttacttggtagtgttaccagaaaggggtcctgatccataccccaagagaaggttcttggatcttgctcaagaaagacttcaaggcaaacccgtagagtacagtgaaagcaagtttattaagaaagtaaaggaataaaagaatggctactccataggcagagcagccccaaggtctgctggttgcccatttgtatggttatttcttgattgtttgctaaacaaggggtagattattcgcgcctcccctttttagaccatatagggtaacttcctaccgttgccatggcatttgtaaactgtcatggcattggtgggagtgtagcgatgaggacacgcagaagtcatttttgttgccatcttggttttggtgggttttggccagcttccttacggcaacttgttttatcagcaaggtctttatgacctatatcttgtgcagacttcccatatcatcctgtgactaagaatgccttaacctcctaggaatgcagcccagtaggtctcagccttatttacccagcctctattcaagatggagttgttctggttaaaacgcatctgacagaagtacacaccagatgctgagctgagtgctttgtgtgcattatctagtttaaaatcataactttaaaaggtgggtattctcatttcattttatagatgaagaaactgagatataaaattttaaagattattgtttttgagttttaaaaatcaaataaattacccaacgtcacttagagattaaaatgttctgtctctgtttaattgtagagaatgcagaaacatgaaattttctgacatccaaattatatctaccaacaccattcttaagttcactgttaaccttttgatccctacctaatggtttctctcattaagagtagtctcttcactaaagtctattaatacagcaacaaattttctgctgatcctggaaaactaatattgattatcagatattgttcaaatattagctgggtgcaaagtttacaattgcaccttgaactggaagaacagaatattacatttcatccttaaagaaaaaaagaaaagcattaaagcattaaagaaaaaaaatggcattgctgtatttgcagtgtcactgaaattcaagggatattttttagttttcacagttcaagaggtttttttcttaaattttcttaattcatgaattctttaagcttaaagtattattcagaaaattcctattaagcaagagatacctggctttgaataataaactggttggtggataaagttgctattgaaaatctggagagtttgcaaaatatatattttgcattctaaatcacaaaggtgttttttaggcaaccgtaaacttgcatctctcacttctctgtcacttgtatctatcacatcttttctgagtgacctgagattttattgcctcatttcctatttttcagttatctgtcattctgaacgatataattggaatgcagccctatcgtttttgtctagaaaccatggcaacagtactggaagttcaggactaaattgccccaggttgtttggtgggaatgatagattctttggtgacagctctgtcttaatggggtcccatttcagacatagtccttcattcttctcactatcgtttgctgaccctgggggttcctgtccctccctgttagtatttgtgacatgaatgggacaaagttaaacaggctttggtagaatttgcagtgagacaagaagaattttctgtgtgtaaaaggaatcaaaagagttgtagacaaatatctctgttaaatggtaataaaaatagaagataaaaatcaaacatctgcattttggaacatttttcatcaattgtgattaatttttacagtggaaagcactgtaaaatataccctggtcagcatttaaggtctggaaaacacgtctggataactgagagtttactagccgattttaggccataatatagaaattaagtccagaacttaagtgttctaattcaaaagacttacaaatggtcattatcatgcatctttgtttcctgtttacccttgaaacaaagaatcatttcactaaagtgtatgacaaaacttcatggccgaacgaaaaaaattccagaaaattgctttatctgaaggactgagtttttgctcaaacagtatttgactaggagtgctcttcaaatctgtttctatgtaaatatatttcctttattttcctaaaatctgactagatgagtaaatttcatgccataacataaacgtctaccctgtagaattttcaggagtcagctgagaaaatgggctctctggagaaatgatctgtctgcactgtgtccagtcttcagtctcttttaatattaatctggactcctgaatggctcagaattatccaactgtctttcaaatgtttctagattagccagctgcaggggttgggggacagagacagtattaagtcaatccttcaaccagcttttattgagcatctaatgtatgccaggcattgttccaaatccaggtacttaatttggagttgcccctggaaacacagaggagcctgagacagacctaacgatgtgcataaaagacacacagcccacatcttaaatgttgtctactgtttaagttactaaaatgatattaaaaccaccacaagtctctaatttttccagagtgcaattttacatctagtccccaaagattaaagtccaaatattaacattttcaaaagatcagtcctttgattgcaaaaatttttatcaaactaaaagttattaacgacaatgaacactaattaggcacccacaagagactgagaaggaagcccaaggactctgctctgcagaatcttctggtaggagatacaaagtctcaatccaggttgaagaacaccaaatctggtttccactgcccttttccatccccaggagcttgccaacatggtcccctgtggatctgacagttcttgggccatctataattccaggaaaagctcttgatcaatagcctcagcaaggcagaaacatccaaggttccagttgagacaagtatgaacaccatctgtcctagaatgaatctaacaaactcgggagccctacagcctcttgcaaaaccattctaatgaattataacaaaccaggtaaccacctttgttgtgttttgttgtcccacctatgcggtaagcttaagacccagacatctaaggaaatgttaacttacctctacagtcattcagcccttatcagtcacgaattcattcaacagacatctacttattgattacaacgtgccaaccctgggctaagctcctgagattcaaagataaatgtgagaagtttctatctccgaaggagctgactcttcagtagcagcctggaaaattaattcactacaattcctcatcgtcactattgtttggaatatattttattcccacattcaccataataattcaagacatagccaatagctttttcaatagccttaccttgtctaatctttctcctcttttaatctacccaacatttcattattttttccctgagtagctttattttccccctaaaagttcacacaaatcaaattaacatattgaatcataaaccatgaaactttctataagttatctgctcacctaactgcctcaatctatactgcacaccatcctaaaccgtgttttcctctccttcctaaaaaaagatggagacttatacttccatttttgtcccgatttactgcagggattttaactaactagtcagacttggttggttctgtttctgagaaatttgtttattctctctaacaatactaatcagcaacctgaactgtaagtccatataacatgcaagcttaactctgcagaaaaaggcaaaggaagcccagtagaagcctatggatcaagtacaactgagatgactatttcacccattaaacataaacatcaattaagtaggaaagcatataaactacattaataattttctctaacattaaacctataaatgtacatttattttatttaccagtcttacacaagagaggcaaaagtttttttttgcacttgagcccagtaattggagtaaaactacaggtgtataaactactcccatactgcattctctgtgatttctagtttgaggtccttcaagttggaatgagaacctaaagacacataaaagcaatcttaatgcagtaatagaatcctttcgggggtttgttgtattactttattcaatcttttattgttatcttgcccacatctatttttttcaacttttattttagatccaggggtgcatgggcagttttgttacctgggtatattgtatgatgctgagctttgcggtagaaatgattctatcacccaggtactgagcatagcacccaattgttagttttttaacccttagatccctccctgcacatctattttgacagcatattttaacaacttaatccttccaaactcttcaaattagttttgacatgaacaattctttctgtttttgtaactgtatgtcatcagtttaaacaatatttaattaaattacataattacaatggaaaaactagcataatcacattttgggaagaaatgcactgcctttgaggtaagcatgtaatttaactattggaagtatggggagcaaaagatgacaggtgtattcagtgtagcctataggtttattgtaacatggacatcattcaatgtgtttacagaagaaatagagagcgatggttaatacctttaattggttaaacagagcttcagtccttgctcttgaaacccttcagtctaataatagagacaggaaaagcgtctgtagcagggaggcaggggcactgctgcctttgcatggaggttaatttcctacttgctaagttttgttatgggatgaggctgtctcttctggttcttgtcctcacctaggtgccccagtcccctgacttctgtccagggggcttacaggtacccaggtttgttgaatggcctgtgtgcttcagtgatgagtctgttggggagtcagtcttagagagttggtcctctcctttgccccttcctctccaccctggtcctccagacctgttccttctgcagtatttttagttacttatttttagccacttatttttctcatctcccaggcccagtattatgtagtctctcttaagcagaaaaaaaaagttagtcctaaaataagccttgggagtttctttgaatctttgtttctactttgatgtggcacaaaaaacaatgttcctggagtgagaagagagaatatggaaaacacactgggcataacaagactaatacttcaaggtctaattctgccacacacaaatgcacatatataatttaaagggattgaaatatgtctgagattttaatagacaacatctctttaattttgtgcccctttatgatttatagaatatttacattgtatccctaagttcaggcctctgtattctttctatggcgatgataactataatttgagccttaacaaggaaaagtaacgggttagcacttaaatgtcatcaaatttaatttcttatcccattcaacactagtgcaaaatgaaaaaaagaaaatatctgtgttagaatcacaaaacaggccattaccttgttcatatcaaagcaaggattcaaatttgggtttgctctcaaaaccattaacctaatttattttagctggagaaattgaagactatatagtcttattaaaaagtggctactgctacttctgaaactacttttaaaaggaaatatagcttcttcctctctgacctttattaagagaagacctgaaaaatcttgttatgatttaatatttaattttttactattttcaaagcacagtggctactcaataagaaatgaacatgcataagagagactaatcattgagtacagagcatttagttctaaagaacaaattcaaacaaggcaacagctatcactacagaattattacagctcaggaaaccatatacactagaatgtaacctcattacagaacttctcaagaacaacatggattttactatttgtgcctaagataaaatcaaaattagtaagtccacaaaattagccaaatttaaagtttccctacatggtacataagccaccaaaaatgtttaagtctaggtatactttattaattagatgttatataattacaatatatttagagttttaagatggaaaagaaagactttctcctagagatcactcaaaaaaaaaaaaaaaaaaaaaaaaggagaacaagaaacgggaacaaaaaacctaaatttatccttaacaaaactggaatcttacccccaaccacgacctataaggaaggatatcatatgcaggatggcaaaacagggccatggaaagatgaaatgaccacagctacaaatctcacttgaagtcggcagctatcaattctccaaagtaactggcacatcccactaagtggggaatcagtaatcgcttgcttgaaacaatagcaacagatgagcttgctggtggccagaacttcccctggatgagtttggcacaaaggagaagcagattttatttttagtttacatggccaaaaggaaataattaataagagatatagatagatgtggagacagataaattcatcagaaatggttaagtggccattaaaaaaaaacacacacaaatacccaaaaatgataatggggaaaaaattaaaatttcaggaaaatttaaatgagattactttgctcaattctatgcaagtaaagttaagattataggtgaaacagatgatttctaagaaaatataaatggcaaactgaccttcaaaaagaaaacacctgaagtgactgtattcattttctattgatgtataacaaattatcacaaacttagtggcttcaaacaatacaaaataatcttacagtccttgggtcagaactccagcatgttttagcagagttctctgctaaggtggacatcaaatgttcagccaactctgtccttgcctggaagctcaactggagaaacctctccttccaagctggctctggttgttggcagaatccatttcttcatggttgtgggactgagcccccattgtcttgctggctgtcatctggagatcactttcagctcctagcagtcactctcaggtccttgccatgtggccccctccagggccctctcatagcatgacaacttacttcttcaaggccagcaggagaatttctctcacatttcagaaccttcaaagatcttccttgaggaaaggccaagtcccattttaagactcacttgttaggtcagacctatccaggaaaatttcccttttgatagaaccataattatatcttcaaaacttcttcaccgacttcatagaatgtcatctaatcacaggtttgaaatccatcatattcacagtcctttctatactcaaaggaaggagatgatacaagggcatgtatagtccagcgggaattttgggaaccatctgaaaattctgtcaaccacactgaccaatgaccacagaagaaggagaaaatcattaacaatctattttctccaaaaaaaaaaagcaccaaaccccattagttttttccaaacctttaaggagcacatactataatgttctaaaaaaactttttttctaaaatcagaaaagaaagaaattcttcaaattgaatataaaactatcacaatatttttaacaaagcttcaccagggtagcacaaaaaatagaaagtgatggtatattttatttataaatactcatactgaaaaatggtaatcataaatataatattacacaatagactagctatttaaagactatacatcaaattaagttgagctttcacaggtatgtttcaatattgggatacgtattaacaaattcaccttaatagtaaattttaaaggttatcatcatctctacagataacataaaagcatttgataaaatttgcaaactgcttttgcaaaatacttaatacagtagatcccccttatccatgtggatacattccaagaccccaaatggatgcctgaaaccatggatagtaccaaatctgattgctgtcggttggaacatgtttctgttccggtcctccgtccacaaatgtaatgcctttcccatcctaactaagcacttaacatgcactgtagctataacttttgcagtttaaggtgtgacagtaaaactagcatgaatttctttttcctcctgcacaatttcatgggtagatttgttcttaggatagatcttagcacctcagcatatgactttttttctttccttattaagtcaagaactgtcaccctttcacttaaaggaagcactttacagcttctctggcacatttcagttgccagagtcatcactcttgcatttgggggccattattaatcaaaatatgagttatttgaacacaagtactgcagcaatgtcacagttgatcttataatcaaggctatcaggtgaccacaggcagacagtgtagctagcatggaaatgctgggcagaggaatgacccatgtcccaggcaaaatggagcaggaggatgtgagatttcatcacactattcagaacaacacacaatttaaaacgtatgaattgtttatttctagaattttctaacaatattgttggactgtgcttggccacaggtaactgaaaccatggaaagagaagtcatgaataaagaaggactactgtatttagcatgattaaaatataaatatgtgtgtttgtataatggatatatttcaactgaaaagctatctattttcttaatgagaaaactctaggaatttttccattaaattattatttaacattattttatattattctgaagatagtaggcaatgcagttagataagagataaaaatacgatataaaaattagaaagcaggggggaaattttctattaggtaatatgacctgcctaaataatgcagtgaaatcaactaaaaaatgactataaacaataagaaatccagtaaattgcctgggtaaaatatgcatgagcgtgagtgtgtgtgtgtgtgtgtgtgtgtgtgtgtatttgtaaatatatggaaaacaatagcctttataaatataaaaagaaaccacccaaaggatgaaaagaaaaaaacaatttacaacagtgaaacaaaaactaggaataaatttaagaaatgtgcaaaactctgtcaaaaaatgttataatctactaaaggacacaaaaaaagacttgaaaaaaataaaaatttataaagaagattctccctatgtatactcataaatttaaggcaatctcagtaaaaatggtaataatttttttagctaagctaagtgcttctagttcataagaagaaatagaataataagaaaattttggagaaaaaatgataaggggctaatcacaacaaataataaaatacataataaaactagcctgaataaacacagatatctatagcacaaaagttaaatggacccagataaaaatgtgaagttaacataagataaaattaacatttcaaatcaagacggagacaatagtttcctcagcgatagtacagaacaactacccattttgaagaaaaaaaaattgaatcccacacttcatacaaaaagtatgaagatcctaagaagacaaatcattttaagcattaaaaatgacaaaaaatataattacaaaagttacacaagaattagaatagagatagtctcctaagtgtgttttaaaaaaaaaaaaaaactagaagcaatcaacgaaaaggttaattcatttacataaaatattatgtgaaaataaaagtcaaatgacaatctgggaaaaattatttgcacctaatacccttcataaataacgatctctcataaatcaacaagattaagcatcatttttaaaaggcaaaatattgcaacagttcacagaaatgaaaatacaaataactcatccattgaaagttattgattctcaattatgataagaaaaatgtgaattaatattataatgatagatttttcacttatcagatttgcaacaatcaagaactttgatagcaatgtgttgttttagagaaatagacactttcaaatacagtcagtcactgtagttaaaagtggtacaacctctagttggaacaattagaaaatatgtttcaagatgtaaaatgtgtatatgtgttggctcaacaattttatttctatttacataaaccaaagataaactcacacctgtgtgaaatgacacatatacaacacatgtatctcaatattgttcttatggatggaaaaaatggaaaacactaaagatttatcactaagggactgattgaattaattattatctacctatgctatagattacagtatagtctttaaaaataatgtaactttatttttactagtatggaataatatccaagtctattggtaagtgaaaaaaaggcaaagtatatagaacaactgtgcaaaaattaaaatgaagggaatacaaatgtttttatttatattgaataatttatatataaaacatatatagtatatgtgaacatatttataagacaaaattaaaatagtttcatatgcagacaatattcatagatgtcctcatgaatccaacaaatatttgtcgaaagcctattatgtgaaaatgacattgctattgaaaataatataatattataatctgcaggaatgacaaggtctctaccttatgaaattgagtgccaaaaagattatacataaacaaacatgatcatttaaatcagccagtattacaaggcaggatgcccataatatagaacagttataactgaccacataattgacttggtatttatatgccaaggtggaagaggatagaatgggctgtgctatttcctggcccccatttctcacacattaaacccaatacctggctcaatatgcattctctgttggcccctgaaggcccctgacttttaagatcctcttaatggaaggaatttagtttggatggtaagaaaaaccttttaaaatacatctatatctgcattcatgtgttaatatatatttacatgaatctcacaattgtttaaatacaaactctagaaacaaatccaaggtattgattaggccaaaacttccaagctaaaggaaggactttggtccactaggaaatccctgagcaaagagaatgagcgatttgttgaatagtgttctctgcatggcatcccttccacaggtgtggatcccagggtagcttcttttcctcaccccttacacctccaaccttgagtctctctcatccagccatcaccaaagcactgtttgcagtgaatgttccatatgttacacaactcacagatttgtaggagaaactacaaaacatgacacaccggcatcctaaagaaaggggttgtttctgggcccttgtccccaagccgggtcattggcccccagcctccacacttgctaacttgccaaacacttggttcccaagacaaaccactgtcaaagaacctcagtattaattcataagcattttcactttctccatagttgtctgaaaatacaaaagccccccagggtgtttaacttatactcctaaagtagttcatttgactccctggaagggtaaaactcaatctcattttacgattttacactttttcccttaagccatctctcattaaactatcatgacaatgctttgtacacatggttttgttagaaataaattcagccttataaaatgtgctcattggaaatcctttttatgccaaggatgattctaaaatattttatataccttctcattgcttttatgagacagttgtattagagaccactccttacttctgagcttgcaaagtaagtcaaagtgtagttgcatttcatatctaaaatgtgacagaagcctttctgtggcacatcacatgcccccagatacacaagaaaatatctggaattgttcctatggaattttttcctacagtatttagcctagatgacattaaaatatccattttagttcaacatgcccagaattgatcttccaaagaaaatattaaaatgactctaaactcattcagaaactcaaagataaacagaaacagctgctaaatgtctcaccagccagtctgagattcatttcaattacccaacaaaagatacctcaggtgtatcagagcactttcaagttaaattttatgtctattagatataagcctaggggcaattatgaattccttccagttgttccttcctttatgtctaatggcattttcctaattccctgtttaattttattttagcttttatagatagttgtaaagtgagcaagctgtaacagtttacatggcattcagtacctgtggtaaggtcaatttgacttcctatagaaatctttttaatgttgagatttttttccaaagttttctatttttctggttgccattttcctctaacaagaaaaatgaaatataatctaatcatgctaatgcttctaacacatcaatctatataaagcaagtcagtttgccccccacacaagaggtatttgtacagaaagtttcaaaataaaacacctcttcatatagttctcaagtccttcacccaaaaccaaataacaatattattgtgagccttcagagtgtatacacacattcactttagaggtataagaatttgatttttggttccaagatggccaaataggaacagctccagtctacagctcccagtgtcagcaacgcagaagacgggtgatttctgcatttccaactgaggtaccagattcatctcactgggacttgttggacagtgggtgcagcccgtggagtgtgagccaaagcagggcaggacatcacctcacctgggaagtgcaagaggtcagggaattccctttcctagacaagggaagccatgacagacggtacctgcaaaataggacactcccaccctaatactgcgcttttccaattgtcatagcaaatggcacaccaggagattatatcccatgcttggctcaccaggtcccacgcccacagagccttgctcactgctagcacagcagtccaagacccaactgagaggccgcagcgagggtgggggaggggcatctgccattgctgaggcttgactaggtaaacaaagcggtggggaagcttgaactgggtggagcccagcgcagctcagtgaggcctgcctgcttctgtagactccagctctgggggcagggcatagctgaacaaaaggcagcagaaacttctgcagacttaaacgtccctgtctgacagctttgaagagagcagtggttctcccagcatggagtttgaggtctgagaatgaacagactgcctcctcaagtgggcctctgatccctgagtagcctaactgggagacacctcccagtaggggccgactgacacctcatacagccgggtaaccctgtgagacaaagcttccagaggaaggatcaggcagcaacatttgccgttctgcaatatttgctgttctgccacctccgctggtgatacccaggaaaacagggtctggagtggacctccagcaaactccaacagatctgcagctaagggtcctgactgttagaaggaaaactaacagacagaaaggaataacatcaacaaaaaggacatccacaccaaaatcccatctgtaggtcaccatcatcaaagaccaaaggtagataaaaccacaaagatggggagaaactagagcagaaaagctgaaaattctaaaaatcagagcacctcttctcctccaaaggatcgcagctcctcgccagcaacagaacaaagctggacggagaatgactttgatgagttgacagaagtaggcttcagaaggttggtaataactaacttcttcgagctaaaggaggatgttcgagcccattgcaaggaagctaaaaaccttgaaaaaagattagacgaatggctaactagaataaacagcatagagaagaccttaaatgacctgatggagctgaaaaccatggcacgagaactacgtgacgcatgcacaagcttcagtagccgattcaatcaagtggaagaaagggtatcggtgactgaagatcaaatgaatgaaatgaagtgagaagagaagttgaaagaaaaaagagtgaaaagaaatgaacaaagcctccaagaaatgtgggactatgtgaaaagaccaaatctacatttgattggtgtaccttaaagtgatgggaagaatggaaccaagttggaaaacaaccttcaggatattattcaggagaaattccccaacctagcaaggcaggccaacattcaaattcaggaaatacagagaatgccacaaagatactcctcaagaagagcaaccccaagacacataattgtcagagtcatcaagattgaaatgaaggaaaaaatgttaaaggcagccagagagaaaggtcaggttacccacaaagggaagcccatcagactaacagctaatctctcagcagaaactctacaagccagaaggttgggggggtggtggccaatattcaacattcttaaagaaaagaaatttcaacccagaatttcatatccagccaaactaggcttcataagtgaaggagaaataaaagcctttacagacaagcaaatgccgagagattttgtcaccaccaggcctgccttacaagagctcctgaaggaagcactaaacatggaaaggaacaactggtaccagccacttcataaacatgccaaattgtaaagaccatcaatgctagatagaaattgcgtcaactaatgagcaaaataaccagctaacgtcataatgacaggatcaaattcacacataactatattaaccttaaatgtaaatgggctacatgccccaattaaaagacacagactggcaaattggataaagagtcaagacccatcagtgtgctgtattcaggaaacccatctcacatgcagagacatagataagctcaaaataaagggatggaggaagatctaccaagcaaatggaaaacaaaaaaaggcaaggattgcaatcctagtctctgataaaacagactttaaaccaacaaagatcaaaagagacaaagaaggccattacataatggtaaagggatcaattcaacaagaagagctaactatcctaaatgtatatgcacccaatacaggagcacccagattcataaagcaagtccttagagacctacaaagagatatagacccccaagcaataataacaggagactttaacaccccactgtcaacattagacagattaacgagacagaaagttcacaaggatatccaggacttgaacacagctctgcaccaagtggacctaatagacatctacagaactctccaccccaaatcaacagaatatacattcttctcagcaccacatcgcacttatttcaaaattgaccacatagttagaagtaaagcactcctcagcaaatgtaaaacaatagaaattataacaaactgtctctcagaccacagtgcaatcaagttagaactcaggattaagaaactcactcaaaacctcacaactacatggaaactgaacaacctgctcctgaatgactactgggtacataatgaaatgaaggcagaaataaagatgttctttgaaaccaatgagaacaaagacagaacataccagaatctctggcacacatttaaagcactgtagagggaaatttgtaacactaaatgcccacaagagaaagcaggaaagatgtaaaatcaacaccctaacatcacaatcaaaagaactagagaagcaagagcaaacaaattcaaaagctagcagaaggcaagaaataactaagatcagagcagaactgaaggagatagagacacaaaaaaaccttcaaaaattcaatgaatccagcagctggtttttcgaaaagatcaacaaaatagatagatggctagcaagactaataaagaagaaaagagagaagaatcaaatagatgcagtaaaaaatgatgaaggggatatcaccaatgatcccacagaaatacaaactaccatcagagaatactataaacacttctacgcaaataaactagaatatctagaagaaatggataaattccgggacacatacagcctccaaagtctaaaccaggaagaagtcaaatccctgaacagtccaataacaaggtctgaaattgaggcagtaattaatagcctatcaacaaaaaagtccagtaccagatggattcacagccgaattctaccagaggtacaaagaggagctggtaccatcccttctgaaactattccaaaaaatagaaaaagagggaatcttccctaactcattttatgaggccagcatcatcctgataccaaagactggcagagacacaacaaaaaaagagaattataggccaatacccctgatgaacagtgatgcaaaaatcctcaataaaatactggcaaactgaatccagcaatacatcaaaaagcttatccaccacaatcaagttggcttcatccctggaatgaaaggctggttcaacatatgcaaatcaataagtgtaatccatcatataaacagaaccaaagacaaaaaccacatgattatctcaatagatgcagaaaaggcctttgacaaaattcaacaacccttcatgctaaaaacactcaataaactaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaatttctggccagggcaatcagacaaaagcaagaaataaagagtattcaattaggaaaagaggaagtcaaattgtctctgtttgcagatgacatgattgtatatttagaaaaccccattgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgcttcaaagagaataaaatacctaggaatcgaacttacaagggatgtgaagaaccgtttcaaggagaactacaaaccactgctcaatgaaataaaagaggacacaaacaaatggaagaacattccctgctcatgaatagaaagaaacaatatcgtgaaaatggccatactgcccaaggtaatttatagattcaatgccatccccgtcaagctaccaatgactttcttcacagaattggaaaaaactactttaaagttcatatggaaccaaaaaagagcccacattgctaagacaatcctgagcaaaaagaacaaagctggaggcatcacactacctgacttcaaactatactacaaggctacagtaaccaaaacagcatggtactgttaccaaaacagagatatagaccaatggaatggaacagagccctcagaaataataccacacgtctacaaccatctgatctttgacaaacctgacaaaaacaagaaacggggaaaggattccctatttaataaatggtgctgggaaaactggctagccatatgcaggaagctgaaacttgatcctttccttacaccttatacaaatattaattcaagatggattaaagacttaaatgttagacctaaaaccataaaaaccctagaagaaaacctaggaaataccattcaggacataggcatgggcaaggacttcatgattaaaacaccaaaagcaatggcaacaaaagccaaaattgacaaatgggatctaattaaactaaagagcttctgcacagcaaaagaacctaccatcaaagtgaacaggcaacatacagaatgggaggaaagttttgcaatctactcatctgacaaagggttaatatccagaatctgcaaagaactcaaacaaatttacacgaaaaaaacaaacaaccccatcaaaaagtgggcgaaagacatgaacagacacttctcaaaagaagacttttatgcagccaacagacacatgaaaaaatgcttatcatcactggccatcagagaaatgcaaatcaaaaccacaatgagataccatctcacaccagttagaatggggatcattaaaaagtcaggaaacaacaggtgctggagaggttgtggagaaataggaacgcttttacactgttggtgggactgtaaactagttcaaccattgtggaagacagtgtggagattcctcaaggatctagaactagaaataccatttgacccagtgatcccattactgggtatatacccaaaggattataaatcatgctactataaagacacatgcacacatatgtttattgtggcactattcacaatagcaaagacttggaaccaacccaaatgtccatcaatgatagactggataaagaaaatgtggcacatatacaccatggaatactatgcagccataaaaaggatgagtttgtagggacatggatgaagctggaaaccatcattctgagcaaactatcacaaggacagaaaaccaaacaccgcatgctctcactcataagtgggaattgaacaatgagaacacttggacacagagtggggaacatcacacattggggcctgttgtggggtggggggaggcaagggatagcattaggagaaatacctaatgtaaatgatgagttaatgggtgcagcacatgaacacggcacatgtatacatatgtaacaaacttccacattgtgcacatgtaccctagaacttaaagtataatttaaaaaaaataaaataaaataaaaaataaagaatttgatttttatattctacatcaaggtcagcagcctgtaacacataaggccaacagaagttaaccagtactcccttttcctctccaaacagctgagaatacatataatgccttccttcccccaacacacacattcacagacctgcatgttatcatatgccctgactcctctcatggaggccaacatgtggatatacatcaaccacctcacgtaacccccaacataccggaaaaataggctgtccactaggtagactatatcgtgtaatcaccattcttgagtacctataatgtgcctcctccagatgctgtgtgtattatttaatttggtccttacaaccacctatgaagtagatacattaccccaactttatggaagatgaccctgagactcagaaaatggtggaaagctgcccaactgaagctcggttcactgtgccacattgtgaaagtgtatcaacttttcctagagatagaaataatttgcaaacaccattataaaccttcaagagtttcacattttttattttggtgaaaacatcttcatatttaatattgcttaaaaaactaacaaaaaaatttaaaactgaatttctctttgattctttgaggcatttattgcaatgctgttcatttgagtagcatttgactgagtgcttgttctaaagtgcacccttggctcctagaaacccaaaccctcactgtttacgaaaagagtttttaaatgtggatatttgacttgcaagaagacagaaacccacctcattttaacttagaagaaaggaagaattcgggaggaagctcgtggaaacggtgcaaaagtcaggaaaatggatgagtctcttggtggcctgagggcctcaagtgctgctaggacctttgctctgaatgtctccccaccatgcctctcagtgtccatttcattccctctcacggactcccctcctgcccctcaggcatggccgctgaaagctctcgggctttcattttccgcttcaccaccagagaggtagttccagccaccatgatgaaacctcagagaaggacttcaattcacctggcctgagtcatgttcccacccctgccatcaggacatggcaagattgacagcccaagtgagcggcaaaggaaaagcctatttgaatatttttgtaaaagaaggaaggttctgttccactacagaaagtcaactttttaaaaatgtttttaaaactttgattatatttttagcagatggtgaatccagaaaatgtaagcaataaactcaaattctggagacatatggaaatatggtaaaaagcaggtgctttgcctctgatgtaaattctaagctgcagaataatgaattaagggaaatgacaggttaggtccttaattacattttacccaaagaagcactcttcagatgttcaaatccagtttttcctccccaagacttaaagttttgaataaacattaagtgatacatctgtttttaagtttcattccccgcccccaaatcgctgtttttaagactgcttaatgttactgtagaaatgaacactttcttaaaagtagtgatcctgtgaacaatgtaacctctgaagctcttctgctaccactcaaacctctagaaactcattaaatgcaagattgaccacattttttatactgacacaacagagcatttctgacttagaaaaaattctaagcagataactcaagaaattagggaattttcccctgaaaataaaaccatcatattctcattatagactataaacacatttctaacttctacttttatttcattctgatcaacaaatagaaaagggggatcaggacaagtcaaaataagctgttctttttttctcgctatctcagagaataacctcaaaatccagatttctgtgaataaaggaaagcaatgctttgtggaagtgtatcttcccaaagttaccctttttagatgtagttttattacatctagcccagaaaagtagtttaatgatagccatagcccttttcaaaatctatatcccaaagcttttcaggttaacaatattttaatttctagatagatggtaaagtgcttgactgtctagtcttaagaattttttcaaccttaccctgcctaagttataccatacaattaggaagttattttctggtcctagaaatttaagtatttatttatatagagagtgctgtatttttaacatcactcatttctttaatttataataaacaactagtgaatgaaaataagctcaaaaaagcttattcccttgaaatttacatttgaatgtattatgatcgtagctgttatttttaatggcagctagctacagagtgagttatcattaagtaactcagttgtctggaattaacctgactttatattaataaaccaataactcattcattcagtcagtcaacaaatacctacagagtaccatgtgtcaggcactgttaaaggtgcttaggatacatcacttaatgaacatagtaaataagtgagatatctactgagttagaaggtgtgagaacacaggcagaaaagggtgatgagtactgagagtataggatggatcaaaaggatttggagctatgacttgaaggagatgagggaactaggcatgtggagttctgcaagaagagaattccaggcagaagaaaccgccaagataatgcccgagggtgacagagtatctggcttgtaggaggaacagaaaagaagccagaatagcttgggcagaaggagggaaggaaagaagcataggaaataagattagagagatagccaattttggggctgaatgcttttaataaatacttttttgagaatttgaattattatttccataaagtgtattatgcttcatcttatacctgatcatagtgctcccttattgtcctcctaataaccagtttcttattgaaactaatttcatagttcatgtgaccagtgtaactgtatgattctattgaatttaacattctctatgtccaaatttcaggttgtggctgatatagaaaattgttttaaaaataagacaaacatttaattattccatcaatttgaactgcattatgacaaaagaaaaaaatgccaggccaggcacagtggctcatgcctgtaatcccagtactttgggaggccgaggcaggtggatcacttgaggtcaggagttcaacaccagcctagccaacatggtgaaacctgtctctactaaaaatacaaagatcagctgggtgcggcggtgggcctctataatcccagctatttgggagcctgaggcaggagaatcactttcacctgggaggcagaggttgcagtgagccatgatcgctcactgcactccagccagggtgacagagcaagaccttgtctcaaaaaaaaaaaaaaaaagcaaagaaaaaatgcatgtattcattcacaggtgaaataacatttcttcaaaatatttatgctgtcaaaagaagacacattatttgcaaatgtaaaatatttctctaagagttaactactaaagtatggagatatggtttgactgtgtccccacccaaatctcaacttgaattgtatctcccagcattctcatatgttgtgggagggacccagggggaggtaattgaatcatgggggctggtctttcccatgctattctcgtgatagtgaataagtctcatgagatctgatgggtttatcagaggtttccacttttgcttcttcctcatttttctcttgccaccaccgtgtaagaactgcctttcacctcccgccatgattctgaggcctcccctgccatgtggaactgtaaatccaattaaacctccttttcttcccagtttcaggtatgtctttatcagcagcatgaaaacggactaatacatatggcatgccactttttttagactatcatcacatcatactaccaaaaatttcttttaaaaatataatccatatctttcagaacaaatatagaatttaatacctgccacaacagtgtgctttcctaaggaatcatgttcccacactaatacctaaatccatctactctatcagaatgtgaatgcttctactgaaatgtgcatagttattggcagactgaaaaaaaaataaagtagtgcatagtgatatccaggggatagagacaaaaacaactctaagattagagatagtggaagcagtgtgctatggtaaaagtaagggggccctgaggttgtgtgaagcaacactaaattagaaaagccttagggacttccacataagtagaagcactaagtataattgaaagaagaagccaccatattcacctactccacaaatatttattgagtgtcttctatgtgctgaacccttcaacagtagctggagatataatagtgaaaaagaaagtcatggaatttatagtctggtgaggggaggcagatgctaagcaaatcatacaggtgcactcaaagaaatcatttcattacagttatcccaagtgttattgttagagtaggcagatagctaggcatgagcaggatggggagaccctgaggaaatggaggtctagaaaaatctcacacctcagagatcaccagaaacaggtaggctagttataagcagagaggaggggaaacacctatgcaggaaggaccgctccttaagagacccagtaatcatctctttgcagttaacctgccaggatgtagctaggtgtgtgctgacaaggaggggaagagagtttattagtttgttttcatgctgctgataaagacatacccgacactgggcaatttacaaaataaagaggtttaatggacttacggttctacacagctgggaaggtctcaggatcatggtggaaggcaagaaggagcaagtcacatcttacatggtggcagggaagagagaacttgtgaggggaatccctctttataaagccgtcagctctcataagacttattcactgtcatgagaacagcactggaaagacccacccccatgattcagttacctcccactgggtccctaccactacacttgggaaatgtgggagctacaattcaagatgagatttgggtggggacacaggaaaccatatcagagggcagagaaattcctaagaaatacgcaggtagaataagtatagatctgacctctatacaaccttcctgggatggtgctaatgagcaatgcagccactaggtagacttagtatccaacactgccccatgtgtgcacaccaaggggagtatattagtctgttttcacactgctgataaacacatatccaacactgggcaagttacaaaagaaagaggtttaaatggatttacggttccacatggctggggaggcctcactatcatggtggaaggcaaggaggagcaagtcacatcttacttgaatggcagcaggcaaaaagagcttgtgcaggaaaactccccttatagtaagcatcaaatctcgtgagacttactaccacgagaacagcacaggaaagacctgcccccatgattcaattacctcccaccgggtacctcacacaacacgtgggaattcaagatgagatttttgtggggacagagcagaaccatttcagggagggtcccacgagcctggggtgggaactaggcagggaaaggtaagggacttaaggcagaagcgggaaaactagacaaagaaaaaaggtgatgacttaagacagaggtgaaaacttcaagaaaaaatccaacatcataaaaacccaatgcagaactctcagggtgcgcctggcccattctctttcagcagcccgctctgcctcatctttcacaatgtcctgtccctttaaataaactctctgctccctctttcccttcatgtaaagttttctgctgtgtttgaactggccaaaacctttctcctaagactataaacgactgaggattcccgcacttccgggcaacactgtctccaattgaaagaaggctccatgtgctcaaaactttaagtgggtcacacattagagcttctgtctgggacggatgcttggcacctagtgagtgctcactacgtatttgttcacttaacgaagtatatgaaagagaagcacaggatagagtgagagcatgaaacagggaatcccaaccaaatctgggggctcagtgtgagttaagctgaaatctggaaaatatagagaagacaaggaataggaaagaaggaaagggaagaggagaaggtgggagaattttctttggagaaaacaactgatggcagcaagctctgaggagggaaacctgatccttcctaaggaattaaaaatagctctggccaggggagtgggaaggtagtgactgagagacaagtaggcaaagaccagatcctgcaaagtcttggaacctttatggagcagttgtaactttgccctaagagcagtagaaaaccactgaaggattttgatagaggaatggtatgctcagatttatgttttttactgttttgttttttgttttttcgagacagagtttggctctgtcgccaggctagagtgcagtggcgcgatctcggctcactgcaagctccacctcccgggttcacgccattctcctgcctcagcctcccgagtacctgggactacaggtgcctgccaccacgcccggctaatttttttgtatttttagtagagacggggtttcactgtgttagccaggatggtctcaatctcctgacctcgtgatccacccaccttggcctcccaaagtgctgggattacaggcatgagccaccgcaccaggcttatgtttttttttttttttaaagtgatcatggggccgtaagaaggaaaaaaaaataaatcgcaggattctatagttttctcaacactgaatttagaatttaaaaagtctgcccagaagtttcttgaatttgacttaactacacagagaaacttctgaggggaagaattttaagaaccaggatgaggttatcgatagaagacatgaattttgagtccttggaaatggtagtaacagaactctaagatgactctcttccttggtttactcacatgagtatgtcaacgttacatggtaaaagagatttggcaaacgtaattatcaatcagttcactttaagaagaggaggtaatcaaggtaggcctcatctagtcacatgagtttaaccactgctgggatggaaggtctgtgaagcaaggaactaaaaatggtgtcgataagctgagaatggtccccagtcagcagccatcaagaaaatggggatctcagtcccataattgcaaactgaattctgtcaataacctaagtaaacttgaaagcagattcttcccctgaggctccaggtaagagctccacccagcagacacctagacttcagccttgtgagacccttgatggagaaccttgttgagccctcatggactcctgacctacagaactgtgatacagtaaatgtatgttgttttaaacaactaagtatgtggtcatctgttatgcacgtacatctgtaaacaccatgttagagtgaccctctgagaataattagttgaaattttattactgtgtgtttattaggttgttttgctatatcttaagaaggaaagagtcttacttacccatttgggctgctatagcaaagtgctacagactgagtggcttataaataacagaaatttatttctcactgttctggatgctgcaagtctgatatcagagtgccagcattgttgggttctggagagggccctctaccaggttgcagactgccaactactcattgtatcttcacatggtggaaagaccatgagagagctctctggggtctcttttactagttcactaattctatccttgagaactctaccctcataacttaatcacctcccaaggaccctacctctgaataccaccacattggagattaaaatttcaacatttgaatttgatagggtggatggatacaaacattcaatccataacagaaagcaataatgatttattgaactttctattacggcacttttcattccgcaaatactctcctaagatgcatttagttcacttctgctcactttgtaagtattttacaagataacattaagtgaagaataggttaaggccagaaaatgtaaggcattgttccagaccttgaccccacatcttgtcctcacttatcaccatctcctagtcctgcaggaaagattggccacctccacaagctaatcaatattgtcacttttttgtgaaaaacaaaaggctgtgccaacaaattcctatctcccagctgcagatgataagaaagtttctttgccttgacatttgcttatctttgaccaataagcactgacatttgattatacactggactatccagcattctcctccctcccatttcccaccctaacacctgctgtctaattacttttaaattctacctctttaaaatgcaggagtaagaattaaagtaatctctcaaataattacagtcactaaatttgattaaaaatatcagaagaggctgagaaaaaaatgactgttcattagggtggaacaacatctataataaatccaaaatcttggtaatttaacattaataagaattttctattgcttgtctcacaatttggaggaggaggcatgagcaatgcttcacccagttttcagcaaccccgtccccatccatttaatgattctaccatctgctagggcctcagaatcctcctctgtatcttctgcaattactcaggctctgagggaaaaatatattataaataaggtagagaaagtagtccacttgtaatttctttggcccagaggtgatgcacatcacttccatttgcatttcactgtcaagaaacaattacatagtcacatctaaatacaaaggagctgggaattataacttggctgtgtgcccaggaggaagtgagcatggaaattgctgagtcctagctctgtatcccgtacaatagaataagatgaaatctatgagtgatccataaattttggttatcggtgttagtaattcacctttatcatggatttagaaatatgtagttccaattactactgttgcataacaaagcttagcaccataaagcaactgttttattaagcttttggattttgtgggccgcaaattcaaaaaaaggcacagaggagatagtttgtttctgctctgtgatatatggagtctcggggggatgattcagcagcaaggggctggaatcacgtagaggcatctttattcacagtgctggcagctaatgttggtcatcagttaaaaccccaagtaaaggtatttacccaatgcatgacatctcaggtccttggactttttcacaatggagtagcctcagagagtcaaatttctcacatggaagcccagagtttcaaaaacaaatgccccagaggacaggctatgtggccttttatgacctatcttcaaccacttctgttgtactctactggtctaagaattcataagcccaccctaattcaaagagaggagacatagaccgatcccctaatggaaagttggttaccgaggtcacattgcagaggggtatgtgcaatggaagatattgtggtgtctaattttggaaactataatctcccacatacattatcttagaatcactgaaagttagtgtttgaaaggattaatttctttatagaacaagagccagcaaacaatagtccactgccagttttggtaagcaaggtttaactgaaatacaccatgcctatttgttagcagatttgaggagttccaaaagataccatatgacctacaaaggcaaaagtatttattttctggccctttacagaaagagtttgcataatctatagatacaatatcaattaaacacgtggacactgaagttagactactaggttttcaaatctcagttctggaagtggccagttatgtggctttgaacaagctacttagcatctctaggctgccattttcccaccttcataattggggaaacagtaaagtctgtcattgaattgtgagcattacatgaaataattaatgaaaagggcataattagcattcataaatgctaacttgtgctgtagaattgccttaaattatcagctagatcaaatgtccatttgagtcatatgtttatctccagtgtcatctgctgcagatttcaacacatctagtgatacaggaagtccattctatctttaatcattttattagaaatttcttcctactaggttgaaatctgcccccttacagctatatgcaattaatcctggttctatctcctaaaggctctacaaaacatctcttccaaatattgggttctttgaaaaggctatctctgaattttatcttatcagaactacacatctttagttctttcaattgcctctcctaagacagagttcacatcacttttcaactttaaaattccccttagaaggaaatataaagcatttatccagaaattagcaaaagacttcaggcctgcagatagatctagatcgttggtccctaaattctccatagtatgttaatgatgtgtgttttgtgctactcagtctttttccacacttcctgctgtggaagagttgatttcttaagatcctgggacaggtgtttattgttgcctttttatgttcaatgttatagagctccagcctgtggagatctttccatatgttgataatgtagtttagactgtccactgcccttaccagctttatattacccacacatatttctgaaggcttgatccaaatcgttactaaatatcccatcaagttgaaattaatactatgagtaatcctgaactcaattacagcaactgaatgttgctttaataattgcacttattccttcctggacttccattgaccttaatcaccatttgttcaaccattctcgcttgggtgacattcctcttagtgaaagaagttggaagcaaatataaaggaaaacataagcatttctctttctctctttcaatattacacttcaaatcaagatatgtatctgtattactcaggggtctccagagaaaccaaaccaagggaagagagagattaattttaaggaattggtccacacgattgtggaagcttggtaagtccacaatcttcagagtaggtgggcaagctggagactcagggattctgctggcagaattccttcttgctcagtagaggtcagactttgttctattaacaccttcatccaattggatgaggcccatcgacatcatggaaggtaattcactttactcaaagtccactgatttcaaatgttaatggaatgcaaaaaacaccttcacagaaagatccagaatagtgtttgaccaaatatctgggcgccatggtccagccaagttgattcataaaattaaccatcagagtatctctttttataatcatttatcttacaataaaaatagctaagactatagcctatatgaagcctggatttatgttttgataattagttcttttataatagaagatctgttatataaaaccacaattaagtgtgcgtctgtctgagaaggttgtcatggtaaaatataaccatgacttttgttactaaatataaaagtacagcatctagggccaggtgcggtggctcacgcctgtaatcccaacactttaggaggccgaggtgggcggatcacctgaggtcaggagttcaagaccagcctggccaacatggtgaaacctcgcctctactaaaaatacaaaaaattagctcagcgtggtagcgggcacctataatctcagccacttgggaggctgaggcaggagaattgcctgaacacaggaggcagaagtttcagtgagctgagatcacaccattgcactccaacctaggcaacaagagtgaaactccatctcaaaaaaaaaaaagtacagcatcttaactgattattttctgtacctaagaaaaagatcagtggcggggggagaaatgagaatgcaactctgatttttaaggttagcactgttgcaagtttcagaatgcaacttaaaaggtatgatatgcttgtgttctttaaagcattcacctatttttaaaatttcactttttatatgttaaatttttaaattggcattttaatttcaaatgttatttcttcaaatgattttacaagattattgaaacaaatatctatataaataagatgtctaagcatgaaatgtgggttcaatacaatatttgtaacaaaattttactagaatttttcttaagccaacatgttgtctatggaaacaggattttattgaactagtattttagttttggttttgttttgttaagacagggtctcgctctgttccccaggctgaagtgcagtggtgcaaacatagctcacttcagcaagccattcgcccaactcagcctcccaagtagctgggactgaaggcgcacaccaccacacccagctaatttttgtattttttgtagaaatgtggtttcgtcatgttgcccaggctggtcgtgaccacctgggctcaagtgatcctccctccttggcctcccaaagtactgggattataagcatgaaccactgcactcagctgtattttggttttaaacttttatgaatctaggttttaaaaaaaagtggttttcttttctggttagccatttataataagtagaaattattgatttaaagacttttagagattttaagatggtttatgagtcctactgattattcctttcttgtgtgaaattcactgttgtcttttgttctatttttccctcttcaggtttggatgtgtggaggagaaatgtttgatgttccatgttctagagttggtcatatctacaggaagtacgttccatacaaagttccatctgggacaagcctggcaagagtgagtaactcagcatcagaacagactggggttgatatggctttctgtaaccagagtaaccaaccttgcccatggcacagtctgagaaaagctctccagtgtacagagagctcctgtgcttctcagagtcttatttccattgcttaaagaagtattaactataatgctatttcttgttacaaattggttcaaagcattttcacatacattatatttaatcttcaccattaccttctgaggtctgtgttcttgtctttattttgtagatgggaaaatgaagtctgaactaggtgcttgttcatgctcacatgaatgccaaatagcagagtaggtccgcggacctggggcagccagttctctccacccacatggagtgtagcaggatctgtaataagtcagatggaaaaaggggtaaatgggagatgggaaaaggtggatgtccaaactctgccttcttctctttcataactagggccagctctgcctcaaattttgccccatcctcaacatttcaaaattggctcagtcttaagatttttttccaatattgttttgaataaaacctttcttgtaaaccagatgcaaagatgctcttctcttctgccgtttgaaacatttttatgcttgtttaggagaacggactcacaataccatctccaaataatcctgacaatttctctgctttccatattactttcttcagggctgggtcagtttttgtcaccaccatatgtacctgctactgctgagaatcgaaatctagaaaaagagaattttatcacactgctaccctagaaatcaaatcctgaattattcattttggttcttttactaataaggctgcaagatataactatttggatcttttatataaggctcacataacaagcttttgtaaaaataaataaacgaattcaccaggaatcattagagtatcagtaacacaagggtagagctttggtctgtgttagttaccgctgtactctcagaacctaaaacggggcttagggaacactcagatatttgttgaaagaattaattaatcaggaaagctaagagaggaaaatgctggagatttaagttgttactaaaacttaaatactttttaatgagtataacaaaattttcttttacagtgaatctttgtggggcggggggagttgttcttcctttttccctttctgagagtattcatcaactgtccatttctctttagctacatccatattctctaacagcaattagagctcctagtaataacattaccttacacacaccttgaatggaaatacaggctgagtatccctcatccaaactgcttaggaccaagagtctttcagatttcagattttttccagattttgggatattcacatatacataatgagatatcttggggataagacccaagtctaaacacaaaattcatttatgtttcacatacaccttatatacatggcctgaaggtaattttatacaatatttttaataattttgtgcatgaaaccaaatttgcgttagtacttatgtgtggaattttctatttgtggcatcgtgttagcactcaaagagttttggattttggagcattttgtattttatattttcagattatggatgcccaacctgtagtaatattcctgctttcctaactaaattaaaattttaattagatgctaaaacatattcctctaagtagctgtcaaaatacactatttgaagggaaaaagcagtcacaaaatcataaagtaattaaagagctgaatttgggtaaggaaatatggtttgatttagtcataagacttaagacatatgaatcagaaaacaatagttcacaggaaagtaaatgattgaacaatttagagcacatgtcaccaatcagctgggtagatataataaatcatagcagtttaaaatatcctaaagataataatgttctctcatgtatccacttttattcactcatatgctcccctgcttgtgctctgaaaagaaccatccttccaagacaatgggtgtgtatgcttgcttcgtagtctaaagtagagtgtaaaagcttgcaggggaatgctgtgctgatccaaaaggagctattttcaaaaaaataaaactgttcatatattttcaagaaagaaattaagtactttttcaaggattgtcaaatacagagaaactggggttggcacataaaacttccaggaaaaagtgaatatttattcaactgaaaaaagtccataattctgaattttaatcttttccactcaaattttacttcagagctcatttttatttttttttctaaactgctagagcaatcagaaagtcataaatattaaagcttgactgtcactctgagaaacattttatggtttttttaagttaaaaaaagtacattaaaatgaaaaacaattctgatattttgtgggagcacctcaactacctcgctacatgctacattattaccatatcatcaaaaatgaagagagactttatatatacttcaaatgcagggccacgtctactcaactgatattttaatcttgcagcctcatcaggaaatggagatgaaggtggagacttgactccaaaggcttattttcttactctacaaagctcaattaattcttcaaaaatgtgcacttttcacattgatgattccaaaagacttccaaaatatttaaacacacacatagacacacaaatgtctgaacagccttaaacagcctactggttggtgtatactatagaaatacatttgtaaaattagttcttcagtaccttctatttacctggcattagaatctggttgcaaaagacaggatatccatatatgaaaccattagaggacagtacaaggcaagtaactgcttaaatgtatcgtaaggacatgtataggtagagggaagaggaggaagtagcgtcatagctgtgaccttcttcagtcctctcaaattaaaggacttgaaagaggaccttcaagaatatgtccactgaattaacgagtttcatataacagtggtttccaaactcaggatgaaccaattcctgactaatatttcacccagcctcagtgaactaagaaaaatgataatcccaaagataaacctgttcaacttaataacatctttttatgcagaaactataaggtttttttcattgaaaaaaaaatagaatgcaagacagtaaatttttgttagtgcccttatttggcaaaaacaaaaatcagcatcactttgtcatttcccacaaaatgtaaaaacctaggacaccataacttacacttcagcttcatctgggaataagcgtattcacttgacattaataagcctagacagttttactgagtcagctcggggcctattgtcagcacactgggacacggttgtggtgtcttgccacaaggaacaagcagcaagtcactgagggaagggatgctcatgtctagagttgcagggagactagaaagacagcagggctgtggtgacaatcatcccttctgcttcacagaagcgtgagcagctcctcagcaaaggtccactgagtgtcgctttgcacagcccaaggaggctgagtggcaaataggtggaagaatctcaaagaagagattcttctcttcattccaacaggtttttatgtgagccaagcactgtgctgaaggagcagctattactggcacctatggggacagtccacaaactcctctgtgaatgtcagtgtgttcaggaacaatcaaagccactggatctgtgacaggtggctgtaacagcagggacatgtcagaagtggagagcagtcaccccacggctaaacataccagctgattatcacacagcagtggtcttcatgggaacaacttggcccatgagagtttccttggagggtcaccacgccagagcgctgccctgcagactgtgagtggggcagtcctggaagtgcacacagccaccctcgccaatacaagacaaggttagaaccaacccttacccctagtctgtaagaaacatcagagaatgcaaatctgtatactgctgtatttcacctctgacatagtatcagtaattttttcattttaaaatttcaccctaatatcaaaattaaaataactagagaagcaagagcaaacaaattcaaaagctagcagagacaagaaataactaaaatcagagcagaactgaaggagatagagataccaaaaaaccttcaaaaaaatcaatgaatccaggagctggttttttgaaaagatcaacaaaataggtagactgctagctgactaataaagaagaaaagagagaagaactaaatagatgcaataaaaaaatgataaaggggatattaccactgatcccacagaaatacaaactaccatcagctaatactataaacacctctacccaaataaactagaaaatctggaagaaatggataaattcctggacacatataccctcccaagtctaaaccaggaagaagtcaaatccctgaatagaccaataacaaggtctgaaattgaggcagtaattaatagcctaccaaccaaaaaagtccaggaccagacggattcacagccaaattctaccagaggtacaaagaggagctaataccattccttctgaaactattccaaaaaatagatagagagggaatcctccgtaactcattttatgaggccagcatcatcctgataccaaaacctggcagagacaccacaaaaaaagaaactttctggccaatatccctaatgaacatcgatgtgaaaatcctcaataaaatactggcaaaccaaatccagcagcacatcataaagcttatccaccatgatcaagttggcttcatacctgggatgcaaggctgctcaacatacgcaaatcaataaacataatccatcacataagcagaaccaacgacaaaaaccacacgattatctcaatatatgcagaaaaggccttcgacaaaattcaacaccccttcattctgaaaactctcaataaactaggtatcgatggaacgtatctcaaaataatgagagctatttatgacaaacctacagcaatatcatactaaatgggcaaacgctggaagcattccctttgaaaaccagcacaagacaaggataccctctctcaccactccaacatagtattggaagctctggccagggcaatcaggcaagagaaagaaatagagtattcaaataggaaaagaggaagtcaaattgtctctgtttgcagatgacatgattgtgtatttagaaaaccccaccgtctcagcccaaaatctccttaagctgataggaaactttagcaaagtctcaggatacaaaatctatgtgcaaaaatcacaagcattcctatacaccaataatagagagccaaattgtgagtgaacgcccattcacaattgttactaagagaataaaatacccaggaatacaacttacagggatgtgaaggacctcttcaaggagaactaactataagaaccatccaagaacatgggagactttaaatttttttctagtttcaggataggagctaaaactgaagtcaaatctcataaaagccaaattgtacaggctgcttcccaggtcctgaaaatgttaacttagagtaaaagggatagaggttaaatggtaaaggagtagagctgggtctatgaaccgaggtctgtctggtcgaggttcatgctcctcaccataatgtttcttctagagtgcttgagataaactggagcagcctgggcatctctggtagggcaccagtttagcagagtaccaagtagaaatgggcaggcagagagttacggagggtgtgcgtaggacctgtggagttagccttggaagaccctggatgcagatcacagtgttgacctttactccttgactgtagggccttgaacaggaagtatcaggataaaaatagcagaggtaaaatagaaaggtcaaccaacaaataattattaaaatggagaaagtctaaagaaagtctaaagaaattaacatttcgaatgcaaggagcatttgtaaaaaaaaaaatcataaaatatttttattgatttgctacactgtgcacggaggtggggctcacatgtgactatgagctttccatctcagcatcccagagaaaatagtatcagtacaaaaacagggaagggaggaagaggaaaggggaagagactgagattggttttagataaggttaagtgacagcctgggatagcctggggcagccagatctggggagatacccacagattttccatccagaattctgagagcacacaaaaacttttgacagattttctttggcaaataaatgtttacttctgaaaaaagaaatgcttactgtgccagtcagtgtgctaggccctggaagtttaagtgatgaacaagttaaacacaaatctcaattcctcttaataaatggccttgacagtaacgtacagtccacaccatgcagcagtaatccacgtattccaatgccagaatatcatgaggatgagaaaagggttaaatgaaaataataaagctcattatggaatgaaatctgtatcttatatagttcactatttggaaattgttttttaatagactgtcatattataattgagattatgatgtaacaaaagagaaatatatgccctatatagcatatagcattattttatatatagccatatatatttgatattaacaaattatgtttaatgacccaataggctaatctacatacaagttacaaatgtttttgactttatgcatttacctagggtttcttagcaaagtgtaacaacctttgacaatttcctatggttattatacttcacaggcacaaagttctaagtctgaggtctgagggagaattgtggttgtgcctctgtaagctgtgaaacgacttctttatatacttcccaagatgcctttcttccttcctgtgccatctccctggtgacatccagctctgctgattccatagatcctctcagactcttgaaaatgatggaggttgggagaggcatagagaaagggaggaggaggaggtggaggaggagggcttcaatgtaaaagccagaccaccccaagtcgattaataaatgcttcttcattgttgaccatggtgtcagctttcccatctgaaatagctgaaataaaagagcacaatgtcaggcaaacgcaactcgcccttgtttatgtcagaaaaagatatcagctgaggaaaagcattaacaaaaccaaaatgactagtttgatatctgaaaataaaatcaccaacaaggttataaagtatggtggtgatgaatgggaaatctatactccctcaaattgacctttctctcccgatgactgtaaatcactgtactctcttaaagctgcccagcatacaagagcttgtggcacgataaccttggacaacaacagcagcaccacttctctctcctgctcttaaaactgcagggttcagatgctctatttgaaaccatcactgagttcaggggcatggtggcctatcatgggttttctcccaaaaagcaggaaatgatagatcttccctcaaaactcagccctcataaatggctaggacttttgtgcagaggcaattctgaaagcaataactttctctaattcttccttacaatataacctaaagggcaataaggctgtctaatacttttgctcaaaactaaagatgattcacatactgcaattatatgtttgcttctctcctgacttggtcacagtttaaaatataatacctcaggacaggcatagtggctcatgcctgtaatcccagtgcctcaggaggctgatgcaggaggatcacttgagaacaggctgggcaacatagcaaggccccagctttaaaaaagtttttttttttaaagttacctgggtgtggtggcatgtgcctatagtcccagctacttgagaggctgagaagagaggattacttgagcccgggaagtcaaggctgcagtgagccatgatcaagccactgccctccagcctgggtgacaatgtgagaccctgtatcaaaaataaaacaaaacaacataaaatataacaccctctacttagaaggagctttttattttaaaaatcaaggcatcttccataaataatgtttcattattctctatgattgatatcctctctaaaagtcaatcataaattaatgtgacaataatgattcaataaatcattaaatactatgagttcattgcatgctataaagataaatgtcatctctaacctcagagaagtctcaggctagataaatcctattaataaatatttatcaagtgcctactatgtgccaggcagaaatgcacacagcatgctacatatcctaagcaaatagcattgggccttgccagttagatcaagccgcccctttgtgatgtaacgtcacctcaccttggggcatcccctgcactggggatgaatttctggtagacaacactggtagagcactcactcacccttcaatcctcctttttaaacactgggcatttcctgcttgtgctaaccatgagaaaaataaggccaagggaaaccattctgtcagccaaggacccacagagaagaaatgagaaaattgtgtgagaaacacaaatttatttgccactcaaccctcatctactgccttaattcctaacccgatggcatcagaatttttaaactatatattttgttagtttaacaaataacgatagaatcccacattacttttaaaaattttaaacaatatggaggtaaagcatagatttttttcatatcaaacatagacactaaaaaagaaagtaaaatagcaaattgctggcaggtacagcctcttgccatttgcaagtatcatgaaaaaaatatgtgaggtaaagacaacgttattttcaaacttggtaatttcccacaaaacctcgcaaaacttttttttttttttttttgagatggagtctcactttacctagaaggtaaagttggccactgatacatgaaataatatttaaaaaacactatggactggttgcagtaaacacatatgaactcaaacctaattccacttcccaactaggaatcatttatttatagaatacagaaagtaattttctttttttttttgaaatggagtcccaccctgtcacccaggctggagtgaagtggcgtgatcttggctcactgcaacctctgcctctggggttcaagtgattctcctgcctcagcctcccaagtagctgggactacaggtgcacgccaccatgcccagctaatttttgtaattttagtagagacgggctttcaccatgttggccaggatggtctcgatctcttgacctcatgatctacctgcctcagcctcccaaagtgctgggattacaggcgcaagccaccacacccggccaacattttattattattattattattatttagagacagggtctcactctattgcccaggctgaagtgctgtggtgcaatctgtgctcactgcaacctggaactcccaagctcaagccatcctccatctcagcctcctaggtagctgggactacaggcacacgccatcatgcctggctaatttttgtatttttggtagagacggggtctcactatgttgctaaggctggtctcaaactccaggaggcctcaagcaatcctccagcctcaacctcccaaagttgtgggattataggcataagccaccatgtacagcctcaaaactattttttaaatttagtttcttccaacttatttactctaaatattttttcctcaaaagctctcacagatgttatattcttcccaacattaaggaattttgcttaatttaaatttttcaaatattccattgtgctttcccaattttcagctcagttatgacttgtgattcaattatctgatgctttccattgtgcaaaagagagcttgtaattgagtcaggtagtccccaagctatggggacaatattaagcatttcttgagctatcacatgaggaccaagattttatgttagcttttgtttatgcctattgggatattttataatgtaaatagaatatctgaatagtgatcccagataattgcataataacaagctatcatgattaatcattactttcactttgtcattcttaatgaaattaaaatgggatttatcttccacttcctatgggatcttttccagtttgttttggttattcactctcctacctggagaccttggcatttcaggcggttattgagcatttacataactttcttttttcaaagcacttgagaaacaaactacatggtgagaccagtttgtggactagagagaattttaattgcatttttatcattatccccattagaactgaccatttccctgtattcacaattccactagagcctcataaaggagaatgctggctccgacaaagaaggtccctgctgctacaaaattaagctgctgaaatttaagcaaactcaaatattttagcatgccataatctcaataaccgaaaatgcaactcttgcaaagacgagtagggctggccatttaataactgtcttccaggaccccaatcccacgtctaagccatgggagcacctggatggtagggactcatttcatggaattaacttcttcccatgagatgtgtgaatgcacagtaccactgtgcttggggcctctgcaatttcattcccattccaatcctccatgtttctgatggtttattagttcatgccaagaattccatttccaactgcaattccagcccaagtgtatctccattttagtgccagttgagatacagaaagtagttctagttgctattttgtaaactgagaaatggtcaaaaacaaaatggcagctttgtggtgtatggatgcttctgggtgttctaattctgaaaacagtttctagaaataaaattttgcagattacttacaacttggacagatataatttgtaatctaagacccctgtcatgggcatttagaaacatggggattttattttctgcctgtttgaaagtctgggaaataaaacaaggtctattaataataattggaataaatgctatagcaccttttagttcaaccacagtttgtttgaatgcttgctgtggatgttcttgtgagggaaccaaactcttgataatctctttgggtgatgattagaaaatgctggttgtgattttttaaaaatatcaaatggattaatgataatcatctagaaataaggtcgtacttcattttatacctaagttgtgatgacatgaggcaccattggcttgattaccaggaagaacaccattcagattgtcccccaaccatctgtagacattcccaaaagcctccatcgcatatgcttgtgcacccacttgtcagaagcatacccatgctgcaccgccccggatttgcttcttttgtttctgctttcgcttgcctctgtttcctgcccatgaagctgtaggtgaaggcacacctccaccaccactcacagaagcatcaaccactagctcacaatgctgagtctggaggaaccaagacttcagtcattaaagtgccagaacttctctgggtcctgagtagactcagtcaagatgactgtctcctacctgtgggccatacatactcacttggacacaaatgacctgtgtttctgtggtctctcttcaacggttccagcttctgattatctccacttttccagggtttcaaaaaatcaatcacgtaaaattattccagcatactctgaccctcacacccagccaaaacaaacaagtacaatcttaagggatacatgaaaattggcaaccatactttcactttagtcctattatccttttttttttttttttacttccaagggtagggcataacaggcattacagctttctccttgttctcttggatgacttgctttgggagaagccagcaccaagtcatgaggatactcaagcagccctgtagaatggcccatgtcgcagaaagcaagccaagtcctcctactcagcactcatagcaagcaccagtttgacagacactgagtgagccaccttggaaaaagatcttccagccccgtcaaaggcttaagattactgctacctcagccaaaatctgactggaactcatgagaaatctgatccggattgtacagcctattttattcccaagttcctgacccacagaaactgtgaaggataaaaaatgttttttattgttttaagccgctcaggtgtgagatagggtgttatttatcaataggtaatgaatacagttgtttctgcttaatagtctttcatcagcaacattcagactaattttatcttcagggacatgattacctcaggtggcacatttgaagctcaaaaattaggcaagcttgtacaccaaaggacactgttcacagaatgaaaatccagctcacagaatgagagaaaaaaatgcaaatcatacatctgataagtgcttaatatccagaatatagaaagaactcctacaacttagcaacaacaaacacacaacctgattgatatatgcaagaatctatttctggaagagaagagagagcccagaaatggattcttcaaatggtcagttgatttacataaaggtataaaggtatacattggagaaaacattattttttcaacaattgatgctagaacaattagatgttcatatccagagaagtaaataaacatcaatctgtatcttgcaccacatacaaaaattaatacaaaatcaatcatagactttaaatgtaaaggatacaattataacatttctagaatacaaaaacaaagaagaaaaattttttgagattaagcaaaaatttcttaggtatgacaccatagaaaaaaattgacaaattgaacttcattgaaattaaaaccacctatttttcaaaggcactgttaagagaataaaaagacaaggactgaaaagagatatttgcaaatcacatttctggccaaaggtttgtatccataatacataaagaattctcaaattttaataataagtaaaacggcccaatttttaaaatgggtaaatgatttgaaagacattttaccaaagaagatactcaggtggcaaataaggacatgaaaaaatgattaacatcattagtcattaggaaaatataaattaaaaccacaatgagatgctactgcatgcttttataatggccaaaattaaaaagactgaccacaccacatgttggagtaactggaaatctcatacaatgctaatgggaatgtaaaatggtacaaccactttggaaaacaattcagatttttttaaaagttagacacatacctagagtacaacctagccattccacttcaagatttttatccaggagaaatgaaggcaaatgtccataaaagacttgtacaagactgttcatacagctttatttgtaatagccccaaactggaaacaacccaagtgttcatcaacaggtaaatggagaaacaaattgtagttttttcatgtgatagaatacaataagaatgggctgggcacggtggctcatgcctataatcccagcactttgggaggctgagacaggaggatcacctgaggtcaggagttcaagaccagcctgaccaacatggtgaaaccccgtctctactaaaaaaaatacgaaagtagccaggcatggtggcatgcgcctgtaatcccagctacttgggaggctgaggcaggagaatcacttgatcccaggaggtggaggttgcagtgagccaagatcacaccattgcactccagcctgggcaaaaagagcaaaattccatctcaaaaaaaaaaaaaagaaaaaaaaagaatactataagaatgaatacatgcagctgcagctacatggataaagatcaaaatacttatactaagtgaaagaagccagacaaaaagagcacatactgtatgattctatttatataaaattctaaaaaatacaaattaaactatagtgaaaaaaagtacatcagtggttgtctggggacatagaaatgccacagaaaggagatcgggaaagggatttcaaagaggcataaagaaacctttgcaggtgatggacatgttccttatcttgatagtgttgatgattccactaatatagtatatacatatgtcaacatataccaaactattcactttaaatatgagcagtttcttgtatatcaactattcctcgataaagctgatttttaaattaggcttaccagcattttttaagacacattgttagctcatttggggtttttgtttgtttgtttgtcttatatctaaaggctacattaaatgccatcataaacaccaccatagatatccaaaatatttgggcaaaaatacaatagagatataaaatcaaagagaaagctaacccttgttcatgacagcccaaagaagataaccacctacaaacagctcacacagccttggggaagaaggaaaaggaaattgcctgtcagagaagctctgtttgtaggactagattagcctcctctccttatgctgaaagtttcccactgacttcaaagaagtgctcagatcagagaaaagtagagctaggctgaataattgtagtgaggttggggctgccttaaagacaatctcttttgagctgtacccatgatgacattatcatattatcaatgataaaagggctgtggggtgggactactgagccacaaaagcactcttaagcatcaaagaggagacaagaaatacattcaaataaaagcagaaatttaaaatcatgggatatggatacacctccttgctgtaggagtgactgtgacaaattagaaactgtttctgtttgggactggctttactagttatcactagttttggggaaaaagcgtgtgtgtgtgtgtgtgtgtgtgtgtgaagaaagaggattcactataacacaatccaccataatacaatagcttaatattgacacaagcacaatttgagaagcgggatcttgccaggacacatgtaataatcacaccttgcacaaagaaatagaaacactctactgaggtaagatggcccaaataatacaaatacagttgactcccaaataatacactgagaaactgaacagggattgaatagtctagcagtaagatctaaaatgttgctggtaaaaataataataattagtggatagatttatgcagtttcacaagccagcaggaaaaattgaactatctattttcctcatgctgtacaccaacagtgatcagtcaagctggaaatctgttcttataaactgagctagaaatgtcatttaatgttcctggtaaaatatcaattcaaagacctgacgtgtattagaattaaggaaagatttagtgttggatagcacaaagaaaacaagactagaattctaaagacctctaatgaaaggctgaatgtgttgataaatatttgagcaacacagaaaagagagattaatgccagtttgggttgaatagaggaacatttgtgacacacaaagaaccacagacaggtgacataaaaatagagaatactgttaacatcttgtacacagaagatgctccaaacaacagtttctatgtggagaattatcctgttcagcaatccattttggttatggaaaagcagccaacatggtttgcccaggataagcaaggacaaacaatgagaaagatgaattgccgggcacgaaaagggagaagaaattttaacattctggtacagccccacaaaagagacgtaagagagagatttttgagttgagcagaaccatggcaggaagctaaaagacagaaggaggaaattttagccagggagaaattccctttagcagccaagggaaaagaatccaaggggtcaaatacttcatcttacattatcatctatgctgttttgttatctaagtctctgctactgcctgaaaatcttcagtaaaagttatgcccagttgatgcaccgagagacatttgagagatgagggaaaatacctgtgcaccccaccccattcaagtctctgcaggacagaaggtagacagcaagctgggggcaagatgccaggaggagagagggatcacaaacagaaaactgaagtgaaggatgaatgtgtgaacacccctgggaatccacagaaatcttcaggaggacagggacatgcaatttgaggttaaagtatttttatttaaacctcaaaaaaacaagaactccagctaacacctggctctgtatataaggcaacctctagagatgcaacatctgatagttcaagagtaaatgattacatgtatagatctcccggcattcatgcttgactctttctttccccttgataaattttttttttttttggacatcttagcaggtccaccaatgtccattcaatctcagagaaagataggactactcagattgatttattttctcttttaccatctctggcacaagctgttattggaatgtttccatttcatgattctgcacatgtttacacagccgtaagtgttcaagtgagaaacattgctttgctcctattccactatctctgtgtatgtgaatgtgtggtatgcgtgctcctatataaataccctgacgaactccaatgagtatatgattttcctatttcctggagtgggtcaatttattgtacagtctataaaagaccaatgaaactctctttttgcaactgtttgcaatatttctcagctgtggtaccaatgttttccccaaaactaagtactgatttatgattccagtgacaaactaacacaatgttttattatttccagaatactgacctcagaaagattttatttggccagccacctggttagttgaggagtgagggctattccttgaatataataattgacactttagaaagtttctcctgatagtaaattctggagaacaggcatctataatccaaaatgtctaatgagccaatggggacattagagaatggtcaggatgttttacttatgtttaaatgtttatgtaacacttatagctagagggaaacttgttattgccatctttgcaattattatgttgtttctgttttaccatctcttgtaaaactacagaaaaggaatcgatgatttcacatgatccttggaatatgtccatgatccaactgcttgctttggagtggtttttttgaggggggcttttttggtttgatttttctttttgctgttgttgttgctgttttgtttttctttgagacagagttttgctttttttgcccgggctggagtgcagtggtgtgatctcggctcactgcaacctccacctctcgggttcaagtgattctcctgcctcagcctcccaagtagctgggattacaggcacctgccaccagcctcgctaattttttttttttttttgtatttttacataaaaatagagatggggtttcaccatgttggccaggcctggtctcaaacacctgatcttaggtgatccacctgcctcagcctcccaaagtgctgggattacagcatgagccacggcacctggccattttggagtgtttgagaaatcaacacacctagtgtgtttcaacttgaaaaggacacgatgatgcagagctacctggttagttccctagttaactatactaaagcctacttgacccttggtgacagctttccaacatgctgacttctgcctcttttacttattgatattgcctattctggttagcatttatcatgatcctctgagccttttcccattgactgcaccggaattagttagttcctctatgagttttgcaataattgccatatctatttcaaaaatccaaagcaacaatttaccatttagcaacagcacttgttttcaattgttcccatttcagtgcttttatcaatagatacatacgcacactatgaatttgttcacattcatttcatcatatggtctttcattaattcaatgattagcatgtccagatgagcacacacgtttctggaaccacacaagatgctaggtcttttaaggcaaaaatagatctatccctaacttcatggcacttatggtctgaaagtgcttacttatccaagtcaaaacagagtcctgagggacagatcttttctgcaagctactagaattttaaaggtatattttttcttaagaaaatcactttctcattattactaggtcatttgcttctgctttttgctattccccaactgtattcattttcacttatcacagaggtgtaaattgatgaaaattaagtatttccactttatttaatattgcagtttaggggaaaagatggtaactacagcctaaaatcaattttgaatataaagttttaatattatcaactagtttttttttattctaatcctcattaaaaaatttggcctagcggggtgcgctggctcacagctgtaatcccagcactttgggaggccaacgcgggtggatcatgaggtcaggaaatcaagaccctcctggctaacacagtgaaaccccatctctactaaaaatacaaaaaattagccaggcatggtagcacgtgcctgtagtcccagctacgtgggaggctgaggcaggagaatcgcttgaagctgggaggcagaggttgcagtcagccaagattgcaccactgcactccagcctgggcaacacagtgagactctgtctcaaaaaaaaaaaagaaaaaaagaaagaaaagaaaaagaaaaaagaaagaaagaaaagaaaagaaaatgtggcctgaggacaagtaaaatagaatgcatttcatacagaatgtttgtcaaaatgaaatgaaaatagtaagatgatattacagactcacactgagtttttatgtatgtagtacagtgccatcccacagcaggactctcaagacatcatctgtttcctttctggtccccaaatgaatcaggcaattccgaattggtggcaagggctagaatattacaaaaccatgttgactctgatcatctgtctgttaaggtaaactggagtccaaggagtagaaagcgttatgggccaggcaatgctgacgggatggtagggtgcacagcaatggcaagtaataatctctcagggaacaattctcacagtctcaaggtcattagcctatcttcctatctatgcacccaggcaccttagaaagaaaggaacacagagggaactgagaaatcagagctttctttgtggctctgtctcttttctgcatcttactgggttaacagagcccttcttggtgcccaccgtccaccaaaagcacccaaggagtgcacagagaatgaagagcagggacaaggtcagacaggagagacctgctgggagacactgaacacacggagtggatggagcggagtaagaaaatgtacagtctcattaggaatgaggtaccaatgatggtgtctccaaatccagcagacctctgggcatagttccaggcctgaattaggattttgtagtcattttcaagataaagcacttttcctaaatatcactagcttttactttagtcacctatgtctggttctcattaaagttcctgaccattgcagtcattttatcttctaagtgcaagtgagaaacaggagtgggtcaatgctcgcaccaactgggcacttgaaagaagaatttgaacaggacacaagaagtagagactaagggacaccagcctatgaaaatgtactgcagcacatttaagctggaggcatcaaaactggtatcttctacacaaatgcagctgttctctctactgtttagcaccatagagcctgaaggcacatcagagagcatctcatctcagctaatgcctttcctaaaggccacagaagagttccattaatgtgtggccagcccaacacccaggctctccaatttccaatcctgcaccctttttgcagctaataatagctctactatttgtggtacctattatgtgccagagacttattctaagtgctttacgggtgttgccttacttaatcctacagccacccccgtgatgcaggtatgtgctactgttgccattttcaggtgaggaatctgatatccagcatggatgagtaacttgctcaattccaaagctgacaaaagggctgagcttcctacactgaatccatacactctcctacacctaagatccatgcttattccccaccaccaaccttctgcttccttcaccccagggacacatctgtggaaaagactggctacttggtgcttcctttagccccacttcatcatgcagtaaagtactaatttctgattgatatctgtgttgcacacatagaacatcagaacacacagttttaaatgtacaaatgctcggtgatctctctaaagttgggggaaaagaataatagcttgtttgtcctcattctttccaagattcttgtttctggaaatgctttaagcaatttaatgcctgagaggaatgtcattctctccagtttcaacacctttagtttaatgtaaaaaataaaaaatgtataatcatgaaataacagagggaatgagaaagctgatgtaatagtgagctgaatctttactggctctgataaattaactaccaaattggcaattgaaccccatgccagaagtagaaatgtgtgtgaagccacaggctaattatatcataccccttgctgttactaaaactctcattgttcataaaccaccaaccagggctgcctgaggttgccgctatcttttccttttcttttttcaatttctggtgcaacaaaaaacaccttttgaatgaataaaccaataaatgacatttttgttttcctgctgcacagaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggaggtgaggaaaggttgcctgaaacctgcgcctacctatgagactgtgtgcctcccccatagcctcaggtggtgggagggactgctaaaaccttcacttttaccctgcagccaagtagcattcatttaaatcatctcaaatacatgaatgttcaacctctttttagcaattactagatttagcttcagagttgatagcctaacccagaattagtgaccactgttgattccccagatgatttttgtttgtttgtttttgtttttgtttttgttttttttgagatggagtctcgctctgtcttccaggctggaatgcaatggcgtgatcttggctcactgcaacctccacttcccaggttcaaacgattctcctaccccagcctcctgagtagctggaattataggtgcacaccacgacactcagctaatttttgtatttttagtagagacggggttttgccattttggccaggctagtctcaaactcctgacctcaggtgatcctcctgccttggcctcccaaagttttgggattacaggcatgagccactatgcctggccataaatttttaaaatacacctagaaaatatttttatttgagattagggaaatcaccatcggcgtttgtagagaattgatatatctgtcatacaagtgcgtaaatatgggcacctgatatacgtgataaaaaccctctgtcctggtgcacagccttgctgctattggtatatgcaagtacaaggcaatgaggggcctggctattttcccctccaggctatgctatgcagagtcatgaagaaatgcatttccataatatacagaactgtgacacaggcagccacattgattctttaaataagcaccaacctttccacctctgaacacttctattcagtggaaatagaatggaaaaagctaaatagccccaggtcccaaatttaaaatatctatcttttggcatagaaaagactattgcactgggttcggttccattcaatactgttgctatagcctttctccgtagaatagagtgtgctaaagcaggactaaaattggatagggtggatttatcctagcaattcaacctgctcttaacagaggatatcgggggaaatgcatgaaggctagatgttcacaccgtcccacttctccagcctttcagaaatcaagagttgattgtctcgcattgtggaagagtatcatcagtgtccttggttttctagtctctgaaagaagatgccattgcctagatagtgtctgtggctgcagagctctgagaaaaggctaccccagggcatggtaggagaggccagaggactcaggcagtgttcctgggtgagctgttccagatccctgtagaagacgtgttcagcaagtcacaggtgcactgcttgttgtgttcagagggtcactcttcatacctgggacacccaggatgaaggaaagagtcaatcctgccactacaccctccatctcctcatggtttttgcatgtgtatgtcatcctgacattgtctgcttaattcaagttattaatttggtctcatcctttgcatcttaaacattttattaaaacatccctagaatattagtaatattagcctgcttgtattaatttaactgtctaccacagactcaattcacagcagtggaaatttgaaaagaattttcttaatcctaacgtgttggaaggcatgggaagtgagttccttctacagttttttttgtttgtttgttttttatgtataaggttctgtttgtcatctttctatgatgattcaaatgctgtcctgcctagtgactaagaaatacacttgaagagcccacagtatcattgtgtgattcactacagggctaaaatctcatcaatcttttatctgccttatgtggatatgtgaatttttcttcctaccagttactatgttctgcaaactgcaactggtcacatttttcccacagtacctgattaaaccataacctgaatttataagcaccttttctaaatagactcaaatcttccactcagtttctaggaaaggtacaaccttccaggaataatcaaaatcagaaccatcttaagcccaagtaggcgatgccagtgtgtttatatctattaccctagattgcctcatacttttacaacacttgccttatccctggagacatttgcattcattatttccggcttaaacaatgagacgttgagaagatcagattttttatttttcccgagacaaggatttgctctgtcacacaggctggagtgcagtggcatgatcatggctcactgcagcctcaaactcttggactcaagtgatcctcccacctcagccttctgagtagcccagactacacattcacaccaccagtcccagctaattttttaaattttttgtagagactaggtctcaatatgttgcccatgctgatcttgaactcctggcctcaattattcatctcacctcagcctccccaagtgctggaatcgcaagcatgagccaccacacccggcaacagatttttttttcttttttaacacaaatggcaaatttctttccccaaagcctcagaacagtaaacaaataaaggtcatatttaggtttaggaaagaagaaaatggggacatagtttatgggccagttgcattcagttgaatttgttcggtgaagatgtgatgcatagcaagaatgaagacatagaggatgggaggaaggcaagaagaaaggaaatcaataaaagacaagggtttgcactgttaaatactagtttttaaaagtatctaattctcagggagaatagatctctgagagtataagtgaaacatgtacatttaatgcaggaggcaagtgaaggatttgaaatgcagcttaatcaaaatgaaataatgaaaaaagattattttctaactctaggtgggtaataatatttttaagagtggctaggctgggcacggtggttcacgcctgtaatcccagcactttgggaggcagaggtgggtggatcacctgaggtcaggagttcgagaccagcctagccaacatggtgaaaccctatctctactaaaaatacaaaaattagctgggcatggtggcatgtgcctgtaatcccagctactcgggaggctgaggtaggagaatcgcttgaacccgggaggtgccactgcactccagcctgggtgacagagtgagactgtctcaaaataaaaagaaaaaaaaaaggataaaaaattattaaaagtgcagaatatatgtgttgagcaacttaatctctgacaaaaaaaaagactttcaaaatgttgacacatgcgatttcttttgcctttcagaggatttcttaaaataagctttttattttggaataattttaaatttacattcttctaatgttaacattttatatttactttcactcgcgtccctgtgaagacaccaccaaacaggctttgtgtgagcaacaaggctgtttctttcacctgagtgcaagtgggctgagtccgaaaagaagggagataggggtggggccgttttataggatttgggtaggtaaaggaaaattacagtcaaagggggggttgttctctggctggcacgggtgggggtcacaaggtgctcagtgggggatcttctgagccaggatgagccaggaaaatgaatttcacaaggtaatgtcatcagttaaggcaggaacaggccattttcacttcttttgtggtggaatgtcatcaagttaaggcaggaaccagccatctggatgtgtacgtgcaggtcacagggaatatgatggcttagctttggctcagaggcctgacattcccatcttcttatattaataagaaaaataaaacaaaatagtgttgaagtggtggggcggcaaaatttttggggggtggtatggagagataatgcgcgatgtttctcagggctgcttcgagcaggattaggagtggcgtgggaacctagagggtgagagattaagctgaaggaagattttgtggtaaggggtgatattgtggggttgttagaagaaacatttgtcatatagaattattggtgatggcctggatatggttttgtatgaactgaaaaactaaatggaataagacaaggagaaaaacaggtattaaaggactaagaattgggaagacctaggacatctaattagagagtgcctaaggagattcagcatagccctgccagcaaagattatttatttactttaagagggagtcaagagtggcggtttggggatagcaccaggagatatcagctgtgatggcttggagaagcagtgaaaaccggcagtttttctgagaacagtgaataggagtatgactagacagaagacagtagggatgacaagttttttggggcacagtccaagttggtctggtgtctggaatgaggctggggcctaataaaaagaagcgtctatacaggagctcaaatgggctgtaccttgtagcattctgaggacaggcctgaattatgagaagggaaagaggtaaaagtattgtccagtcctttttaagttggaggctgagcttggtgaggtgtgtctttaaaagaccatttgtccattctacctttcctgaagattgaggacagtaagggatatgaagtttccactgaataccaagagcctgagaaactgcttgggtgatttgactagtaaaggccgatctgttataggactgtatagaggtgggaaggccaaaccgaggaattacgtctgacagaagagaagagatgaccgtggtggccttcttagaccctgtgggaaaggcctctacctatccagtgaaagtgtctacctagaccaagaggtattttatagtttcctgactcagggcatgttgagtaaagccaatttgccagtcctgggcgggagcaaatccccgagcttgatgtgtagggaagggagggggcctgaataatccctgaggagtagtagaatagcggatggaacactgagaagtgatttccttgaggatagatttccatgatgaaaaggaaataagaggttctaagaaatgggctagtggcttgtaacctacatggaagaggttatgaaatgatgacagaatagaatgggcctgtgtggctggaaggagatattttcctcggtctaagaaccatttgtcttgtgtgggaagagactgataggtggaagtttcagcagggcagcggggcagtaggtgggagtggtcagatgagaaggagaaaaactgaaagtgaggaatagaagttgcaacgctagctgcttttttagctatcttatcagcataagcattgtcctgagcgataggatctgatgccttctgatggcctttgcagtgaatgactctagcttcctttggaagtaaagcggctttgagaagcgtttttattaaagaggcattaatgatagaggacacttgtgtagtgagaaaacctcttgcatggtggtgcaggatatggaaggcatatttagagtcagtataaatattgacgtgtagtccttttgcaagagtgagggcttgatttaaggcaatgagttcggcttgctgagaggtagtggaggggggcagagcagtagcctcaatgatagatgtggaagataatatagcatagcctgcctttgctggtgagtggtgattaggcctggtggaactgccatcaataaaccaagtctgttcagggtgaggaacatgaaagaatatggggaaatggagtgaatgtcaggtggattagagagatacagtcatgggggtcaggtgtggtatcaggaataatgtaggaggccggattgaagtccgggccagaaacaatggtaactgtgggagactcaacaaagagtgagtacagctgaaggagccagggagcagaaagtgtatgtgtcaggtgtgaggaagaaaatagattttggaagttatgagaactgtagagaatgagttgagcatagtttgtgattctaagggcctctaaaagtattagggcagcatcagccgctgcacgcagacttgagggctaggcaaaacagtaaggtcaagttgtttggataaaaagcctacagggtgcggtcctggtccttgtgtaagaattccgactgcacagccctgcactttggctgtgggtaatggaaagggttgggatgagtcagggagagctagggtgggggtagtctctaaagctgtcttcaaggaacagaaagaggagtggggaaaggatttaggatctgtggggtcagctaggtttccttttgtgagtttatataatggttttgttaggatggcaaaaccaggtatctaaagtcgaaagtatccaaccatgcctaagaaggaaaggagttgttgttttgtagaaggtgttggggtttgagagatcagtcagacatgatcggcagggagcgcacgtgtgtttttatgagaattatgtcgagataggtaacagatgaggaagaaatttgggcttgactgaagtaatgggggctgtctgtgaagccttgaggcagtacagcccaggtaatttgctgagcctgatggatgtcagggtcagtctaagtgaaagcgaagagaggctggggtgaagggtacaaagcaatagtaaagaaagcatgtttgagatccagaatagaataatgggtttgtggagggaggtatttaggataggagagcatatggggttggcaccatggggtggataggcaaaacaatttggttgataaggcacagatcctgaactaacctgtaaggcttgtctggtttttggacaggtaaaatcggggaattgtatggagagtttataggctttaaaaggccatgctgtagcaggcgagtgataacaggctttaatccttttaaagtgcgctgcgggatgggatattggcattgagtggggtaagggtgattaggttttaatgagatggtaaggggtgcatgatcggtcactgaggagggagtagaggtgtcctatacttgtggtttaaggtggggagatacaaggagaggatgtgaaggaggctttgaactgggggaaaaggtggcaatgaggtgtggctatagcccaggaatagtcagggaagcagataacttaattaaaatgtctggacctaataagggagctgggcaggtggggataactaaaatgagtgcttaaaagagcattgtctaagttggcaccagagttggggagttttaagaggtttagaagcctggccgtcaatacctacaacagttatggaggcaagggaaacaggcccttgaaaagaagctaatgtggagtgagtagactccatgttgattaagaaggggatagacttaccctccactgtgagagttacctgaagatcggcatccttgatggtctagggggcttctgaggcaatcaggcagcgtcagtcttcagccgctaagctgagaagatctgggaaggagtcagtcagagagccttgggccagagttccaggggctctgggagtggctgccaggtgagttgaacagtccgattttcagtggggtcctgcacagatgggacatggcttaggaggaatcctgggctgcgggcattccttggcccagtggccagatatccagcacttgtagcaagctcctggaggaggtgggcctggaggaatgcctgcctgctgcggtttaggcgtttggaagttcttgtgtgctggagatgtggctggggtttgtctcacagtggagggaaggaattgcaactcagaaatacattgctacttggctgcctctactctattattgtacaccttaaaggtgaggttaattaagtcctgttgtggggtttgagggccagaatttaatttttggagttttatttaatgtcaggagcagattaggtaataaaataaaatgcatattaagaataagacggccttctgacctttcagggtctagggctgtaaagcgtctcagggttgctgccaaacaagccaaaaactgggctgggtttttatattcgacgaaaaagagcctaaacgctaactgattttgggaggggtcagataaagaaaaaggagcattaaccttgactatgcctttagctccagccacctgtttaagaggaaattgctgggcaggttggggagggctagtcacggaacgaaactgtaagccagaccgggtgtgaggaggggaggtgataaaaggattatagggttggggagcagaggctaaggaagaattgggacctggctcagcctggcgaggagcagcctggggaggaggggagaggtcagatgggtctgtagaaaaggaagattagaaagactcagcgacgcttggggttgggattgaggggacaggcaggagggaaagaaggaagatttgggataagtcgcattgggaacagagactagggagggaacaatgtgtaaaagaatgcctggacaccaggcacctcagaccatttgcccattttacgacaagaattatctagatcttgtaggatggaaaaatcaaaagtgccattttctggctatttggaatgactgtcgagtttgtattggggtcaagtggcattgtagaagaaaataaggcatttaggttttaggtcaggtatgagttgaagaggttttacgttcttgagaacacaggctaaggaagaaggaggaatggagggtggaaggctgcccatagtgaaggaggcaagcccagagaaaagagagagtagagacttggagagaaagggtgggggtgcttgccctccaggaaagtggagaaggggtagagacacggggagaaggggttggggggttcttgcccaccagaaaagcggagaaggggtagagacacagagagaaggggtgtggggtgcttgccctccaggaaagtggagaaggggtagagacatggggagaaggggttggggggttcttgcccaccagaaaagcggagaaggggtagagacacagagagaaggggtggggggtgcttgccctccaggaaagtggagaaggggtagagacacggggagaaggggttggggggttcttgcccaccagaaaagcggagaaggggtagagacacagagagaaggggtggggggtgcttgcccccccaggaaagtggagaaggggtagagagagagaaggggtcggggggttcttgcctcccagaaaagcagagaaggtgtagagacatggagataaggggttgggggttcttgcccccccagaaaagcggtacttgctgctaagggtgaaggaccaaggcaggcgtccccacgtggtcagacgcctctgaaatgtgggtgaataatcaggcaggcatccccacgtgattacacactaagggaagactgtcttcccaagtccgtgaccggcaccagagttttgggttcacgggtaaaacgtgtctcctttgtctctatcagaaaaggaaagaaattgaaattaagagaagggagagattgaaagatggtgccaagattgaaaggagaaagaggttgagggatagtgagagaggctggagaagagaataaagagaggctgcttaccagattttaaattggtgagatgttccttgggctggttggtctgaggaccagaggttgtaggtggatctttctcatggaacaaagagcaggaagacaggggattgatctcccaagggaggtcccccgatctgagtcatggcaccaaatttcacgcatgtctgtgtgaagagaccaccaaacaagctttgtgtgagcaacaaggctgtttatttcaccagggtgcaggtgggctgagtccgaaaagagagtcagcaaagggagatggggtggtgccattttataggatttgggtaggtaaaggaaaattacagtcaaaggggagggttgttctctggctggcaagggtgggggtcacaaggtgctcagtgggggagcttttgagccaggatgagccaggaaaatgaatttcaccaggtaatgtcatcagttaaggcaggaacaggccattttcacttcttttgtggtggaatgtcatcagttaaggcaggaactggccatctggatgtgtacgtgcaggtcacaggggatatgatggcttagctttggctcagaggcctgacatttaccacattaactgtggtatatttaatcaagctaagtaattaacattagtataatactattaactaaacaagactttattcagatttcactagttttttttgctaacgtcctttttctgttccaggatccaatccagtatctgaaagagctttttagtttcctataaactttaaattaattgtcagaatgggcggagttcctaaataaatgtaataagtcaattattattttagtaagaaagtgaaaaggagaatgcagactcggtggttctttttaagcatttatgggaaggaaccacaaacctccagcaatgtaaacacaagattcctttatgggagatctgggccaagaagcagggcaactcaccattttatgcacttgtacttggaacagttttccacctgcttgtctgcgccagcctgattctgggtaaacaatgacgtgcttaggcaatttttggctctggtacttggaactcagcttgtaaaggatatgttacagaccataaacagcctataaaccgccactcatttccctgacaaattcagctggattactgcacttgtctcctggctcatctccctgcttctgcctgccgcgcttcggtttattctcaacacagtccacttaaaacaaactggagacgaggccaccactcctccattcaagctttcactggctgccatctatttctaggtaaaaatgaaagtccttacctataagattctaaacaatctgacccctgttgtgtcccctccaacctcctctctgactcctcaccccctggcttcctcctctcagggcccactgtcctcgtcaccagtcttcacacaggccaggtcagtctgacctcagcacctttgcatttactattcctgcagcttagaatcctccagtctcagaaatcatatggctcccgcccttacttccttctggtcctcactcaaaaattcatcttctcagtaaggtcttccctagtcatcctatctaaaattgcaacaacacccacacacatccacatgcatacttaaacactccctactccctttcctcctttatttttctccctagcatccatcactatataacaagccatgtaatttatttttttatcatgtttctcatctatctctcccactagaaagtaaactcggtgacacaaggattttgttggtttgttgtgttgctactgctctttcgcagaaagacatagtgtctagcatatagtaggtgcttcataaatatttgttgaatgaatgaaagatgaatgaatgggggatcctggctccctgttgtcccacctgccattcacagctttgcccacacacctgtgtgtgtgaagccaccccagggcacactagacagtcactccctccatggccacacaaagtccacttctttggaaagctcggccagaaaggcagtttgagtaatgactctcaggtaactgattctcatgaacagtcgggtctgtggtccatttgatagttaaacaagttacaaaatattccgttctgacatcctatggggaagaaggagaaactccaaaagttaaaagcctctgttcagcaatttccaaactctgcctaccagcttcctacttaaaaggcagaagagattacagtcatatctgatatagcagtactctccagaagtcattccatcctctggtaggcaaggagagtgggtagagtggggaggtgatgagtcccagagagaataaataggattctgaaccatggaataaattgaacagccctcagtgctgttcaaatagaagcaatgtgctttcccccatgctatgttggatagggtaagaacaggtttaaagtggaaaactattcttaaaccactcacatatggagtgcctctttttgtgtcaagatgctaaatgaaagaaactgaattccctattattttcgccttctcctccttagaattcatgaatttgctaaagtcatttagagtgctcctttatagtctaaaaagaagagttctgcagaattctaaatatcatgtgtaagaaggaataaaagatgtaaaatagacaaacgtgtcttttccaaccagtgccataaattcttttaagaagtgtctgcttactgtcctcaatgtgccaatctgggtacatccatttgtcaccttgcgattgtgcaaactttttaaaaaatctttattttaaaaattcatgtcaataccgaactacctaggctgtttatttgaattccttcctcaagattaatgtcaccccgaattgtggaacattcacaaagacaggcaccctaaataattccagttctcctcttctgctgcaggctgctgttcttaacttcttttcacctgcttgcttctttcttctaatgttctggcagtgcacaaggcttttcaggtttctccctatcagcttacacgaaaggaagttcaacactaggagatgcattatctcaaagaccatctgaggatgcgatgttgtctctttcaaagaaattctgtgtgagtgctgctgatgtgtgatgcaggagtaaaaagcaggtgctttctgcacaacgagcgaggctccctcacattcttttgggagagccaaagccaactttcctgaattcccctgcaatctagtctcacaaccaggaaagctgcaaagtgagattgtcctgctatttccctggcaactacgcggcaaactgcctctgccctttaagtgctatatctcatcaacccagatctttaaattaagcactcattcagagatgatttatcattcagactgtattagacttgacttgatctgtcatttattttctcaggcagaggcagtgctggtacactatgctaagtcatctctctggggctcaaaaacgaggttgggaaaaatgtaagaacacataaagaactgcattaccctctcaaatatttctgtgctttctgagttttcaacattgagacagggctatgaagacaaacctaaagtgtcctataataaacacaatttgtccaggcgcagtggctcatgcctgtaatcccagcactttgggaggctgaggcaggaggatcacaaggtcaggagattgagaccaccctgtgaatggtgaaaccccgtctctactaaaaatacaaaaaattagctgggcgtggtggcaggcgcctgtagtcccagctactcgggaggctgaggtgggagaatggcgtgaacccaggaggcagagcttgcagtgagctgagattgcgccactgcatccagcctgggtgacagagtgagactctgtctcaaaaaaataaataaaataaaaattaaaagtaaaaattaaaaaaaaaaaaacaattttaattccacattcccagacgagcaaattggacatcttagtgccccaacagtggcaatttaattcaagtcataacagaattagaggtgcttccgagttaaccaatattttttttcttctcctgtatggcatatataaatttggcaaacaaaacattctgtcttatctttctgtttattttataaacatatgtatttgtatttgatatatgttaacacacataaatatatacttttttggatttgtgtgacaggagtccatgacattttaagtgtatgttagcctactcatcaattcatcttagtatttaattttcagtgaaaattagtgcctttctaattccaagaatgacactaaattaatagaatttaaatagaatgaataaaattaatctttgccaaaataaatcagttgggagaatgttagactgaaaaattaagagaattgaatagaattcactgaactatcatagcaaaatttctaatccacagccttagaaagttagcatatgtacaaaaattcaatataatttttccggtctcggacataggaatacctccaccctaccaatggggtgacatagtgacctgctggcttctgtgataactaagagtggcctctacagtggcaactgccctcaacttgccttaaacatccagtaaccatccacaagctggtggacaagaatagcgcagccaattaaaaaggagcaacggaggttcctggggtcctgggatgaaattttttaaaacagggagtcgatctttttttttttttgagatggagttttgctctgtcacgcaggctggagtgcagtcgcatgatctcggcttactgcaacctctgcctcccgagttcaagcgactctcctgcctcagcttcccaagtagctgggattacaggcatgcgccaccacgcccagctaattttggtatttttagtagagacggagtttctccatgttggccagactgatcttgaactgccctcaggtgatccacccgcctcggcctcccaaagtgctgggattacaggcgtgagccaccgcgcccagcccagggagtcaattctaagactaatgccagtatgcattattgggcttgaaatttgattttaatcatctgcaggcaggcaacagttaaagatgagagccaatattcctctaagtgtccttgaaatgtagtgagccgctgtgttagcagcaggccaccgtgggcactgccccaagctctgagaagtgtggtgactgtgccgctaaaaggtaagttgtctcttacattcacaggagagacctttttagcaacctcaaggtcatcggtcagtcttagattttgtaagcaacccaaaacatagctacctctgtcgtggtttgggaggtgtgctccccatcggcctccgtggctaaattctttctccgtgtttcattttctcacaattatctccgtgtctttgatccacttgattgcatttcctcctattgactttaggagatgcaggaattaacgtttaccttatatttccaaagttctctgtttgtgtaattgataacctagttgtattttgctcagccttcacttacattttcccttagaccttttcctttttatagagcttgcatggctctttgtgttgagattttattgcccagtcgaaatgatgcctgatcaatttctggaaaggatggcctattgtttaggcccattccaaagagaaactaaaataacaagataatctcaggaggagcttaattttctataccaatctctagcacaggaaggacaaatcagctttttcaagcttgttttagactcaagtcttccagaactaatcatacacattcaaactctttgcctatgcttttttttttgtcagaattgcatacaaatttgtagcaaatacagaagtcttccattatccatggtctcactttctgcacttttgcccaactatattatgaagtcccaactataatattaggggacttcatgatattatattattttggaacagagagagagagagaccacattgacataacttcattataatgtagtgctataattgttgtatattattatagttggtattaatctcttactgtgcctaatttataaagtaaactttaacataggtacgtatgcataagagaaaacattgtatctgtagggtttgatactatctgtggttttaagcatccctgggggtttggaatatatcctccaagaataacgggggactactgtagttttgttttgaatttcaatactcaagtacttccctgttgaaaatgatggaatgatgccagaaatagaaaagctacattttctacaatattctttacttagaatatattagcatttctgatgctaaaagcatggcaacgccatgcttttgtttaatcatcaagaccagacagaacattgaggatagcaaaagaaagaaacaaacaacatggacatgatcttacataaaactgatgacaagaaatccctcaagtactacagaacataggttagtgtcaccaaaacatcagacagcagcagatccagtgtggggccaggagagatgaagaattggtagaaaagaaaaaggggagtactgctacttctccaagaagagtactcagaaatcaacaacaagcattcacgcccaataggagaagagcctttccagaacaggaatgaaagcaatcaaatctgcaccttaccagtggaattaaaagaccctctcacaggctccaagctgaggccaatgcaaagagaccatagggaaccagtaatgtaaaccatgctaacgcagagttaccctgcatatatctgagaaacactccaaagtactaccttctggaaagacagagactcatcctctcccctcctccctctacaaaaaaagaataagaaatctgctgtgaattcaatctaaaatataacactgaggaagccagcaagacaaaagcttccaaaccagagaaggaggtatcagagatagatctcagaaagtacagaatgacaaacacattcaaaggtaacaatactgctttgaaaggaaagacctttagaactctagacaacacagagttagagcaggaagtttttgtgaaccaggcagagccctaagagacagagaagtgcccctataaaaaggccatttttttaatacttcacagtaacaacagagaagagagccctacacaagaatcttcctctaatagtccaagaaaattatctcatttatatatgagattgttcatatatggaaaataaaagcagtttacaataaaaccccatgctgagacaaggataaagataagaattaatcaaatatagttccaacacataaaaatatactacaaaagtggctataaagaagatgaaaactacaacattagatttcaaaatgagctaaaacaatcttaaaactaatcaaagcttgaaagaaccatacaaatcagaattagaactgctcagaaataagatgactagaatgatatgaaacatcattttatggaaagagaactgagaaaactcagggatgaactagaaaagaaagaaacagtatttcagaaatgaagggtatattagaagaaataaaaggacaataagagaccatggaaggcacagtaagagaaactgaggttagaagggagaatgaaactaataaaccagacacaaagaaaagagaacaaaaagaatttgtcaatgatttggaacaataagtgaaggagattcaacataaaattcccaaaagaaggaagccctctgagaagaaaaaacaactaatacataaaactataattcaaagaaaccttttcaaaataaaagatttgaatctatgtattaaaaggaccatctgggaaatccaactaagaaccatcaacactgaaacactttctaataaaatggttgtattgttaaaacaagaaaaaaaatagcatccaagcaaagaatgaatcagactttgaagtatacacattttgtaccagaagacaatgaagcagtagttgtaaagatgctcaagataagaaaatacaagccaaagattttatatccaaccaaactatccctcaagtatgaaggtgggtgctatgatttgaatttgtcccccaaagttcatgtgttggaaacgtaatcgtcaatgcaacaatgttgaacagtaggatgtttgagaggtgattaggtcatgagggcaaagccgtcatgaatgcattgatgctattatcacatatcgggggaaccagcccccaatatttcaatgtagtttatttctattttccctaagtgtcagctggtctgagaaataaagagaaaaaccacaaagagaggaattttacagctgggcagccaggggtgacatcacgtattggtaggtctgtgatgtcccccaagccacaaaaccaacaagtttttattagggatttcaaaaggggagggtgtgtacgaacagggagtaggtcacaaagatcacatgcttcaaagggcaaaaaaggagaacaaagttcacatgcttctaaggccgataaagatcacaaggcaaagggcaaagcaagatcacaaggcaagggcaaaactagaattactgatgagggtctatgttcagctgtgcatgtattgtcttgataaacatcttaaacaacagaaaacagggttcgagagcagagaaccagtctgacctcaaattcaccagggcaggattttttccccaccctaataagcctgagggtactacaggagaccggggtgtatttcagtccttatctcaccacataagacagacaatcccagagtggccatttatagacctccccccaggaatgcaattcttttcctagggtcttaatatttaatattccttgctaggagaagaattcagcgatatctctcctacttacatgtccgtgtataggctctctgcaagaagaaaaatatgactatattctgcccaaccctgcaggcagtcagacctttggttgtcttcccttgttccctgaaaattgctgttattctgttctttttcaaggtgcactgatttcatattgttcaaacacacatactttacaatcaatttgtacaatagtggtcctgaggtgacgtacattctcagcttacaaagataacaggattaagagattaaagtaaagacaggcataagaaattataagagtattatttgggaactaataaatctccatgaagtcgtcacaattaatgttcagagattgcagtaaggacaggtgtaagcaaatataaaagtattaatttggggaactgataaatgtccatgaaatcttcacaatttatgttcagagattgcagtaaagacggggtaagaaattatgaaagtattaatgtggggagctgataaatgtccgtgaaatcttcacaatttatgttcctctgctggggttccagccagtccctctgttcagggtccctgacttcctgcaacaatcacaggagtgggttattgtgggagcaagcttctaataaaagaatgagtttggctcccttccctctttctgtcacccccataggatgatgcagcaagaagggcctcattggatgcagcccctcaatcttggacttcccagtctccagaaccatgagccaaataaatttgtttattaaaaattatagtctgtgatattctgttatagccgcacaaaacagactaagacacaaggccatcaaaaagcagttataaatattcaagaactctgggattatttttaccaaaagcctttctgagcaatctgctggagaaggagcattagaaaaccaagagctgcttgaagaagcttgttgcaggctctggtagaaattggctacaggatggaggaatatacaaattatatataatctgacaatgtagaaataatacaagtaacaagtggggaaagtgagtggaaagcagaatacgtttgctgattgtcgcataggcattaaccaggagtaaaacagtatcatctatgtttagacactggggaggatggaagaaaagcagtaatagttatagccaactttagtattgcttagagaaaggtagagttaggcattaatttaaaaagagaagcttcagctattataaataatattagtgtaaaggcaagaagtggaacaaaaacacaaaccatattaaatactaaagattggaaagagaaaacaggccatatgggaaaagaccttctagataacagtaaattatgtaataaatcagtatgtcagagctgagatcaaacatataaatccacagaaagaaaaagattcagattgactaaaaaggcaactctctctgctgtatatgagacatacctaagtcaaaatgataaagaaacattaaaaattaaagaatatgcataaatatgccaggcaaatttaagtaataagaaagaagggtttgagatcttgataggaagcaaggtagaatacagagagaaaaaaagtcaaaaagttaaaagagactgagaaagacattataatatcaaagactgcaattcattgaaaacaacttacataaggcagaaactgctaaaaatctaaggagaaacagaaagaaacatgctaataatagaaccttaacacacctctcttgatccaagaatgaataagtggaccaaaatgaataaggatgtatagaacctaaaccatgtcatcaataatgtagatctaatatacctatctaactctaaagcatttttggaatttactttcctttcaaatgcacaaatttaaaagtatgttaatgttataaacaaataagatttttgaacacatatcaaaagatatctaagcctaaaattaaagaaacaaataccctacaatcttaaacttgaattagaaatttcaacatcagctactttcggaaaatagccacattctagctttgtccactgaaaaagtctagaaataacttcaatccaatcagtgagcacacctagctctcaattgtggtctctaaatagaattgttcacaaatagaactaaagattcatgaagaaatagctgattctagttgtggggcaggaaaggtagacggtgggctgagatagtttgttactctagaaagtagaaagggaagaaagctttcaaaggctggtggaggtcatgtcaaaaggacatgggagtcagctagaaggggatcccacttgccatagatgagacaacatgaacaataaaaaagtgaccccattaattaaaacaaattgaatatacaaaatgttgtaaatttaaaatgatattttttaaaagggagttaggagagaaagaaaaataaaataaaagtcactgggcaccaatggcagttgcttgggcaccaaatcatgactctagaaattgagatttaaagggaaacaagcatttgtctggcttttctggtataatgtgcatttcaggatgtccaaagagctctgtagttgagggattttatacagatgctcagataataaattcaaaaggaaagaattttctaaatcaacattttgcaattcctgatgcaataactgattaaagaaatggtcctcattagataataaaaccttagatgaagtattgatgataaacttcacaataaaattatcaagctaccatcacctaaacccactgatcaattttagcatcactgaatcatacacattctggtatgatatgatgcaacgtgaaagcattttagacaagccaggaaatcaagaaccatgcctgaaatattctttttataaaaccaaaagaacagctaactgaatttaatcaagtctttaacttcagtctataagaaattcagaagttgagggaaacttgaatagcacctcaagccaaatctagaatgtaggaatctaatttagtcaataagtccgtggcagagagaaaagaggagataggaggaactgttctagattacaagatacaaggctgaagtacaataaaatgaaacctgtttaaatcataaatattatatatgctatgatttcatataatcatatattctactagttcagttaatcatggaataagtgaaaagagatattttagataaccagaggaatgtaaatatggagcagatactggatgatagtaagtattaagtagttattgtaaatttgtggatacgtaagaaaatggttttttctctcttcctctctttgcctaccactttcacgctttctctctccctctgactccgtctttttcactttgaaaagcttgctaaagtattaggagtgaaaggacatgctgcatggtattgacttcgaaacgctccagtaaaacagagagagattgggaaatgtatagatgaggaagtacgtaaaataatgatggtgttcaaagctcaatgattggctcataaaaatgttcataataaatgtattttttaaatgaaatgcctttgaaggtatgtgggaacataataactataagaaagacaaagtatacacatgctttttggtgatattgtaggtagctaggtatcagtatttttattgtacttatgccctacagctaaaataattatattgaaatacatcaccatatcctgtcatgttgaaatggcatagtgccacagtaacaaaaaatttcattcaaagtttatatttaggatatgtatttgttctatcttagaactgttgtgaaaaaacatgagacaagatgctgtataatagacgagcagatggcacctttctgtctacctctcttcctctttctctctctctctcccccatttctcagtgttggagcactgattattagttacctagagtactttcctctttctcaccaataaataaaataacttttgaaattatacaattagtaaaatttatggactaattcatattttcaaaatgcttactgtaattagtttaattctgaaaacgtgtatgaaacatatgacccaattattcatcatttaactagatagcagtagaggccacactggtgtcatgggatccttggggtgttgttttgccagccagaagcctctgtggtatctttggtagagtttttactcgggccccctgggctcattccacccactcagcctggcagtctgcactcggttcatcctaccagcctgaatcccatgcctgtcaagggcgagccaagtgcagactggtgaggggtgtgtgagtgagtacagggtctggccactgtgtaaagccaggcatgccggctgcagcagggcaggcagctccaggcaccggcacggacactggctccctgcaaggctgcagctgcaccaggcataccacgaccagcttctactgtgggcaccagggaacacagtgatgctcagaagcctggagacaccaggaaccacagagctccaaagagggtgtcacagccctggcttggggagctcctatgtctgggatccccaaaggactgcagctcttccctctcttctctccttctggttgcccccacgtggcaagcaggggatgggtgtgtgtttcaaccatttgtgttacagctcttttagtcccatcttttggcaggtcttgagtttttgtcctgcatccaggaagaatgaggtgtgtggacaactgcagggtgagcaaggtgaagagctgctttattgagcaactgtacagctctcaggacacccaaagtgagtagctcctatctgcaggcaggtcatcccactgagtttgcagcatttagtggagaggagacccagagtgggcagcttctatctgcaggcaggtcgtcccatcaagttgaggagaccagaattgggtagctccttcccacagctggtagtccccacatctgtctgagtctggctgagtccaggggtttttatggacgtcagaagaagtgcatgctgattggtccatgggaggccatgggtgggcccagaaatggcactaaatggcaccataagttctcattctggtccgctgaactgacagcctggccaccaggcttcagggagtccctggtttgaaggtggggcttcaccagggacctgtccctttctacccaggagcctgtcccctgccgtcatccacagtgcccaggctgtttgttctgagggatgcctgcaggtacaagctgagccatcctcagccccttgcctcagccccccttccatgctcatcggcgagggggctaagggaggaggagcctggcatgtcagtgccatccggagcacacacacacccagccaggtcacagccacccaggctcagcctcaactttgcttcgaaatctgagtgggcaacaggatcggggagaagccagacagcaggagtaggcacttcggagcctgcagggttggggcggaggtggcttcccaggcccctaagagtgcagggatgcacaggtccacagctacaactgggttgctgcagctgcgccagggaggtcggagctccgcccgcttaactcggaagggggcggagctccaacctgttcctggctcccaccagctccctggagtgcccaccacctgccacacctcccccgctgtagctagctccttgacagccactgctccaagtggacacctctgccatcactggtatttaaaaaggagagagaaaattaaaaagaattgctactgaaccaggttgaggagatcctattcaccacaaccaaaattactatgtagcaatctaagttagtcattaaaagatcaaaataatcagtcattttctggtataaaaaattctatttagaagaagttaagtagctaaagctcataaaatagatttttaaattataaaattatttaaaactctaagacatagaagtcacataactgcaagatttaagcatgtgtctaaggcagggcttctgaaattcacataagtatatccctgcaggggtactcagctgcatgcccagaagtacagtacgtgggccacaggaaaccacagcatttctttccagaacatcaactgtacttaaaatttagtaggcaaaaaacatcatatgaaagtaacattgacacaaaatagatcagttacagaatagaatgcacactttataacatttttaaaatagaaagaatacttcaggaaaatgttgtacttcaatctaagattgctgactccccagacacctgtccaccttttctgatttcagcctggtccacacagaaagtttgagagacagcagcctaaagaaaaggctggatgcatgaaactgactctcctctttgaaaacctagaaacattcttttacagccttcacgatgataaggtccccaggactgattgtcaccaactaaaatgcacaggaggctgagatcaacaccaaaatatccactatttatagacaatgaaaactaatacaagtgtcacaatgctcagaaatccaggtgtgagtaaaatcagtgcatttggtctcagaaagctatgtagacatcaaatgttcattggaaacctctttattgattttgcatgagaaattactgtcaaacagaatagaaaaacatgaaatccatatcatcagcacattctctccatgtaagcagattacacaggagtcaaaaagttgtttgatgaacatggaatcagaacacagacgaagaggctgtttcacattatcagggaggccagtgggtttgtttgccagaaagaacaacactctgggtctattgatggaagcatcataccttcagctccatcctatggacagcccttccattgaagctaggaatatttgagtcagtggttatcctgagtagcatttgagaggcactgccaaaatttacttctcagtcacctttttctgtctttccataactgaacaactcctcacattctttctcttgtctatgccaggatactgagtggatcattgtggagttttgctgtctccatcaggtggttgttggctgttgtgagacctcagtttttgtcttctcagtttaaatgaatgtaaatggagacacacagcaaagaagatgcagcatagagcaatttattgtaaaggaaaaagaatatttggaaagtttggtgcagaatacactgcatactctgagagagagaggattcatggcaggctgctggtaaggatgagacagcaaagactggcactagggagactctatgggagtcttacatgatgattcataagtgggtgggaagaggtgttactaggaagcatgttctgggtggtcctctgggtgcacatgtgcagtagctgtacatgcttgttcatatgtcgcatgtctcattagcatcttaaatctccacctgtgtgtttggtttctgttttgttttgtggcacattctcgctctgttgccaggctggagtgcaatggcgtgatcacagctcactgcagcctctgcctcctgggtccaagtgattctcctgtctcagcctcctgagtagctgggattacaggcacccgccaccacacccagctaatttttggtatttttagtagagatgggatttcaccatgttggccaagctggtctcaaaactcctgacctcaggtgttccgtccgccttggcttcccaaagtgctagattatatgtgtgagtgtggttttactattataatgagcaaagggtcagtctgagaataggtaaaataaaaatttctctctacaggagaaatttcttactggatatagctttgcttgaatgactttgactatgatgtgaatgctgaggcttcttgggttgactgtatagtcccacggttgccgagtcccaagaacatggttactaatcacaaaggaagaaaagtgagcacgttagacactagttgagctctaatgaggatgagctgcttccatcattttgagcaatagacatctcactcacaggatactaagtaaatcctagagctcttgaaaccctcctaattgtgcacaatgacttctaaagagaccccgtctccacagccacaatatggcagactgcaacagagttgaaatgcgttgttcttcagtagtctcagcctgtgcaccccaagaaaaagaaaatccacaattcatccccttatgttagtaggttacccaatttcagtgcgtaaaatgagcaaataaaattccatattgaaataacttctaagttaacatttgagatatttagcacaatgctaaatattcattggctttcctcattctttaattctacaaacatatattgagctcattctgccacaaataaggcacaatatgcaatgttgtggcaaacacaacgataaacagaaaatgatcactgttctcagctcctcacagattagcacacatcctcagttctattgaattcccaggcatctctgtttaaatttcagctccaacatttactggatgaatacgttagaatcaggcaagtcactttaatgtctctcctcagcagtaaaatgaggatagtagtccctgtattatagagtttgttgaggattaactgtaaataattcctgcaaagctcttacctcaatgtctggtacatgacgagtaatcaacgtaagtcacctgttagttttggcagtgattttggtactaatagtgggtgttggtagtacaaatatttgcacatccaaattaatggttaacagtaactggagtgttggggttttttaatggcccctggccatatcaaagccaaatgaatgcagaattacccaaagattcacgtgtgccaaaattattgataatggaaacttaaagtaccccatatctaaaagagaaatacattgaattcccttccatgccaaagtaaaagtgaccaaatattctctctttaagaaaattgttctttccttccctaaaggtccaatttaccagaaaatattctggatagaagttgcaagttacataaaataagaaaactgaatatggaaaaataaattgttttcaatataatcaggcttcattgtgacattctgagtagagttcaagctcatatctagcgtataccttagtgaaactgagtagagcaatgcaagagcctcctacttttcaaatactatttcctcttcctggtcctgtctccccaagtgaactataaaattgcttatggaatttaaaagcagattggttttatatcttccagctcattcaaatattcacctggctttaggagccctttgagttaccctgcttggttcttaaacactggttgacacctaccactggaaagcttggctgttaactacttgaactacactttgaaaaaccaatcttggttagtttctcaagaagacagcatgcattgaaagggacaatctcagatgaagcaggaatagaggggtaaaataaaaacaagaatgcttaccactttctaatgtcctccccgcaatttgaagtaatccctgtccttttgggaatttccagttgttatctctcctaagacaattatgcaccatcgtggaaaaacagataatgctatatgtctttgtagcttttctccttgtgcataaaatgagggtgaaacacctcatcggtgtgagatagagtcagctctaaatatactgagaaaattgtgtttacacagaggccgtattgactacatctccacttctttcacctcacagaaaaggaattaggtcctgccttatgtgatctgctagtccccatcagactctacaacttggtttcttctcttgcacagatttacacaaagcaaaagcaactgtcccaatcactaccaaataggcactgtatgatacttttgtattatatatagacctaactttaaatttgccattttaatcagtggcataccagtacagtgacattagcatgcattcacattgttgtgcaaccagcaccactatccatcaccagaattttttttatcatcacagcctgaaactctagagccatctttattagtcacctctggctgctataacacagtgccacatagtaggtggctcgtaaacaacatacatttattgtgtcactgctcctggaggctggaattctgagatcaggatgctagcatggtcaggtcaggttctcgcgagggctgtcttcccaccttggagatagccacctcctctctgtgtgttcatatggttgtgcatatgctgggtttggcgggcgaggggaaaagacccctcttccttcctcttgttgttaagccagttttatcagattaggactccatccttatgacctcatttagcttaattacctcctaaaagccgtatcttcaaatacacttacattgacggttagggcttcaacatataaactggcaggggggagagaggggcacaattcagtccattacaccattaaacaataacttcctattcactctcccccagttcctagtaacttccattctacttttgtttctatcaatttgactgtttcaggtacctcacataagtagaatcacacaatatatttcctttagagactggcttatttcgcttagcataatgtcttcatacaacatccatgtcgttgtatgtatcagaacttggtttctttttaaggctgaataatactccattgaatgtatataccacattttctttatgcatccatctgtcaatggacacttgggttgtttccacctttaggctatgcttaataatgctgctgtgtacataggcatataaatatctgttcaagcccttgctatcaattcttttgggtatacacctagtagtggaattgctgcatcatatggtaattctgggtttaacttttttgaggaaacgttaaacttttcttccatagcagctaccccatttggcattcctaccaacagtgcacgagggttccaatttctccacatacttgccaacacttgtagttttccactgttgctgggtttttttaacagccatcctaatgaatgtgaagtgatatgtcactgtggtgttaatttgcatttccctaatgactaatgatgttaaacaccttttcatgtatttattgaacatttgtatttcttctttggagagatgtctaaaacatcttttgcctgtttctattggtctatatgtctgtctttatgcaagtaccatactgctttaattactgtagcactatagtaagcttagaaatcatgaagtgtgaacctttcgactttgttcttccttttcaagattgttttggctattttgggtcccttgagattccataggaatttaaggataaatttttatatttcttaaaaaaacattgagatattgataggacttgcattaaatctatagaatgctttgagtagtatgaacgtcttttttttttttttttttttttttagatggagtttcgctcttgttgcccaggctggagtgcagtgtgatagctcaccgcaacctctgcctcccaggttcaagcgattctcctgcctcagccacccaagtagctgggattacaggcatgcgccaccaccctggctaattttgtatttttagtagagacggggtttctccatgttggtcagactggtcttgaactcctgacctcaggtgatctgcctgcctcggcctcccaaagtactagaattacaggcatgaaccaccgcacccggccaaacatcttaacaatattaagtcttttgatccaagaacacagacatctttccatctacttatgccttcttcaatttctttctgcatgaataatattttagccaaatgtttccacaagctcactgcccttctgcccaggcaggtcccaaatgcagctcagcaggcttcccaggttcctcagagccctccctctgctctctccatgactcaatcaccacgggacatctcacaccagaataaagccaaggagctaaactagagggaggaactgtgcccttaacgtgatttttggctttattgtccctggctaagcttctttgtttatttgtgtgagtcagcttcacatttcctctagaattgagactgctatcaaaacaggccctgacatgttagccagcagccagtctatacataagacaatggtcctcatgactgaaagtcagaagagatgctgaagtctacaattagtgtggggctttcacaagctcttgaggccccaagacaaggggttggaatcccaggtttactactgactcactataaattacctatgtattgtctagcaggttgaatggcagcccacaaaaagatatgtcaaatcctaatttcaagaacatgtgaatgtgactttttctggaaaaaaaaagataagatatttttagatggaatgaaaagataatacgaaaaaaattttttttccaaaaaatatttatctgagatgagatcatcctagattttctagatgaggtataaatccaatgaaaagagtctttgtaagtagccaggcacagagggtcaactatcacatgttctcactcataagtaggtgctaaaaaatgtatacatatggatatagagagtgcaataatagacaatggagactcagaagggtgaatgggtgggagggaggtggatgatgagaaattagttaatgggtataatgtacttcatctgggcaatggattccctaaaagccctgacttgaccactacacattctacgcatgtaacaaaattgcacatgcactccataaatttatacatttttttaaaaaaagagtccttgcaagagacattcagggaaggcagagattgcataagccaccacaagccaaggaatgctggcagccaccagaggcaaagaacgtaatctcccctagagcttctggaggaagcacagccctgccgacagcttgatttcagacttctggcctccaaaactgtgagataataatttccagccaccaagtttgtgatcatttgttccagcagccacaggaaactaagacaccttgtttcctcattcaaaatatgaataatggacaggtgcggtggctcacacctgtaatcccagcactttgggaggccaaggcaggcagatcatttgaggtcaggagtttgagaccagcctggccaacatggtgaaaccttgtctctacaaataatacaaaaagtagccgggcgtggtggcacatgcctgtaataccagctactctggaggctgaggcaggagagtcacttgaacctaggaggcagaggttgcagtgagtcaagactgcaccattgcactccagcctggacaacaagtgcaaaactctgtctcaaaaaaatatatatatatgaataataatagtacctacttctagagttgttgtgatggttaaataaaattatcatggaaagcaagtagcatagggcctaccgctgcaaactctcaataaaaccctgattagcattacaaatggaggagtgaggcaacacaatgccgaagcttataagaaccagaggtccaggaaaatcattgtttttgcctgagacatctcccggttgatttttttttttttaaggttaaaaactacagtcattttcttgcttactgaagtccatggggtataggcaaaatatcacattctgcattccaaaaaataagtatcaagctcccatgtgtttgtgcaatgggagatggggagaaaactatatatgtaacaaacatatgaaaatgttcttaggccaccagatatagaaagcaaaaatactttgtgtgccaactgttgtgtctgtatatgcgtatgtattcgtccgttctcagattgctaatacagacatactagactgggtaatttataaggaaagagctttaatggacttacagttccacatgactggagaggcctcagaaaacttacaatcatggctgaaagcagctcttcacagggcagcaggagagagaataagtgctgagcaaagaaggaagccccttataaaaccatcagatctcaggagaactcactcactataacaagaacagcctgggggaaaccgcccccatgattccattatctccacctggtcctgcccttgacatgtggggattattacaatcaattcaaggtgatattttggggggcggggagcacagagccaaaccatagcagtgtacatttcttctggagagttcataactttcatcagattctcaaaaagagtctgtgtggaaacaatagacactggggactccgaaaggagggagggggcgaggacggcaaagcctgggaaacttcctactgggaactgtgttcactgtctgggtgacaggatcagtagaagcccaaacctcagtatcatgcagtatcctcttataagaaacctgcacatgcacccactgaatctaaaattaaaattgaaattaataaaaataataaattaataaaattctttcaaaaacactgccatgtaaaggaagttataattgctctaggaaattaacatttctaattactataataatgaacattttttatgcaacagtggatactaatgggaatttatgctattagaagattatgctgtgttaaccctaacaaaaaagaacctgtaccccccaaaaatgttaatcacttacataaaataatactgatggccttgaataaagtgcttaaggccaggctctaaaaaataaaccaggcaagtattacattcagccagggggctacctgtggctcaaaacatcattgctggagccttgcccatgacccaattccagcaatatgagatgagtctggattcgaggaagagatttgagagagaaatgaacagcaagtgccttcgacaatatagcaatctcccagttgtgtagtaacagaaagtgcatttaaacatgacctgcaaaaagttctagcaataaattccttttaaattgtttggtgaggcctctttgtggaactctaagattaattgcaataataataataaattgttgtcattgtgacccctcacattcataatcagacaaactagatagaaaatatttaacattttttctttatttaaaaggcaattattgagtaagtactacatcttggtaaccacctgacaggttcatcttgcctattgcctaaacagctgatttatcaagacagggaattgcaataaagagtttaatacatgtagagtcagctaaatgggatgctgaagttttcttactactcaaaccagcctccctgaaaattcgaagactaggtttttttttaaagatattttggtagtcagacagctaggaaatgaggaatgctgaatggtagggtgggaatgaaataataggaagtcaaagctgtccttttatgctgagtcagttcctaggtgggaaccacaagaccagatgagccagtttactggtctaggtggcaccacctgatcttcagaattcaggatctgaaaaatacctcaaacatcaatcttaggttttacagtagtggttatctataggagcaattgggagtttgaattcttgtggcctctggctgcgtgactcctaagccatcatttctaatcttgtggctaatttgttggttttacaaagacagtctggtccctaatcaagaggagaggggaggttgtttggagaatgggctttttacattcttcttttcaaaattaaattataaactcaattactcccaaagttagttcaggctacccccagcaatggacaaaggcagcttggaggttagaagcaagatcagctgattaggccagatttctttcactgtcataattttcccatgtcaaatttttctcactgtcataatctttgcaaaggcagttttaatctcccctcttgggtttcatcacacattattcttaaaggtaagaggagtgaaactactctgcagctgtctgcatgtattcacaggtgcctgggtggggtttcaagacttgcatgacaatgatgttagtactctcatccacagttttagcacagcacttcagtgagcagcagactagaagataatgagtcttaatgtcaggagtgaaagtccgagcttcagtcttctttgtagaattgatttgaaaccctgggggattcaggcaaatagctctgagaaccaatcagacatagggtcactagtagagagagatttgggtcaggttgttagaaagacaaattgggacacacacaaaagagaaaatttaaatatatcatctcatatatttttagtcagctttttagacctgagaatagatcagttgagttaaacagtagtgtcccattctaggaggtggcattgcagatgggctatgctcctataagtgatgaaggtaaacagatttttaataagagatatttctatggaaacagaagaaaaaggttaatgttaggcacaatctatccagatgtccaattcaaaacacttttagttacagaggaggaaggctgtggtaatttgacacatttttcttgactgtatcccaaggaataagctttagcttgtagggcctcagggaaaaaagaaggtagtagtccaaatccgaaatatggaagaaaaatttgtaagcattaatttggggacttgcaggccagaaagaatttcagtcagtccaaactgtagaacatatttttttaattaaaaacaatgaacaagaccaaaatctaacaacaattatactatagtttttagaaacataatttttctctctccagtctccgaattttattaaagacaaatcatggtaggactgatttacttgcaaaataagctttagttcatgtattagtccattctcacactgctaataaagacacatccaagactgaataatttataaaggaaaaaggtttaatagactcacagttcagcatggcggggaggcctcaggaaacctataatcatggtggaagggaaagcaaacacatccttattcacatggtggcagcaaggagaaggtggcagctaagcaaaagggggaaaagcctcttatagaaccatcagatcacatgagaactcactatcatgagaagactgtgagggtaaccacccccatgattcaattacctaccactgggtccctcccatgacacatgaggattatgggaactacaattcaagatgaagttttgggtgagggtacagccaaaccatatcagtccaattatacttggcccaattatttgcataaagtacagcaagaataattatttgttatatggtgatatgatttggatttgtgtccccaccctaatctcatgttgaattataatacccagtgttggagaagaggtctggtgggaagtgactggatcatgggggcagactctccacttgctattctcatgatagtgaatgagttcttatgagatctggttgtttaaaagtgtgtagcacctctcccttctctctctctttctccttctctggccatgtaagatgtgcctgcttccccttcaccttcaaccatgattaaaagtttcctgaggcctctccagcctactacaattcctacaatactacaggaattatagttcctgttacagcttgcagaaccgtgagccaattaaacctcttttctaataaattacccagtttcaggtatttatttaaagcagtgaaagaatggactaatacagaaaattaatactgggagtggggcattgctataaagatacctgaaaatgtggaagcagctttggaactggatagtgggcagaagttggaacaatttggagggctcagaagaagacaggaagatatgggaaagtttgaatcttcctagagacttattaaattgttgcaaccaaaatgccaatagtaatatggacaatgaagtccaggctgaggtggtctcagatggagatgaggaacttattgggaactggactaaaggtcactcttgctgtcctttagcaaagagactggtagcattgtgcccctgctctagggatctgtggaactttgaacttgagagagaggatttagggtatctggcaaaagaaatatctaagcagcaaagcattcaaggtctgccctggctgcttctaacagcatatggtcatatgcatgagaaaagagattatctcaaattgaaacttttcaaaggggaagcagagcataaaagtttagggaatttgcagcctgaccatgtggtagaaaagaaagattcattttcatgggaggaatatgcctaaataaagaggagccaaatattaatagccaaaacaatggagaaaatgccttgaagatgtttcagagaccttcatggcagcctctcccatcacaggcctggaggcctaggagggaggtatggtttcatgggccaggcccaggaccctgctgccttgtgcaatcttgagacactgctccctgcatcctatcttctccagctcctgctatagctaaaagggccccagataggtctcaggccactgctccagagggtgcaagccctaagccttggcagcttccacatggtgttaagtctgcaggtgcacagaagccaagagttcaggcttgggagcctccatctagatctcagagaatgtatggaaatgcctggatgtccaggcagaagtctgctgcaggggcctgcaggggcaagccctcatggagaacctctgctaggacagtgcagaggggaaatgtggtggcagggccctcatacagggtcctcaaactggagcactgcctggtggagctatgagaagagggccactgtcctctagacatcaaaatggtagatccactggcagcttgcactgtgcacatggaaaagctgcaggcactcaattccaacctatgaaatcaaccaaggaggctatatcttgcagagccacaagagtggagctgccaaaacttggctgatttctccctttgggaataggtgtacttatgaaatgcctgtaccctcattgtatcttggacataactaacttgttttttattttacataggcagaagggactttcctcatctcaaatgagacttttgactatgaacttttgagttaatgctgaaatgaattaacatttcaggggactgttgaaaagaggtgattatattttgcaatgtgagaaggacatgagatatgggaggagccaggggaagaatgatatggtttggatttgtgtccccacccaaatctcatgtcaaattgtaatccctagtgttggagtaggggcctggtacaaggtgattggatcatgtgggcagacttctcccttgctgttctcatgataatgagtgagttatcatgagatctggttgcttaaaagtgtgcagcacctcccccttctctctctgttctgccttctttgtccatgtgagacgtgtctgcttctccttcactttctgccatgactgaaagtttccagaggccttccagccatacttcctgtacagcctgtgaaacaatgagccaattaaacctcttttcttataaattatccagtttcaggtatttctttatagcagtgcaagaatggactaatccatatagactttttaaaaattggcttttctggaggtttctccataaggaatctcagattagactttttaaagccttgagcccagccgcaaatttatctgtgccttcagatgcttatatgattggatgaatatctctcctcttgagcctgggcccgtcaaaaattatttaccacaggtcaggaactctgtacagggactgtgtaaataaggtataagtccagttctcccaaggggcttttattggctctataagtcaactttgattccttcaagcagtctgtttatatctgaaagcatgtcattccaatttaagccttgataaagtagccagtgtctccaattgtgtcctgttataaaagaaagcagatccttattgcacctatgcaaataactatattgccataagttaagaaaactcacgggtagtttccaaattctgataaattaggtagagaaagaaatatttttttaatttttgttcataggagtatactttcttcaattgttaaaagctataaatagctcaaaagaaaaagttttctatactctgaaaaacagaacaaaaaagatcagcagtatgtcaagcagtaagtcataaaaaggttatttgggtcttctgttagttcagttcatgcaattaacctttgttcttcctgttgttgagccagcagtgctcctgaacagatcagctgtctacaagagtcctgaaagttttttttttttaatttcaatgacccaatctcccaagttatcaaaaacctgcactcaaaagcagctgtcagagtcttatagctgattataaactgccgtttgtaaaggatcaaaacaagataacaattatctgtggaaaacaaaaatcttagtatagccacaattaaagacaaaatcaacaaggaaatctggtcatatctgtggcacacaataatttaacataaccattattaatcataaaatatactgagacatatcagaattacaggaatcttacaaagttttgaagcacaaatttataacacatttctatgaatataactcaaagaaaattaaaaaccattttatatttgaaaatgctttctgtatgattttaatataccaaataagctgaatatgtccctttttggaattcaggggacctaattcttaaaaagttaatgaagccaaaaaagacttaatttataatttgattttggaaagtttgtcaaatatcaaagatttaaaacacttggtatcataaaatagaattccatgtcactataagtaatttctttaacaaaaatgataactcaaaaattttaaaaagacttaaacttttactcattaatagaggggagattcagctttccaaccaacaagatccaataaagacagtatgaagacaactgaatctatctcttctctctttttgccttttttctgtagttgatttaaaaggcaaaatatattttattatctcaatattacatgaaaatcttgttcaaaagagaaaatcctattttacttttgtattcacgtatgatttatgttaaacccagtttttgtttttttttgttttttttgttttgagacagagtcttgctctgtcacccaggctgcagtgcagtggcatgatctcggctcactgcaattctctgcctcccaggttcaagcgattctcctaactcagcctcctgagtagctaagactacaggggcatgccaccacactcagctaatttttgtgttgttttttttttagtagagacgggattttgccatgttggccaggctggtctggagctcctgacctcaaattatcctcccacctcagcctcccaaagtgctaggattatgggcatgagccactgctcccagcctaaacccaatttttaataaaacctcataaacaaatttatctcattttaattagtgtgtaagcataagatatggttttgacaactccattattactttataatttcttgttaaaaagcagatcaatattttaagaaaatcttgttattttgacacagagcccagttccggccctgcattttattttaatgtttcatttatgggaaaactaaataatatccttttaattttagccaatttgctcacacacagaatttctcttacaagatgaatctatcataaaccttataaacttgcttaaacttttagttctatcttctcctttattaaatttagaacaattcctaaaccctctaagctagacccaaaaaaccaaattcgtatgtgtttttgccaatagcatacaactcctatttttaagcataagcaattttagttatgtaccaggtgcagagcctaggacacaggacagaactgcagataatgtctgactctttccaactagctaagggacatggctaaatccacatgtcctcaggccttacttacgatttaaaatttggaaaatatttctaaagcaggcaagaagacacctatcaaaagtcacagaagcggtgtgtaactttaaagcctctagtaaatacagtatctgaactgcctaatttagatgaaatgtctaaattgtgaagacatttttattttattttaccaataatctttaaaactgtctttatttttcaaagcttattagagtcctgtgaactaaaaggcattaaagtttctatttttctggcaaaataatttgatttaagtgcttatttttaaaggcaattaattagagctcttttatttattttaataatgaggcatcacacatacacacaacatatatgaatacacagaagcagatctggtagaatctgctgcttttaattttttaaacagtctgggtagcaccagctaatccatcagaatgcagggtctgaaaaatacctcaaacgtcagtcttaggttttacaacagtgatgttatctataggagcaactgggaggttattatcttgtggcctttggctgcatgactcctgagctatagtttctaatcttgtgaataatttgttggttttacaaaggtcatcggatcgctaagcaagcagggagtttattttggggagaagatgtattgtctttttttcaaagttcaactataagctaaattactccaaaagttagttcaccctacccctaagaatgaacaagggcagcttggaggttagaagtgagatcagtcgatgaggtcagatttctttcactgacataattttcctatgtcagatttgtctcactgccataatctttgcaaaggcagttcatctcatgaactgaattgtgtccccccaaaaattcgtatgttgaagccctaatccccaattgtctgtgtttgaagatagggtgtttagaaagtgaaacaggtcctaagggtggtgccctaatctaataggactggtgtcctgataagaagagaagagacaccagggatgtgtgcacacagagaaaaggctatgtagggacacaggtaaaaagtggccatctgcaagcctaggaaagaggcctcataggaggccaaatcctgctgacaccttgatcttgagcttcctgactccagaactgagaatctctcttgtttaagccacctaatctgtggtattttgttatagcagctctagctatataccaaaaccattccaggtgccagttacagaggtgattaaggcaagcttctcctgaagaatggcttactggcatgaggttacattacagaccactgcaagaaatagaccccactcagcctctcatggctacttgatgagctttcacttgatatggcctggactggctgattaggttgtgcatgcaatggggctaattagaactagaactagactactgttcgcttccctcaaaacctcttttgttttgctctgttatcattttgttttgttctgttctgctttattttcagggagaaataatctcactgtcttcccaagaaaggataaatcttggcttttccgggcatggtggcacatgcatgtactcccagctactcgggaggctgaggcagaagaatcactagaacccaggaggcggaggttgcagtgagccgagattgtgccactgcactccagcctgggcaacagcagagaaactccatctcaaaaacaaacaaacaaaaaaaatattggcttttgacacccacccttcatatcacagtccgaccaaaccccaacccgttcattgtcagaactatccactcattgaatctagcatgattcattgcatccacagtaagaaatttgaggagggagattaaataaaatgcttaaatgagaagcacgtatgagatttttcagaaagctgactggagcattcacatattatcagattactacaataactgttgtataagatggtgccctgggtagcatttctgatgtcactggtttggaaggagtatatttgctttttttatagaaaatatcaatcagttttccctatcagttttgcatgaattttccttgctacaggaaacagtgatggactgctggtcagtgtgacttggaactttaaggctagacctttgaaattcaacagtttaggtccccattagtttgattttagagcaggagttaagaaatagtttgaagatgtatttttaccacacctcagctgtgagctccacaaaacagaaaggccattgctttataatttaaggctcacagagaaatatttcagggaagtagttataccatgaaatactttacaaatgttacattacagtttcatatgccaaatgaaatttgacattttcacctttgttccccttaaagagccaagtcatctcttttaatatgttgaatgtgtttagcagtgctgacattcgcaatagataacccagaccgtgaattattttacctgaaaataaagacaatttgcaggccttccttagaagaccggctattacactcaagaatgggctcaagagaatctacttctctagagaacttgaaaagccccatgggtctcaggggttttgctgccatcctgtccagggctaaaaggtcatatcctcagaaccagtcccatgattttgattgcaggtcttcatggactaatggtcctgaatcttacacagagcttaacaactgtatattagaccatattttcaacctgctcacatttcaaccatctgacctgacttcaaagggagaattattttatctagacaccatattgtgtgagtagtttttcaagtactaaaaatttgctttatcttcaaagcctgtgactatggcccttggctttgaggataatattggaagtggcttttcatgattgtactagaaccagagcaaatcttagatttattggcaattcatatatgaatccaaccattgggagaagtgtttatattcataaaatagcactctagaaaaaaaatgacaggaatattaaatgtggagacattagttaaaagatcagctgcttaccccgcacagtgtggttcagtgaaaatacagctgcatgccattttctgactgatgatgcaggaaatatgatgaccagccacgtccagcttgcaggccacttgaggtttcttcccacaatctgggagtggaagggggccacactgtctccacagcacataagccaacttctgtggctttccttcaaagcagcattccctgcttttaaatatcttgacgcaggttcaagtggagcacaggaactgctattcccgtagattctttctcccacagaatactgaaaactcatgaactcctgacttaaagtacctttcaggattttcagttatccttttgatgagtttctctgcagatattcttgaagtctcacggtgaagttttctatcagatctcattttctctcctcttgtgcacccttaatttacttatctgagttttgtaaattgtagggagaaaaagaagagctaaagtaaacttgttcatctcctaagttacttcttataactgttttaaatgcctgctttcatgtttctgacatgccatgctcttttgtctcataacaaatatttgaataactcatttcaaaacataacattgtcacctgagttttcaaaaacccttggtcagccaagctggcttttggttatttcctcacctgaccacgcctctgttccaacagggcactcatgagagaatctataacaaaacacttctttccttgactttatgaaatcacagcacaaaaacctaagaaaaaaatttaactgtggtagaatgatttatattcctttggatacatacccagtaataggacaaatgcatgatatgttcattgcagcactattcacaatagcaaagacatggaatctatctaaatgtccatcagtgacagattggataaagaaaatgtgacacacacacacacacacacacacaccatggaatactatgcaaccataaaaaaaatgagatcatgtcctttgcagggacatggatgaagctggaggccgttatccttagcaaactaacgcaggaacagaaaatcaaatattacatgttctcacttacaagtgggagctaaatgatgagaacacatggatgcatagaggggaacagcacacaccgggggctatgggagggtggagggtgggaggaaggagagatcaggaaaaataactattaaatactaggcttggtatctgggtgacaaaataatctgtacaacaaacccccatgacacaagtttacctatatgacaaacctgcacatggacccctgaacctaaaataaagttaaaactttttttaacttaaaagaagaattaatagtttcggagggctctcattctcatgtgatcagaaaaacacaaattgttccatatgctctgtttacaaagagtaagtccaagctagcaaagctttctaatcttcaaagatgatatgagagggcaggaataaacttgcactcaggcagaaccaagtagagtgatgtacccctggctgttgatcacaagacgagctactttccagtgaactgtatgagtcaggatgaagtcaccactcttctgccattttctaacttttcctttcagaaatggatttttttaagtccaggtttaaaatctagagcctcttgcaaaggttaggagatgtttgctcctattgctactccatggtgccttttcttgtgccaccgcagcctcccctagagtcaagccactcatgggtaaccaggtcttcttcttcagtcttgtattttgaagacttcattgtcatgtctccatcccttggcagccccgagtgttaaagtgattttctttctaactccacttcagtgtctctatctgtaccagactccaatcctatttttgactaggatcacttcttttctaaacccaaggactcacagccttctttaatttccatgtgtttccttgagctcagtaaagcagttgccacagatttaacgcctaaaatgacattttttccagtgaattagttataaccattaccatttgcttggtaaaaagagcccaggtctaggaattagacatgggtgcgaatcctgcctgctgtctgctggttggatagtactggacaaaccacctactttctcggagcctcagttgcaaacgtgaatgaaaacacagcatggcgagagtgcagatgaggaagtgaaatgatgcccgtgaaagcatccagttcagtaagaaccttaatttattttccttctagcagaaaagagttgcttatcctaaccccaaaaggtagtagagtagcttatttatatgaatttctctctgtgtctatttgtgaaaatcaacttgtttttggccagagatccttaacttaaaactttctattttgtgataatagactgggaagggtgagtgggggcagggggaagggtgaagagatgtggattaaagagtacaaacatgcagtaagatagagggagtaaattcaatgtttgataacagagtggcatgactatacttcataaaaatgtattgtgtttgggagatggacaccgtaaataccctgacttggtcactatgctttatatgcatgtaatggaatttctcatgttccccataaattcacacaagtaaaaaagtttttgttttgatgccagacatgtttcacaaataataaaatgcttagcttcaagtggcaagacatggctttaggaaaaggtgatttgaagcagaacacatataaacctaagggccctctgataatatttctgctgtgggctcttctttctcttgcataatgtaagccagcttctgaaatgagtagtcccaacaagtcccagggcaagagagagatgccaaagcaattacatttatggtaaattcagaaaaggaaaatgtgcacaagataggaagaaaatctctgcaggcataatttgaaggaaaggcactaggtggtctctgccagcagtcattggatgtgactagcatggagcaattagaggtggaatggatctgtttaagcaaaaatggtgtgatggctatgaggcaaagccttaaatagtgaaaaatcctataagaatcacaaaagcattcctagtatgttgcatttatatgctgcttttaatttctacaagcacttcacaatttttttatcagagtctcaaatgaattatgttagggcttatatgtaattctattctcaaatatccctatccccaaaatgtttattttaattctgcttttctcctgtatatatcattcccatcactatcaagcttcttgaaagagaaacttccatttgttgactctgttcaccttccatttttttctcagtcctcttggcaatctgtcttctaccttcattcatgaaaccacagaaactgtcctttgaaaggtctctggtgacttccttattgccaaatccaacagcctctccctaggcctcccctactggatccctctatgaaatttgacactgcagctcacccctcccaccttgaaactcttctcccaggcttctttatgatttcttcttattttctccttcttatttctagctacactttctttgctcactttcaaaaaaagtcattccctggagttcccccctcaatcttctcaaattcatttctattctttgcttgagtgagatcatgtacttctattatttcaattcttactcatacgtggttgcatcagtccaagtccagccagaagacagaaatcacaccagtaatttgaatagggacattttaatattaaaaaaaaaaaaaaaacgttggctggtaaaaggggtaaaagagggctctagggagtactgaagcagcaactccaaaaaacaataactatcattagggctgaggaatgtgagcaaggcaggaacttggaaacttagaagaactctccaacttttcccacgccaaggttgagattcaggcctcatttgatgtggtgtggctgtcatatacatgcagcttggtagtgataaagaaacttgcaggacatagcagctgctgcttatctctgagggccactcctgcgagggctgctctcttccaccccaccccacatgcccatttactggctatcacatggaaaaactgtgcatgcgtgcgcactcacacacacacacgaaaaaccttcctcctgctcagcccttccagtgtccttccagcaccctctattagcaaaattgtatccactgacaaaattgtatccactgacaaaggagaaatatctacagggtccatcttgagaatcacaaactaaggcaaaaaaggatttgaagttgaaaggcaaaatattagtagaatattagcaaaatattagtagaacagtagataagagcatatacccaaataggcatttcttaccctgacccatcttccaaatttcagacttctaggtgtctatatatagatgtcccagagacacctcaaactcagcatgccttctttattatactcatggaaacagttgtcaagagctgtaatttttatttaaaatgtctaaacacatatcttcttttgaatacatattatatatatatatatataatttggatatattatttggatacattctatcattagttcagattctcattgccaattagaactagtacccattatgacaattacataactctccacctgtctttctcataatcaccagaatttactgtctaaaacaagtttttgttctcaaaaacatttaatgatctttttgccaacagaacaaggtctaaatcccttatcttgatatttaagactcttcacaaaatggcaccaatacactgccccagtctcatttcttactacatcttgatactactgctactactactatgaaacattaacatctattgagcacataatatggtccatacactaaaacaaatatatgtataatctcatttaatactcacatcacatttatgaagcattatccttaattttaaggaaaaaaactgaggcaaaaataagttaagttaacttgcttaatgccatgcagccctactaaatggtgaaatcaaactctgggcagtctaacttcagaatatgtgcatttaaccactacattatatgtctcccgaaaaataaatgagagtagaaacacatttaacaaatgggtctaaagactcataaaaaaccacaaaatgttactgaaagaaattgcatatctaaataaatggaaaaacatcccatgttcatggatttaaaaacgtgttattgttaaatggtgatactacgcaaagtgatctacagattagatgcaatctatcaaaatctaaatggaatattttgtgaaaatagaaaaacccatcctaaaatttatatggaatctcaaaggaacctgaataatgaaaacaatcttgaacaagaaaaacaaagttggagaacccacatttcctaatttcaaaacttaatacaaagctacagtaatccaaaaaatgtgtggtacaggcataaagatagacatatagaccaagggaatccaatagattgccaagaaataagccctcacatgcaaagttaattgatttttgacaagggtgccaatatcactcaataaggaatggacagtctgttcaacaaatggtgctgggaaaactggatatccactactaatggattgaattatgtctccccaaaatttatatgttgaaatcctaatccttggtacctcagaatgtaaccttatttggaaatcaggttattgcagatgtaattaattaagatgagattattctgagtatggtgggccccaatccaatatgattggtgtcttcataaaaaggggaaatttggacaccagcacacacacaaacagaacatcaagtgaacataaaagcagaaaccagcatgatatgttaacaagccaaggaacatcaaagattgccacaaaccaccagaaactaggagagaagcatattatgtactctctttcacagccctcaggaggaaccaacctgcaaacaccttgatcttggtcttttagcctccaaaactgtcaggcaataaattgctgtagtttaatccacttggtttgtggtgctttccttcggaagccatttcaaactaatatatctacgtgcaaaaaaatgaggttgtaaaatttactttacactatacacaaaatttaattctaaatggacctaaacataagagctaaaactataaaactcagaataaaacataggggaaaatctccatggcattggaatgtcaatgatctcttaaatatgacactaaagcacaggcaacaaaagaaaacaaatagataaattggacttcatgaaagttaaaacttttgtgcatcaaaggcacaattgacagaatgaaaaggtaacccactgaataggataaaatatttacaagtcatatatctgataagggattaagatctagaatatatattttcaaaactccttaaacaaaaataaaaccacaaatgactcaattcagaaataggcaaagaacctgaataggcatttctccaaactatacaaatgctcaataaacaaatgaaaaggttttcaacatcattagtcattagggaaaagcaaatcaaaaccacaatgaaataccagtttacatccactaggatggctattacataaaccaaaaaaactacaagtgttggcaaaaatatgaagaaattggaaccattgtacattgcttgtgggaatgtaaaatggttcagctactgtggaaaacactttcatggttcctcaaaaagttaaacatagaattaccttaggacccagcaatttcattcctaggtgtatgggcaaaataattgaaaacaaggatgggaaagatatttacatgccagtgttcacagaagcattattcacagtagccaaaaagtagaaacaggccaggagcagtggctcacgcctgtaatcccagcactttgggaggcagaggtgggcagatcaagaggtcaggagatcgagaccatcctggccaacatggtgaaacgctgtctctactaaattaccaaaagttagccaggtgtggtggtgcacacctgtagtcccagctactcaggaggctgaggcagcggaatcacttgaacccaggaggtggagagtacagtgagccaagattgtgccactgcactccagcctggtgacagagtgagactccatctcaagaaaaagtaaataaaaaagtagaaacagtgcaagtatccatcaatagatgaatggatacaaatttggcatatttatatatgtatatatttatatatgtgtttattcatataaatatatatgaggtcgggcatggtggctcacacctgtaatcccagcactttgggaggccaaggtgggtggatcatgaggtcaggagatcgagaccatcctggctaataaggtgaaaccctgtctctactaaaaatacaaaaaaattagccaggcgtggtggtgcacacctgtggtcccagctacttgggaggctgaggcaggagaatcacttgaacccaggaggcggaggttgcagtgagccgagatcgggccactgcactccagcctgggggacagagtgagactccgtctcaaaaaaaaaaaaaaaaaaagaatattggccttaaaaggaaatgaagttccgatacatgctacaatgttaagttaaataagccagacacaaaatggcaaacacggtatggttccatttatatgaggtttacaaaatattatttatagtcagtagaatagacagtaccaggggttgggggagaaggggaagtagggagttattgcttaatgattaatagttgctgtttcgaattatgaaatattttagacatagatcttggtgatggttacacaacattttgaatgcacttaatgctattcaattgaacatttaaaatggttaaaataataaactttacattatgtatattttatcacaattttttaaaacagctcatgagaagatgtcaaagggctgggagactgggatggagaggaaaggagtgggacattcagtacctaggactagaatcagcagaaattgttcattcattgaggggtagggaggtgggtatgtttggtgtggcgctcaaattgccaaattgagatcttgggggattgtgtaagacacagtgaagattaaccagtgatacacactgaagaacaggcctgcaatgctgggccaaggcttgttcatctgcattctccttcgacttaagtgccgtgagcaatcccatgatacaatagaaatgtgatttggccatggcagcaccccatttaccatcacagacaattcagccaaaaaaattaacaaacaaataaatagtagctaacatttactgaccacttgcaacgtacaaacactgtgccaggcacttcgcatgcatctgtttaatcctcacaactgccctctgaggcatgatcgtcttcattttacaaaccttatgttgagccatgctatatcatgtgccattccctaaaaaatgctgtacactgtcaaacttcaatatccgtattcatttctgattcctaaggcaatagtgtccttctgtcattttactgtgtacattcaattctactcatcctccagggccccttccaatgtcatccatcctaccaagtgctccaagcccatctcacccagaacggtcatttcctcttcaggtctcacttagcatttagtctcttaagaagatgtcttcagagtaatgtctccctgatatatgtgggctccttgagaacagaagccagtttttcttagtctttgaatttctaactacaaagtgcctttcattcaaaatcactctcagaatgttgacttcctgtaaatggatgaattgagctttaaaaaggacaggaggctgaagagggaagatcgcttgagcccaggagttaaagactgtggcaagctgtgtgagctgtgaacacgccactgcagtctagcctgggcaacagagcaagaccctatctcttgaaaaaaaaaatgaggttatagggaacctcatttgtacctcctgagcagaacccagacctgcttagtctccatccagttctctttctgtgttaccctagtgtcttctgtctttccagctctgcaaataaatttgcattctaaaatcaactatagtccagaggttgggcagagtggctcacgcctataatcccagcactttgagaggccaaggcagcggatcatctgaggtcaggagttcaagaccagcctgcccaacatgatgaaaccgcatctctactaaaaatacaaaattagctgggagtagtggtgcatgattgtaatcccagctatttgggaggctgaggcaggaagattgcttgaacccaggaggtggagattgcagtgagccgagattgagccattgcactccagcctggggaacaagagtgaaactccatctaactaactaactaactaaataaataaataaataaaatcaactatagtccataaaagggagcatcttaatttttttgccacgttaaaaattcacagccagaaatattggaagtctcaagcctttcttccattcaggtcctctctgatgtcctcactagaccatcaggtgcacaaaggataggactggttcttttttaattttttgctgtatacctggtttccagcagagtgcctacgacatagcaggtacctagtaaatgttgaatgaggaatgaacccaccacttcttacttaaaagacctaaggctaccaggaggaattagcagaccatgctggctcatttgttaagctaaggctagtccctctctaacagccagttgaatcccctaccccacatctactaggctccttgacatttatgccacattccccttctcttgtacctctctgataaaaacctcctgtgttgggagctggggggccggtattaagctaagcctgacttcccttgcagacctaaagaactcctttactctctgccagaccttttcttgatccttgcccaaaaggagattatctcggtaattcctgtcacaaattatgattctccttttcctcatttttctccttcccacccattcctagccaagcactgcctcattttctaatcctgttaagtgtctctcaggattccgtgacacaattgcaatgctgtcaagccctgaaactgggcatcaaaggaataaggcctgaaaatgattgattctgccatagacatatttaatatcccgtgtcctaagtttgggcccatgtgtatgtgtgtgaactgcttcaccttcagccagaggtacagagcccatgttgaaaaaatatgaatcatcataagtgttcttgtctacatttaaaaaaaatatattattagcgtgaataaacaagtattagaatcagttctattagaattgtatccacttgtttattttaatggagttgagtttgtgagcaaaatgagagaatctgaacatgtgctggagagaagcaggtggacaggtaagaagagaagcaagtgggaatggctggatactaatcttgaggaagagctggatattaatctcatatccagctgcctaccttatcctatagtgaactcacagcatttcctctctggcacaactttttgctggaatttacacagatgtagacaattatgcctttgaaacctgaaatttggcttccaaagcagtttatcccattgtctacacagatgccacttgagtgagaatttagaaaattcaagagtctagaaaatggtatcctccatccctgccagaggccttttgagctcataacatttaaaaacaaaacaaggcactccaataggctttggtgcatatccacaggcagatttggcagacttgtcactcagtgttcctggcttgggtatgtttttttctcccccacatcctccttttccaggagcagagctgctccacatgtgagttcaaatgccagccgacataggagagtaagcttctcccctgggacccactggccatgaacctgcaagcagctgctttttcttcccaaatgtgttcagagctcctggactcaagtagagagaaaaatagtgccttgaagttgtcttcagtataaactgatactggttctctaagaagagtgtgtctgtgagttaaatggcccaagaatgaaaagaaaggcctgctcagagttctgtcaggtagctttcaggttatagacagctttagaaaaccaacacgctgcactcagataaggagatcaaataggagatttacagagtgtgccaggctcaagacagcaatagcaaaatctacctttgaccttctgggtgtttctatttcactagagaaactccatcacacatcaggaaattgattttacaaaacgtgtattttaagcttggcttcacaaattctagagagaagttcctccctggtacttatttcaaggaaggtgtagtaaaggtaaaagaaatgagagcaaatcaggtgccttctgacaaccagccaagttcattccctgtctttctagatctcctacactgagagaaggaatgcaactagttcccaaggggtcagggcaggcattttccctaattcagggttcaaatctggagtcgatgggttccaggaaaaccaacttgaaagtgcttggacatatccacttatagttttgtttgtttgtttcaaaaatgtccaccactttccttggattctcagagaaatctgtaggcaaaaccaggttaagaactgttcccctgtactctgcattatttcacattaccttgtcatcagggacagagatcctgaaagcagagccccagcagtagcagatgaagccaacctgttgcctaagtccctattgaataaggagattagtacccaccacattgattccctcctgactggcatccccaacctctactcctagaataaatgaaatatgaactactctttccaccaccaccattctgtcccagcattatttattcctttcatgatactccgtatatttcataaaaacctcctctctgcctcattgcccaccccagcaggaacaggcccaggtgggtattcttctgttgcagagactcctttccttatctactcatccaggcaaaagaaccttggttaaatcatcagttgggcccatcctggttttgtttccattcttataaggacctgaaggtattatcataatccaggactatataagggcttaaaaaggattaagatcattgactttctgtaagcatacacacctaaatagcaaactatcaagaatatccatctctgctacaggctgtgcttctgacactatcaggaagattggcgaaaccttcaagcaggaagatatgatggaagggccaggcgtggtggctcacacctgtaatcccaacactttgggaggccgaggcaggtggatcaagtgaggtcgggagttcaagaccagcctggccaacatggtgaaaccccatctctataaaaataccaaaattagcttggcgtggtggcacacgcctgtaatcccagctattcaggaggctgaggtaggataattgcttgaacctgggaggtggaggttgcagtgagccgagattgcgccactgcactccagcctgggtgacagagtgaaacttggtctcaaaaaaaaaaacaagatatgacaaaaggacatgtctctgcccagactctacttctgttgctgtttcagcttttgacactttttatcaccactcttttcccacctctaagtattgagttccttatatcagtgctaacataattgtaaagaattatccttttttccactctgcaaattttcaaaggtcaggctttatgtagagaatctttatccattacagtatttcagcaataacactgtctttcctattttgctaatactctagagtgacatttaatttatcatccaaaagcaatgctaaactatgacaataggtgtagaccaagaccattgtagccaaactgaagccaaaggtcaccatgttccgcacagaaccatgcagggctaagtggttcactcgcctccatcacatcctataactgcaacatccgcctcatattggatctctctcccgctagcatgatagtggtagaaggtgctttgaagcaggaagataataaattccaaattaagcactatctgaaaagaaaagtctcccattttactgaagtcataaactctaggctactgcctatgttgcattatcaacacattctttgccccaaccagctgcagtttggctgtttaaccatcccatgttctttagcatgtcgagtagaccatgttttaaccataataggcctgttgcctgatgtgtacagcaagtcaatacaccaagatatgaggttgcagcagagaaagagtttaattatagggccgctaaatgaggagacgggaggaaacctcaaatctgtctccccaaggagtttggggctaggatttttaagggttttggagtaggctgaagttaggaaatcattgattggtcacagagagcagcataaggtcatgggacagggagatgaagaaacaatattctcatgttgatccatttcctctgtgagggtctttaaactggctgcagtcagctgttccactggaattcaatatctgcttaagcaattcttaagcaaaaaccttatgattctaacatcagaaatcctatgtataggaacaatggagatgcaaatagtcagtgtctagtgctacagactttcagttacaaggaagtgggtcaaagtacagactgattaatattgaattataactatatttctttccagaattcttgttaagcctgtgaagatggcttcaatgttacatttaattccttgatttttctccataaattgcatacaaattcaaggtctcattcaatatgcatgtaaccaaaaagataatctatgtcttacttaatctacaccatggttgttaggagccaatgataaaatacgacatagccccacactcaaaattctttcttctttccacagatccgaaatgtggcagcaaatctctgtgtggacagcaagcatggagccaccggaacagagctgaggctggacatctgtgtcaaggatggttctgaaagaacatggtctcatgaacaggtgagtcacctcccagaagccagggcagtgggaaccagtcgggggctgatgcagacacagagggatgcagctggaacaaatctccgaatggtgcagatggtacttgtgggacctggagtgaggccgctgtatcaccaaccagctctgcagttcagtgaatcacttaatgtctctgtttatgtttcttctcagagcagttgtgatgatcagttcagataatgtacacaattatcctctaaatatgagaaaggatgggagaaatgtggattgcgaccctagtcttacttcttttcccagaatggtagtttaacagaggaagcctgtagagtgctttggaacacttccaactaaatttcatggttttaatgactctgctgttctgtgtttgtgatgtcatcttaaacttgcttttcccctgaccatgaacagatcactttacatgggcctcctgttgttgtagtagtttttaatcttacatgtgaaggatgtaagcaacagcaccccaacatggacttcaggaaatactttaaggctatgtattgcttttattgatttttgttttgtttgcttttttctatttttgggggcacatagtaggtgtatatatggggtacatgaaatgttttgatacagtcatgcaatgcataacaatcacatcatgtaaaatggtgtccatcccctcaagcatttatcctttgtgttacaaacaatccaattatattattttacttattttgaaatgtacaattaacttattattgactatagtcaccgtgttgtgctatcaaatactaggtctttttcattctttctattttttgtacccatttagcatccccacctcccactccccacctcacaccctcccactacccttgccagcctctggtaaccatccttctactatcatctccatgggttcaattgttttgatttttagatcccacaaataagtgaaaatatgcaatgtttgtctttccatacctggcttatttcacttaacataatgacctccagttccatccatgttgttgcaaatgacaggatctcgttcttctttatggctgaatagtactccattatgcataggtaccacattttctttattcattcatctattgatggacacttaggttgcctccaaattttggccattgtgaacagtgctgcatcaaacatgggagtgcaggtgtctcctcgatatactgatttcctttcttttgggtatacacccagcagtggtattgctggatcacatgatagctcaatttttagtgtgttttttttgttgttttttttgttttgttttgttttgtttttaaacggagtctcgctctgtcaccaggctggagtgcagtggcgcaatctcggctcactacaacctccgactccctggttcaaacgattctccttcctcagcctcccgagaagctgggattacaggcacacaccaccatgcccagctaatttttgtatttttttttttttttttagtagagacaggggttcaccatgttggccagaatggtctcgatctcctgacctcatgatctgcccaccttggcctcccaaagtgctgggattacaggcataagccaccacgcccagccaatttttagttttttgaggaacctccaaactgttctccatagtacctgtactaagttacattcctgccaacaatgtaaaagttttcccatttctccgtatcctcaacagcatttgttattgcctatcttttggataaaagccatttcaactggggtgagatgataactcattgtagttttgatctgcatttctttgatgatcgataatcttgggcatcttttcatatgccagtttgccatttgtatgtcttcttttgagaaatatctattaaaatcttctgccaatttttaatcaaattattaggttttttacatagagttgtttgagctccttatctattacagttattaatcccttgtcagatgggtattttgcaaatattttctcccattctgtgggttgtctcttcactgtgttgattgtttcctttgccgtgcagaagctttttagtttgatgtgatccaatttgtctatttttgctttggctgcctgtgcttggggggtattactcaagacattttgcccagaccaatgtcctggagagtttcctcaatgttttcttgtagtagttgtatagtttgaggtcttagatttaagtctttaatccattttaatttgatttttgtacatgacaagagatggggtcaatctactctccagagtagctgggattacaggcttctgcatgtggatatccagttttcccagcaccatttattaaagagactgtcttttccccagtgtacgttcttggtacctttgtcaaaaatgagttgactgtaggtgtgtggatttgtttttgggttctctattctgttctgtgtaagacttaattgcttttaattgaaaaacatttcattgcaactcagtttaagtgagatgtgatttctaaccctcttagaaatttgaaagtccttgcaagcagcttccctgatactgtgtcacctgtgaaagggaaaagatagtgggcaaaattgcctttgctctcttttagcgttttcgtttcttgtattttagagatggggtcttgctctgtcacccaggctggagtgcagtgatgtgatcaaagctcactgcagcctcaaactcctgggctcaagcgatcctcttgcctcagcagcctgagtagctcagaccacaggtgcataccaccaagctcacctaacccttttcactgttttaattttaaattaagaaatatttcaatagaaagctatagaaaatatcatagcagatatttatgtactcatcacactcatctcttatgaaaagcaaaaaagcaagcaagcagttcccagtaaggcgttactgcctcctatagccagattcctctggtgcccatcttgtacattaaactagaaaaggtccaccatgcccagcgcaggatgttaaagagttgtccagatgtgttgagattcacctccctcgccccacctcactgcccctccctgccctctaccacgcattacaatgcagagcatcatgatgcgaggaaaacagccacagaacaagtccacaatacaatccagagatgttcagtccatcaacagtgcctctcccctaaccactgatccaatctttgaaccctctccccacagcctcatggtattctaggaggactgtgggccttgtagccaggccaacctggattttagtttaaaccatgtggccttgtgaagttgtgaaatctttctaggccatagttcttccatcttggacagggtggttaggagaataaatcttggggcagcatcttgcacatgcagcaggtgcagagtaatatcctctccctcctgccttccttctctcaaacactcacaaatccctttatgctaataccaaattagaaacctctctcaggtccaaggcagctgggactttggcttcatttatctgttcccagcatagtcagcaaatactagttattattcactcaaatgcgccctgcatggctgggcacggtgactcgcgcctataatcccagcactttgggaggctgaggcgggtggctcacttgaggtcaggagttcgagaccagcctggctaacattttgaaaccccgtctctactaaaaatacaaaaatcagccaggcgtggtggctgattatatacatatatccagaggggtttatagaaggctctgtgactcccagatttattgataggaatcaaatatcagtgaaaagttatttgcctcctccttcctctgtctgtttctataagctccatggggatgttactggggacctgaggaatggtgttggactgttaactccaacaagcaattctgacttcagcctgggagcaagagagaaggctttagaagctatcggtaaggctggcatctagagtggaaaagaacttttttaaaaagaaaaaggaggaaaccataaggaaaagcttcatttcttgggctaaattcctctctaccatctctattcaacccaactaagaaacacacatggccagctggtgaatataaagcaggccttaatgtctgaactgggcttagtatttctatccagtaatgctctagaatgaaatcttctctggcctgcagattttatttgacagcggaacatggatataaacaaaggcaacgatattgcatacactttaaaaattgctggttcactccccgcaccccccacgtcccccaactccccacctcccacccccaggctaaaatgcaaaaatctatggcccgtaattcaagaaatggtcaccagagggcagcactagacaagcagaaaactacataggcagaacagaaagaccagttaatacagctctttaaaaagatttcctgtctctagagatcctaaaaatgaagctacagtaggattaaataaggttgataagtggtggaaaatgcatcatgtttgaaatattgccatatattgacttggaggttaaaacattacaagctgtttcattcaccagtaattaactgtaagctttattcaatatatcactcagtgacttacaagaattaggaagcactcttctacatttagattaaaattcctgcatgaggaaggcatatcggaacatgacaattatggattttctttttaattcaaaaacattcaaaaaacacaaaaggagacttattagagttgaaataatccgtttttttccaaaaaaaaaagtggcaaaaattaaaaaaaggaaaaaacaaaattgttacatgggaaataaaaaagagtccattgaaggacctgtataagaaaatgccttctgctgcagaacactggtggtgactaacgtggtttctgtgaaggaagcaaatgtatgattcattttgccagggcaatctgcatagctgtttgatatcatggtagcattatgcttcctttagggatcaagaaagaaaaacaaaaatagatcctaataagactataaggtctggaaagaacattccccagctcccattgagtccaagggagaggagtggcggggaggaacccccttggtctagtttggctgttcccactctgcaggcccagcagcaggctctgatgtcatgctggggagcaagtgttgcagcccagctttcgtcctcccgaggaagcaaacactggctccctctccagggcctaggggaaggttcacaaagacagaagcaagcaaatgtgtgcatccaggggacagatttttttcctttcttttttctctctttgggaaaaaagagtctcattatcaagacagagcgaactgatgggtgcaaactgcaaggagaaacatgctgtatctcaggtttctgcaaacctcataacaatgaaataaaacatcacaatccagacagagaaaaatattttctgctgtctcaagtcaggtagcaagagcaagagataagtgtattggcagtaccaaatccagtgaccttattcatataatacaaacggacccaggcaacatgacacatatcacattaatattaaagcaaagaaataagagttaacattgtgatatggtttggctgtgtccccaaatctcatcttgaattgtagttcgcataatccccatgtgtcatgggagggacccagtgggaggtaatttaatcatgagggcagttaccttcatgctgttttcctgatagtgactgagttctcataagatctgatggttctataaggcgcttttcccccttttgtttggcactgctccttgctgccgccatgtgacgatggatgtgtttgcttcctcttctgccatgattgtaagtttcctgaggccttcccagccatgctgaaatgtgaatgaattaaacatctctcatttataatttactcagtctcaggtatgtctttattagcagcatgagaacagactaatacagtaaattgatactggtagggtagggtgctgctataaggatacctgaaaatgtggcagcaactgtggaactgggtaacagacagaggttggaacagtttggagggctcagaagaagaaaggaaaatgtgagaaagtttggaacttgctagagatttggagggctcagaagacaggaaaatgcaggaaagtttggaacttcctagagacttgttaaattactttgaccaaaatgctgataatgataaggacaatgaagtccaggctgaggtggtctcagatggagatgaagaacttgttgggaactggagtaaaagtcactcttgttatgcaaagagactggtggcattttgcccctgccctagagatctgtggaactttgaacttgagagtgatgatttagggtatgtggcagaagaaatctctaagtagcaaagcattcaggaggaagcagagcacaaaatttggaaaatttgcagcctaacgatgagatagaaaaaaaaatttctggagataaattccagcctgctacagaaatttgcataattaatgagcagccaaatgttaatcaccaagacaatagggaatatgtctccagagcaaatcacagaccttcacagcagcccctcccatcacagacccagaggtctaggagtcaaaaatggtttcttgggccaggcccagggccccctgctctgtgtggcctcaggacacggtgccgtgtcccagctgcttcagctccagcatggctaaaaggtgccaaggtacagctcaggccattgattcagagggtgcaagccccaagccttagcaccttccatgtagtgttgggcctgcaggtgcacagaagtcaataattaagcttggggaacctccacctagatttcagaggatgtatggaaatgcctggctgtccgggcagaggtgtgctatagtggtgggatcctcttggagaacctctgctagggtagtgcagaagggaaatgtggggttggagcccctacacagagtccccactggggcactacctagtggatctgggagaagagggccaccatcctccagaccccagtatggtagacccactgacagcttgcaccatgcacctgaaaaagccacaggcactcaatgccagcctgcgaaagcagctgggagggggctgaaacctgtaaagccacaggggcagagctgtccaaggccatggaagcccacttcttgcatcagcataacctggatgtgagacatggagtcaaaggagatcattttggaactttaaggtttaatgactgccccactggattttggacttgcatggggcctttagtccctatgttttggccaatttctcccatatggaatggctgtgtttacccaatgcctgtacccacattgtatctaggaataaccaacttgcatttgattttacaggctcataggcggagggtacttgccttgtctcagatgagactttggacttagacttttgagttaatgttggaatgagttaagactttgggggactattggaagggcatgattgtgttttgaaatgtgaggacatgagatttggaaggggccaggggcagaatgatatggtttggctgtgtctccacccaaatctcatcttgaattgtagttcccataatccccacatgttgtgggagggacccagtgggaggtaatttgatcatgggggtggttaccctcatgttgttctcatgacagtgagtgagttctcatgagatctgatggctttataaggggcttttcccccttttgcttggcactgctccttgctgtcaccatgtgaaggaggatgtgtttgctttatcttctaccatgattgtaagtttcctgaggcctccccagccatgctgagctgtgagtcaattaaacctctttcttttataaattacccagtcttgggtatgtctttattagcagcatgagaatggactaatatacattgtaaatctatgttttaaaggatcattcaaaagaagaaagcagagaaattaacatcaacttactttaacactgaggaatttaaggttgaaaagaaatcaagggttattgtacaggaaacctgaagaaaatctacattcttctgtcaataagagcaggccaagggtgaagacaaactataaatgtcacaatgacattacccaaagcaaacaatgaatataattcaatgaatataatttcataatgtctgtttctgctttgacaagcttgcagacaggaaaatgtgccaatgaaaagactcaatgcctgattggtttgacatggccactgagataagataaatggcaataagaagtatttcaaagacctaagagagaaaaaaatgagctaatcgtaggtgtagaagaataaagtaattgatataatctgaagatgtatcaccttggatgcaggaaagtaatcaacaggtaataataataatacataaaacactgtgaaaatgacaagctaaccatcaggctacaaatgtaagcatgatcatggcactacaatacgcagaaacaagaaacagaggtcacctaaggatgccctcagatataattgtgacaataggtgaataaagttgcccaacagacagatttgccagtgtttgctgtaacacaggtattcttttggacttaactgatgcatttagtaaaatgtatgaaaaggccatctaccaaagaagggaggacttttgaggtgtgacagaagcaagacactcattttctgcaggcctgattttccctaactgactcatgagggactgtactaggtagtgattacattccctttaagctctggccttctgagtgtataaaaaccaaagacagagagatggagacagagagggaaataaatcaatcaagaccacttgttcctgcattggttggactgcctatagtacaagggaaatgtgctatttaaataaaataaagatttaatcaaagccaatggcaggtttattcgccaggaaatttctattaatttctattccaatgataggtaactgaatccagagtcatcaaagttgaaaattcaaaatataagcattatcatttgctattgttgtaattaaacagcacaaactcatttgagagactaaaaagagattcattaattttgatagttaacatataataacagataattgtgggttttatttattcaatagaaatttaattgaggatctattgtgtgtcataaattgttctgggtgctggaaacacaaaggtaaaaatgctccaagccctgcaactaaggatctcactgtctagggagggatagagaaacataagtggacaatcatgatgaaataggtaagggatggaaaggagtaagcagttcaaagaggatggcttcctggatgagtggacacttgaactgaatcttacatgacagatgagcattacctaggttggctagtgaatgtctgttttccaaccagagggatttacgtgaacacggcacagaaggaaatacacagcctggtttgtgtgagaactacagaggttttagcattgctggaacataaacttgaaggaaaggaatgtaggtggaaagaacagcaaaggccagattgtggagcgttcctaagaggtcaaagagtttgaactttattctctaggggttatgtgaaaaggttgtgagattttagattgagagggaacaaggccacacaggcctttccaacagacttccttggaggctgaggaaggcagatgtgtggtaaccaaaaaagccagtttggagatcattgcaagagctattgagagcaatggttgtgggcatagaagggaatgaacaaattccagaaatgtttataaaacaaaaatggtaagacttggtcattgattagatgaggatggtaagggagacaaaggagttaaagactccaaggttgataaagtgcatgacatgaccaccaattaaaccaaaatagaggggcaggaacaaggcagaagagaagaaaatcaattgcatttagaacatgctggatctgagatgtccatgggacatgcagctgggaaattctgcaaggaactggacataagatggatgatgagtgaccggcatactggtgagagttgaaatgagagtgtaaaagaccaaccaggggaggtgcaaggacagggtccaagagagaaccctgagcaacacctgcagtggagagatgcatgaaagagagggtggtgagacagttataggacaacagaggtgcacagtgcttcaaaatccaagagagcagtgagttctgaatagaagagagtgatcaaaatctgaatagacatttccttgagaagccattcttctctgcaggatttaaatgaatctaaaaatgtctcagtccacaattatactttaaaaactctaggaaaaaagactacacaattcatcttcatgaatttatttcaaatgtctattctaaaaaccccttgttcttctatatgaaatcttctcttttatcctgtcttccagggtaacagagtacgcagtggccatgattgagaaggtcgctgttcacatgctcgtttaggtcatttcttgagaccacttaacccagttctttgtatttgtcttcagattcctcaccacttaactatctttgttagccatccctggaattttgccaggttctctacatttcctttcctaggtggaacctaacagctgaaatatactgagggcctggtcagtgcatagtgtattatctgcatacagctcagcattgtgctttcttttatatccacagggtttccctgacagctcttttttattttgcaattcacagtttggcttcacacagccagcctgccgtaagtcctattgtaagaattacataaccttcctgggattttagaattgggagcaatcacagggctcatctagtccattttcacacttaaggatttctcctactgtacctttcaaatacccttatttgttgtacagttcaaataactcaagcaaatgctcttcccctacaggtgtgtggcttgtttgcttgttaatacattgtaaagccaacttagtgcataagtcacatttttaatataatagaatgggatggatataatagaatggtataatatgatagaatgggataatataatagaatgggatacataatagaattggagaggctggactaggataggaatgtgttggatggaatatcagagtcaattaaactcagtaaaggtaaatatcatttcatgaaacttctgtttctattggaatcaagggaggtctctgtgtgtgtgtgcatgagctgcatttcttactgtgagttacagtctaaaactttctacattgccctgcagaattactcttaccaaccctagggaaattaattggcccattcttcacttcatcaagcttagctttcctttacattaggtttttcaaggtgctagcatcaattcggctcatctctactctttgtctctttagctaatctgcaaatttgggcaaactgtgtaggatttgttccagtaacattttagctaaataaagaccgtagagtgttattaaggactttctggccaggcacagtggctcatgcctgtaatcccagcactttgggaagccaaggcgggcaaatcacctgaggtcaggagtttgagactagcctagccaacatggtgaaaccccgtctctactaaaaatacaaaaattagccaggcgtggtggcgtgcgcctgtaatcccagctactcgggaggctgaggcaggagaatcgcttgaacctgggaggtggaggatgcagtgagccgagatcgcaccactgcactccagcctgggagacagggtgagactctgtctgaaaacaaacaaacaaaaaaagactttatttctctctctgaccctcatccctctcccctctgtctttcctccctctgtcctcttactcgttctccttcaatctccttcttccatgcccctccctgcatctctttttctaccatcctctgtattttctctggtacctgattggaaactcttcatttgtgttttttggcagcctggaccaaaagtgcagctgttactgctacagcactttatgacacgtgccttttccaacacctctgttaggctgagacttagctctttttggcagatcacaaagcaggagttctacattgctaaaagacataccttcccccgcccttgcatcttctctccaaaacaaactcactgcagcttttctgctactgttgctttgctagctttttacctttggatggagagaagatattcgacccggtgagccactgcatacccggaaattctgctttgatgcgatctcacacaacagccccgttacactctatgactgtcatggcatgaaggggaaccagctctggggataccggaaggtaagagtcagtccactgtggtcattctcaaattactgtggtttaagttattcttactcagttttctttgaaaacacaccgttttaggcctggcgcagtcactcacacctgtaatcctggcactctgggaggtcgaggtgggcagatcacctgaggttggagtttgagaccagcctgaccaacatagcgaaaccccatctctactgaaaatacaaaaaaaagtcaggcgtagtgatgggtgcctgtaatcccagctactcaggaggctgaggcaggagaatcactttgagcatgggagggggagattgcagtgagccaagatcgtgccactacactccagcctgggtgacagggcaagactctgttaagaaaagaaagagagagagagaaaaggaaggaaggaaagaaggaaggaaggaaggaaggaaggaaggaaggaaggaaggaaggaaggaaggaaggaaagaaggaaggaaggaaggaaagaaggaaggaaggaaggaaagaaggaaggaaaagagagagagaaggcaggaaggcaggaagggagagagggagggagggaggaaggaaggaaggaaggaaggaaggaaggaaggaagttttgaaagttttacctagtcatacatacacatatttggctcacacatctggagatcaccagcaaaggtgaagggaaaaatcgtgtgtgtagaaaggggcaagcttttggcttcgcttgttatatgtgtggccatcacaatcagttatgattgaaaaatggctttgagccagaacaagggatgggtctaggtttaactcagaacactcccaaaaggaggaaccacatatccaataagcaaaaccacgcatacataatttttaacatcaccattcacaacacacatacacacagattgtggcatccattcattttttatgtatctcaggctcacttgcttgggacctgtctgggttaagacaatgatgtttacacaaatatttatacatctatgtagatataattgctgcaatccttatacaaaaagtgacccatttacattttcaccaaaatcctgcccaaatgtagcaaagaagaatttacttggggaatttaaaagtttcaaaaattataaagttaacagtgaatggtaggaaaaattcaaaaacatatataaagtcacattttattgagttaataaaataaagagcaattaagttattgtttgaaaatatttttattgtttccttttgacaactttttagaatactttacaaaattgcttttcaaattctttgcttttggggatagaacttggctgtcaattagcaattactccataagctccattctgccctctcaaatccatggacctgctggggccttctcagccagggataagatgccttctgtttgctttttcacactctgaggccagccttgcctcaggctataaggaaaatggaatatcccccactttattcatgaacttggccatcctgtggctgaggcaaggtcagtgtccccccaaattacagaaagctaaaggagagaagtggtggagagtcagtgtggggagagggaggactggttatgttacttgttgccttacttaataagcattctggtttccacctcttagagatgagctcctaaaactatactcatccaaaggtggacttgtttgtataagtttattctgcatcccacccccacccaaacacctggcaggttgtggctgtgtctagcaaaattacaaaacatcagttgagccgagcacagtagctcacgcttgtcatcccaacactttgggaggagaggcgggcagatcacctgaggtcaggagttcaagacaagcctggccaacatggtgaaaccccatctggactaaaaaatacaaaattagccaggcatgttggtgcatgcctatagtcccagctactcgggaggctgaggcaggagaattgcctgatcctgggaggcagaagttgcagtgagccaagatcacaccattgcactgcactccagcctgggcgacaagagcgaaactccatcccaaaaaaagcaaaaaaaaatcagttgttatatccttctacaaaacaatctagaatgaaaggagctcagaagatggtatctgattaaaaatgaagctgggggaatatcactgcaatagtaaaacctcgccgttttctttatgaaatgtataataaatgattcatcttatcaaactattttgctattcaacatgatacagcctgtgtgtggtgcaataaagtaaggttttttttaatgattatattctgacatctaaagagttactttctgcgcacatcgataaaatagctgactggccatttgcttagtatgttagtggttcctaatgaacagaacatttcttattactgtacatttatagcatgacacaccaaccactcaataatatgcaattaagccaagaaaatgcaattgtttttattagggagcttacaaaagtttacagatggataagaacaactaatacacagagctcctggggagaaaaaaaactggctgcagtggtttcaaggggaaactcttatgagctttaatattaaacctttccaggatcctaagggatttgtgaaaggaaaccactagattcaattgtgctgtggctctcttctcagctttttgtagctgttggtattgcattacttagcaaaaggttacactccatgtgtatttatatagcaagcaaggtatttatacttaatcaggaacatgcaaaggctcaaaatggaaagtttctgaaatatcacatcttggtggatgactcaggcctattcagacacacctgttttagaaaattcctcttgttttttccaagggctatgcctaaggcataaagagaaaaagcacaaagagaaatctctctggtgtgttaccttatctatttggatgcagtacttggctctgggggcttctggcagttttagatgtttttgtttgttttttgagacggagttttgctcttgttgcccaggctggggtcaatggcgtgatctcggctcactgcaacctcctttcccaggttcaggcgattctcctgcctcagcctcccaagtagccaggaccacaggcatgaccaccatgcccagataattttgtatttttagtagagacagggtttcaccatgttgaccacgctggtctcgaactcctgacctcaggggatccgcccaccttagccacccaaaatgctgggattacaggcacaagccaccgtgcccagcctggaactcccactttttataagtgccatgctcttaaggaataagatcaatatttcctaggagagttccccaatgccttggattcagtgtcactgataccagccaacccctccctcccagctacatggagatatcttggagagagaaggtggccagaagccaccttgcttgggtggatgaaagttgttttcggaccttgcttcctggtttcagcaactctcattccgcttttagttatttttagatgtggctctttgccaccacaaaaggagaaaagcatccttattctatgatgctggggctatgttcagttgaacagctgtttcctacaataacaggcacccaggaagaggaatcctgttcctggttttcttttaccaccagggggacccctgttacaagaacagtgaattgttgaggcaacctcagtaaaaatatttgtcctcacccagcatcaaacaggaaactgtctttcctcttcttcaatccccattggtcactaagatttgtcacccacttccatccccagtcattggtcactaagacttgtcacctgcccccatcagccaataactctgaaatccacccgctctttgccatttctatagccagcccctgcctggttcagtcttcacatcttacccctgggttattgcaatggcttcctaaagggctgccctgcttcctgtctttccccttccccttccccatcttccaccctgaagccagagggagatttcacaaaacctggtcatggtattcctctgtttcatgacttcatttggtttctcattgagtagaagatagagtgctttagcctctcaatactcatctggatccttcacaacctggccaacataacagccgaccatcagcccttagagttattcaggcttaatacaccccaattcatcctgaaattgtaaggggatcttgaatagttgttttgcttttatgactttcaagtgcttcaccaacataataatgataataactgagtgagataaactatggaaaacttctagcacagtttctgatcataagatttccatctgtgttggtgacaatgcactttttacactgatcatcatggcaaggtatatcctaatataccacatcattaaagcaatctctcctaggcaatattgacagttgttatccctccaaaattgagcgctatctcccatgcccttttcattttaagtaaacattttattagattatagcatatgtcttaatttgggtttccccatatatacaacctaaagtaagaattttaatgcacatggtttatttgggatatagccccaaaaattcttgacagggagtgaggaagtgaaatggaggagatatcagagccaataaagggtgcattatcaagcaagtaccaccgcaggcaattagaactcaatcctactgaagatctctggaaatggtatatagaacacacatcagggagtcaattttttggtcaggttcctgaccaaagattgactggaatggtgtataaataccccaactcccttgatacctctggcctgctgctcttacagacagaaccattcttaaggccggagaaagtccttaagcagagagatgcagtgacatccgggccagcatgcactgaaatggaaaggcctgaagggccatgctcagggtacaggcactgccaagaatccaggtgctctgcatcctcaccaacacttggtattgtcagtttctttttcttttttattctgtgattgtaaagtgatatgtttgttagccattttggatatcttatttgtgcagcacctacttgagtcttttgcccattttcaaaacatgggctgtctggctttttcacacagatttttagggattttttctatatataagtgcctcattggatgtatgcattgcaatatcttattcttgttggtgtcttgtcttttttctgtttagtggagtgtcttaatgaaagctattatttatgattcgtgggttttgtgttctgtttaggaaatcctggccttcatgtagttagtcttccaagtcatctttggaaattttattgcttaatgttctacatttcggtttataattccctgatatatctgtatatctatatagatatatataattttttgagacggactttcgctctgtcagccaagctggagtgcagtggtgtgatcttggctcccagcaatctccacctcccgggttcaagcgagactccttcctcagcctccccaagtagctaggattacaggcacatgccacccagctactttttgtatttttagtagagacggggtttcaccacgttggccaggctggtctcgaactcctgacctcatgatcccgcccacctctacctcccaatgtgctgggattacaggcgtgagccaccgcgcccagccctccctgaaatatttttatgtgtataatgtaagataagggttgattcatatacagagatagaaatagatatagatatatattgatagagacatgctattgatcaatcaccatttatttaaaagaccattttttcccactgcactgaagtgacgcttttattgtaagtcaagaggtcttatatacactggtccattgttaaatcctcaagtttttaccatgtaactaaatagtcttagccatacagaaagtaagctaataaaataaactaaattaatctaataggaagtatagccaaaaacccacaactaccatcactcttagtggtgaaatgttaaagctctcctccagagatggggaataaaatagaatgttgactataatcatgtttttcaaccttttataggatatctaatcagtgtaatcaggcaagatatagacctttaaaggaataagaattggaaaggaagaaataaaacagtccattcgtagatgtcatgttagggtatttagaaaatccaaaagattatgcagctgaagtattttaaaaatgaatagatacaattagcataggcccaagatgaaaatgaattgtttatatactagcaacaaaaaatagaaaatgaagtttaaaagtgattccatttggtcactgtgaaaagcacaaaataggaataaatcacggcaaagatgtgaaagacttttatgcagaaaactacaaagcatcactaagaaaaatcttaaaaactatagagggatccatcatgttcaaggattatgtctcaatattgtgaagatgtcagtttttaaatgatccaaacatttaatgcaaaaccaaacaaatctcaggaggcttatttgtggaaattgataacctgattccaaaatttacatggaaaatgtaagggacaagaatagctaagaaaatcttgaagaaggaaaaaaaagtactaaaacattataaaagcaccaggtatcaaaacattacaaaggtgtattattaaggcaatgtactcgcctgaggatagactgactgaggctctctagaaggtgaagcctgggtattgatattctttgaaaggtcccgagagattctaatagacagtcagatggagaatcacttttgtagctctaatttttactttctttctttaatctactcctcccttttgctctagttggaatttccccctctttctgtactcctatagcattttgtttccttctttctacttaaaacactgtatattatacatacttagccccctcacccccgccaactacctgagggcaagaactttttaaaaaatgtctatatggcctgcctaatacctaatatatgaagttcctaaataagcattcattgactggcttaaagaaccactagttcaattattgatatgagccctgccttcataaaccccaacctgtgctggataaaacttaacacatttatttgtctcaaaactacatatgcaacctcccaacgaccaaaaataaaagatttaaaattactttctttagttgctctctgggggttcttataatttaactttcataataaaggacttgcaaatagcatcaaacaggaagtacaggtaagaaggcacctgccaggctaaattgataacagtgtaaccattccattcatttaaaaagtgagtgggtggaatttttggcatctgcctacatttgactatttgttgttaacttatgatatatgccaggttttggcctctcagttcataaaatgaggatgtaccagtccacaaagatgccagatagaagggctcgaggttgttattttaaatcattctggacaggtattgatttgggaccaaaaaataaggaaagtgtatataacaagtttaacttaaaagtcatgtaattcaactctggttctgataaatgaagtcactaaaaaatcctggacatgtggtcagaggttgggcagtcacactctcccaggtcagtcctaattgccagaaagctcttccctggcctttgattaccacacagattatatttaattcattttactcaagacagatcccaaatatttgaacaaatacctgcctggtttttaatccaattaaatggcccaatttcctgccactgctctccatatgacttaatttgaacccacctccatctcctggacactcacccctaaagtactgcagatagtcttagagagtaacatgattcccagaacacaatattgtaagaatgttgtcaacaaagaaagtagaataagtttctagcaccttttgttatgagcttctagcatgctttgctgtgagcaatgtctctgttaatttagcctgagttgattgatttcctgccttaacttcacacactcagcttcttaatgagctttcagtactggagaaaaaaaatctcagtctttttctcttgctttgctaaacagacatatctctccaatcttatatctgtacaggtcatcttttacattatgttgctatccacttttttccattaaactctatcctattataattatcccaacctggatttaaacattttgattcaacttaatagcaattgaactataatttgtttcatccacagattggatcagcatccattcatgccttcatctaaattgttgatcccagtgcaaagtcaagcactgagccctctatcatacagcagaggtaacaaaatccattaatgagcatcatttggaggaagttactcaaccagataaaaattcatgtaaaattatcttctagaccaccgttctccagcttgcccataagaaaacaaaattggactcttcaaacatcttgctgaaaaccagatgcccaatgtctgcaacataccccttttggtaacagaggacttatgttatcctaagaagttgtgattcttatgcagaaaatttcagtgcaaattgaaaattcagttaccttttcaaagaagaattaggctaactctcaggaggactatacattcgccccagcaatgaagctgccttttcaataattaattctatcttcccatcctgtttttagctgtatgtctaacccagctgaaatcacttaggttgttatgaccttctaacttttgccatttcaacttagcaatattcctactgattacctaacatacttaactgccattctctgatcactccgaaatagaaaggctctgttacaactctcctggggctcttccgtaaagagaaagtctttgtgaactgaacgcctgcccagatctagactgtcaaacagaaaagaatcttgttaataggaactatgaaaaaatcaaattagtgtttgttgatcaggacaattctttcctaccaagcaggtgcggggtgggagcaggactggtagttggctcagccaagaaaagagatgaaacataactcaaagactctgtgcccggtctgtgttcttaacctctgagttacgtttcatccctaatcctagcattttgggaggccgaggcatttgagaggccaagacagatcattagagcccaggagctcaagatcagcatgggcaacatggtgaaaacctgtctctaccaaaaaaaaaaaaaaaaaagctgggcatagtggcacagacctgtggtcccagctatttgggaggctgaggcaggaggatcacatgaacctggaaggactaggctacagtgagtcatgccactgcactcctgcactccagcctgggtgacccagcaagatcctgtctcaagaaaagaaaagagagagagagagagagagagagcacaggctctggctcctgcagggcctcataatagtcactggccccactgtggatgctggctttgggaccttgggcaactttcttactatgaatttctgtttcttcatttataaaatgggaataataattccctttattatctactttagtatgtgccttagcaggttattctgatgattaaaaaaaatttaagtgcacctagagcatagcacataacaagagttcaattgatgttagccgctactataccatgcattcagcaagataacttctgatttgattttcgctctccaaatagatttgcatacagaaatagatgggctaactagtcatatttctacactgtacatttctgtactattttaactatttagttatagctaaatcttagaatatcaatttcatgagagcaggaatttttctctgctttctttcgtgcactctttccggcatctaaaacactctgtggcacataataggtacttaattcaaattcactgaatgaatgaataagtgaatctagcttcctgtttgtccacattcactatctcttcaggttgcttaagtgggtttaggtagggaaaaaaaaaagagagagagagagaaactctgggtagaatacttagcactgcttgatgcctagatacacatttgacaaatagtagctattatgttcacatgacttcatgcaggtttactgaggggagctaaagagatatggatagacggaaacaaggtgcaaaacttacgggcttattctactcatggagatttcagtacagaggggaagcggacaaatactacttaaaggaagtgtacaggataatatgagaacacaaaacactgggcactatccagatcagaagggtgaagaagccttctctgacaaactaacttctaaatggagaccgaaaagatggagacttttacctttttagataggtaaagaaagtgatggagaaaaagaccacagacatctggatcaacttgtgcaaggccctgagataagcaagatattggttttctcagaacagaaagaagccagttgaaatgcatacgtgcaacagaaaatgaactattaggttggtgcaaaagtcattgcagtttttaccattaaaagtaatacaagggctgggcgctgtggctcacgcctgtaatcccagcactttgggaggccgaggcgggtggatcacgaggtcaggagatcaagaccatcctggctaacacggtgaaaccccgtctctactaaaaatacaaaaagaattagccgggcgtggtggcggatgactgtagtcccagctactcgggaggctgaggcaggagaatggcgtgaacccgggaggcggagcttgcagtgagccgagatcgtgccactgcactccagcctcggcgacagagcgagactccgtctcaaaaaaaaaaaaaaaaagttatatacggtcagacatcccagcctgggcaacatggcaaaaccccatctctacaaaaaaatacaaaaattagctgtgtgtggtggcagcacgcatgtggtcccagctactcaggctgagagggaacgattgtttgagcctgggatgtcgaggctgcagtgagccaaggtggcgccactgtgcttcagcctgggcaacaaagtgagaccctgtctcaaaaatataaaaaaggccagacatctgtagaagcaggactacacaagaccttgtaggtcatgctaagaatttagctaagagagtgtgaagtgtttgaatggattgcagagcaggcatctaacacatcaggattgatttttttttttcatgatcccggctgctctcaggagaattgaggatagattgtgcacatcactggaccacagcccaaaaatgctggtgagaagagcagaaggagggtttgaaggtttgctgtagccagcaccgtctcagcactcacaccaaggggctctgtcagggcattaagaaacattatttcttttcttttttttttgagacggagtctcgctctgtcgcccaggctagagtgcagtggcgtgatctcagctcactgcaacctcctcctcctgggttcaagtgattctggtgcctcagcttcccaagtagctgggattacaggcatgcgccaccatgcccagctaactttagtgttttttagtagagatggggtttcactatgttggccagtctggtctcaaactcctggacctcaggagttccacccgcctcggcctcccaaggtgctgggattacaggcatgagccactgtgcccagccaagaaacattatttctgattggccaaattaaccactgatgcaggaagaccaattttctcctccagtgaggaattctagctgtcaaaaaaaaaaaaaaaaatggaaaagggtagacaaaaagactgctttgtcccttttatgcctatcaaggtgttatttgcgttctctcagatgccaacagtaaaaataggcagaaaaagcctccttgatttgtccttcttccagatggctcaaaggatagtcaaatatcaaccttgttcttctgcacaaccctaagaggtgggaaagcagatcttttaattccctgtctcatcccactcccctcctgcccactccattcactttacagatggaaaccctgaatcactgacaaactaagtgaccacaaaaggttattgtcagagataaaactaggattaaaactggtttcttaattccaagccttcattccctcatagccatattagacacaaaaggctttggacaggaaggagttctctcttacagaaacatcctcttccaatgtatactcttaaaatgaatctttctacttacatggaaattgataggagggggtaactcgagtctcccaacttgacacagaggagctaccctgagatccagtctatatctaactgctcactgggcatctaaactttgatgtctcgtaagcatctccaactcgtcatacctaaaactgaactcattatcattcccacaccaatcctgtttctctttctgcatttcttgcctgaatacagcttttcctctagacatccacctcctccctctacctcaacctccacatctcattaatcagaatgcccaatgcatttcacttctcagatcactccctgggtcacccccaactcatccccattggtctcgtttttgcatcagctgaaatctgaatcattgcggtagcctctggtggttctctcttactgtagtccaatgcctttccatccctcctccatcttcctcactgccaccctaactatagaccctgtgactcttgttcaaatctcccaatgaccattccgagatactttcatgagaagtcaatccttagcactgtaccaccatctcatcatgatgtagcccctgcctacctcttggatatcctcgtctggactttttccccttgctccagctataccatatgacttgctggtctgtggcacaagacccaacctccatcacctctgacaacatctcctcactctggcttcctcattgttctctaaccaccagggtgcatagctgcttagggcccagaccctggccattccctctgggtgggaaggtctgagactctttgcatggttaattagcttaccttctttgagactcctcagatgttaccttctcagtgagattttccctggccactcaattcaatgttcacactggccccacccctggcactccaggtccttctgaccgccttgatttttttcatgtcacctctgaacaggctatgtgtttacatactatgttcattgctcattgtctgtgcccccactgccccaacctcacccctacctctggaaaagaagctccaggagggcagggatttttgtctctttaagtttatattccaagcacctaaaatagtgcctggcaaatagcaggtgcccaatatattttttgttgaataagttgaatgcataagtatatatattattttatatattttttcatatgttcttccttaaatctagaacaacctaattcatatcctactcaccctcatctacaatctcattgacacttttttactacaaacatttctttttttttttattatactttaagttctagggtacatgtgcacaacatgcaggtttgttacatatgtatacatgtgccatgctctttttttttttttttgagttgcagtttcgctcttgttgcctgggctggagtgcaatggcgcaatctcggctcaccgcaacctccgcctcccaggttcaagcaattgtcctgcttcagcctcccgagtagttgggattacaggcatgtaccaccaggcccagctaattttgtatttttagtacagacgggatttccccatgttgctcaggctggtctcgaacttctgacctcaggtgatccgcccgccttggcctcccaaagtgctgggattacaggcatgagccaccgcgcctggcctactacaaacatttcttgtttacctattggtctcccctatgtcgtgggtcagttggtgcctcttaggttatctttccatgctctctcctcatacacaccagaaaataaaagtcacttcataaatatttgtcaaactcaactgatgtgattaatgttatcttctaggcaaaggacctaaacacatagatcagatacaagatctgatcataattgcacagaagagctcatttcagagccatagataccttctctccataaatcctttcggttaaaatgggaggtactattgcatcaatttagataaccagttgaggcagaggctaacttttgaaaattctattttgccaggacttcagaaaacacaatttggtgtcgaatagctggtctcagaccagatggttggtacattctgatttttagaactagggatgctccctgactgaaaacaaagtagtggaaagggagggaggaatcactattacttagttatttacttataggcaggacactatgccagtgattttatatctattaactctttttatcctcaaaataaatatgtgaggcatactgtcatttacatgttacagataagtaacctgaggttcagaaaattaaacaagttgtccaagattacatagcaggactgaaatttgatgaatcccctacgccacaaatccaagcactttccccatgactgttgtctctccgccccctatgtggtagtttcattcttggaatcaccttcctatatataatggactcatatacctattttactatctttgcatctttagcatttggttcttttatgaccagtgtggaatcttttctgtaactcacacattcttttagagttcagagcctacaggactatggaacctaataaagtctagcacaaacccatgagtgccacaaagtgtcacacacatgccaatcaagtccacgggcctgctacaaagaagtgcccctttcaatgagctacctggaaaggcacacctacacttgccaagggtggaccgatcgactggcattgagcattgattaggaagtagtcctggattcaaacttttgcatttcctctcaaggatttctaattttctcaggcaaaacaaaacaaaaccaaaacaaacagaaaaacacaaaaatagatggagtaggcatccaggaaaagtgggaggagtaaagggaaatgcactgctggattacactgtgaatagccagagcacaggccatgccatcctccaggactggacaaagaacaacctagttaaaagcacagaaaggacatcttctatcgtcctttagggagggttgttttagaacagcagacttgccgaaacactcagaagtctattccacaaaaaaaactgtgttcagttctgttacagccatcaatgctgtgaccactgaggtgaagggcagaggagggaaaggctgtcatagaaccaaagaccacattcaaaagacaattacttgatccactgacttaagtccaaccaggaaaagcaccaggaaagacaattagtgattcacaagctcagctgagtagaaacgtaaagatggcaatgatgtagcttagccccaaggtcaaaagtggaaaatgcttgctatgggcaaggcagagggtgctttgagaagcttcacctccgggacttgctgagcactcccaagacaagggtgagcagagctctgtctccaaccagggaacaattagtctgtggatctactgatcactgtggatggtctctagtttgacacctcgtcatttgtctctgtcactagtgacctttggaataaaatgctcattcaattttatgactaggagaggctccagagatttatctaatcccccccacctcattttactgatgaagcttctcagacatagacagatgaagggaatccaatttttcaacttttatgagaacatgaagtacaagaacagaaaacattctggatggttcagggtagtggtatatttgcatactcgacttggttcagcccaggagtacacctgtatttctcagagcatgtgttccaatatgggatttggaaaaatatgatcagttgatggttcagaaaataatgtttgaaaaaataaaatgttcagaaagtctggtttggcatttgcatgcatactgaggtacacaagctagggaagaaaagagaatagaaacatgtcctactccttttctcatttcttaactctcatgaagttatgtgttttgagggggaaattgtgctcatctggagggtccacatgagcatttttttttttttgagacagagtcttgctctgtctcccaggctggagtgcagtggcctgatctcggctcactgcaacctccgcctcctgggttcaagcgattctcctgcctccgcctcccacgtagctggatttacagatgtgcaccaccacgcctggctaatttttatatttttattagagacggggtttcaccatgttggccagactggtctcgaattcctggcctcatgtgatctgcccgccatggcctcccaaagtgctggaatcacaggcgtcagccacggtacccagccccacatgagctattgataaaggtaacaacaggaaaaaatacagatagtgaagagggggcaagaagtgcatgtgtatagaacaaagtgaattagaatgtagcaggtcacctagaatttttatgactataacagcttaagagtgctctttgaaaaactgacctaaatgtattagatccgtgtagcttcactattggttggggctgggagaatgagcatgagagatgctggggaagaagagagaagacagcgaaggagactgctgcctgaggagccacagcagcggctgggagagggcatctgggacagcaaatatctaggaccctcagaaagaagggctggcggagtgagctgcagcctgcattctccttcctcctggaagctgcttcctccaccccagaggagagggaggagagagtttctcagagtctttccctggggtcagacacgggtggaattaatgaagcaagatggaaagaaaatggcaaggagatctcaggagccctctttgtgtaaggaaagtaaaatccacaataaactcaggaaactcataaagagagcagaagagaatagcaagcctttgtattaggcacagctctttgtttacactgaaaatagaaacaggcaaactaaattgcctgcaggttgcctttctccttccttattctttcttccttcatgcagtgcttaactatgcaaacatccggatcctaaaaggacattaaatattggttgatggagtcttaaaatccaggagcaacccagaaatgtttacaaagggtgcctgagaaactcctaattctaaaagcattgcaagtttagtattcctcagataaaggtaaccagagcctgtaaaccttccctaaactaaataataaaacattacttgatcttaaaatataagcagggatttggggatgttttcttgtattattggcattatagacaacattagaggtaaaatttattactagttaggaaatttttcttttagcattaccttttccccacttaacacaattaaaagagggtgtgtgttaacagagcttgttcagataatgagcttgctcactacttaaactttctgtcctcgtggtatattttcattcactgagctgttatctgcatcatgtacctgggggcttttttaaaatgaatgttgcctcctccattttgcagaaagcaatgagaacggcagcactggaacacctgcattatatcaataaagggattgagaggagactgaagctcaagaactagcaaatttgaatttgtacattcagctattgcctgtgtgtcccttgtcccaaactcatattcatcttctgaaaagggcagctgagaacccggcacttttgactgctgcttttttttttcttttgtatttctctttcccattagagattcaatgtgagggaattatgactcttctagtcattgtgtgtgcgtgtgagcagggggtattatttactgcggactaaaatacaattttttgtgtatgtgtttcttcccagatagctacattattggttacttgccaagcaaccccatatacttactattttcaaaatttaagcagatagcaaaaagctcaccacagagcagaaaatgaatggattgcttttttaaaagaagtggatgattgaatgaataaatacatttattgtctctaattgaacctgcttgtaggccctacatagtgccaatacagcctacaaattcacattccacatgggcaactccacctgctattgtttgatttgggagctgttctatttacacaataaatatatactgaaatataaacagaaatatcttacttctgtatattttgggttgtaaccattcaccacgtattacaacagtcttttcttttcttcctcactcctccaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaa

SEQ ID NO: 1242 - DNA, 118591 bp, Homo sapiens
ttcacacagttcagcttttattaaaattaaaggatgggaaattagaacatgattcctgttaaaataatacatttgaggaaatgtttcttcagctattgctgtaactgatcaagcatgtgacaagtgttcttttacaagatatacagtccctaacagccacgcagagaacaccagatcgaggatcttacctatgcaatatgttgtacggggtgtcagtgatcaagtctgactggctatgacaaccacagggacagagcacccacacagacatacacattcagtgtcttcagttttctttcaacgaaagcattttacacataatatgcaaattaaacaagaagtacaacaagggtcctctattgccactgaaaatgaggggaggggaggatgggggagcgaataatttacaatctcataaccaaacatggcactagggtgatttgatgctgcaaatgccacagtcctgtgcattcctgccatggctgatgctatatccatgagtcactgagtcccatgacgaaggctgcacaggggctatgaggctgtaattatccactacagaagaaatctcttccattcccaaatgctggaagtgctgctggctctcctgcttggtcagtagaaacacagcacagctgaacatgaggggcttaggactctaaatagtgcaaacgcttaaaaaaattacattctaacctccttgcttctccaggcaaacagagcctttaaaaactccaactaactggaatatgagtttgctcagcctcccaacttgatccagctaggtgcaaatggggagcatggaggcaatttaaatggcacctgtcccaacaataataataataataataaattttaaaaaccatgatgcaaatggcagataaatacacaaaacagagcctggagtagagacatagctcaagaagcaagttgtaagtgtagtgtgagcacctgcaaagcatatgcttaacacacagggatcatgaggattgacccctcttttaaaggttagagacaagatgctcccaaaaagggcatcatccagcagcaaaggcctcaagctattggaagcttcagatcaacaaggagatagaagagaataaggaatggtcggctggacctaggacactatgggagtatgtgctgggggggcaggcctttccctgaggcttctccatgccacagggtaccaggctcagtgcccgtcagtgggagccaccacgagacagcccggcctcacccccacagaaagcagactccaaaaaaaaaaaaaaagacacaatcaatacagacgggcaagtgctgagtcgaacataacatcagtccctagcaattcaagaaacaccagtgactgcgttttaaaattcagcagactcccttgaatatggtatttttaaaaaaaaaaaaaaggctcatctacctggagctactgaaaaatatgtttctgaagggtgagaaacaaaaggaagagagctacaggcatgaactacgtttgagagtgaatgatgcaaagaacacaacatttcattatcatggacaataaaaagcgattcaaactcttgaaaaaaatatcttataaaaatatctacgttaaaattttagcctaaaagctatagcttcaattttataaaaaggcaatctttgaaaggatctggctcagaaatatacaaacattacacaacagatatcaaagtaagacagctcaaaaagcatcttaggggatattgcaactggcttgtcgggaactagaattaagtattcttattgcatagcagaaaatgaggtcagttttatttgcataatactgcaactttgtagatggagagatgccattgggtacttatgagaaataactttggaattcagaatctgacttctacattgttcaaatcagtatccaagtggcgtctcggctgcttctaaccttgggcctcaattccatttcaccaccgcaatcagatgacagatatgccactggcaaagctgcattcacaagcagccgtggccaccctaagtggggcagtaagaggcttcatctaccacgtgaccagcacaaactagaaaatagcctgctgtgtccactgtggaaagagaatcgtacctggtgatgaagagatagcaggttttggtggcatctgtgggcagctagagcagattggctttggtgatgacgtaccagtgttctggtccccgtgaaaaaggatacatgaggatggagtgcacatggccttggcagcacgcccagtagaggcagtgctttgtagggagggagacatgaggtgaaaccaattgcaaaaatccaaaaacagaaaacatgactggctagctttcagtggagggacccttccccggaagacgacacataaaagtagcctctcccgcatgaaagtctagcttctcagtggtgggggaggggcagggaattcacctatcatctgaaattgagagcttctgtgaatggcatacatcagatcccaaccccagcctcatccccatcacacagacacaccgaaacaagtctcaaaatttcctcagagaaggagaaaggacatttctcattccatcagcttccaacccacagccaggtagagttatgaagccacagtcatccccacttcatagtgagaccagagcactcaactaaaacatgccttgcttcctttggagacatttcttccaggtcccccaaagctggatattttagcctcttctgaaggcttctaaaaattctgggtaccttgttgttctccaagcatcttgttgaagtaacatgtgcttaacatcagaaagagaagttttgtctttaggagagttgcacatttagggcacaataaatatacagtaaatacacaaagtggctcactggctgggaagacttcggggtttctaactgcaggggctgggggatgccaatctcctgcagcacctgcttggaagtagcccagtcgtatcagaagtccaacatcaggatttataaagttccttggcttcctgtaggtggattctcaaagtagggagggtgtcccagactgcaaggtatgagactattctccagacacaagacttcccctgcttatgccagaaatttcagcatgagcaatttgctagtttaggaacagcacaactttaaggttttttaaatacaaattactccatgccccctcaaatgcccgctcctcaagatgcttgaagttctattgttaataatttttacctgtgaattagcaaagctctcaccaagctccctttttaaaatgcaagcacatcttaggaagcctcaaatccaaggcccactgatatctcctacctcacagggaaagcagtagtggggttcttgggggttggggagagggtgcacaccctggaatagggggaaagcacaagaaaaagaagacaaggacattagacagacttgaccactgtcacaaagtgccaagggccagctctagtggtatattcctttgaagccatccaatgtccatctgaatcacacacgaccccatccaacacaggcacaaatctatctttgggtctggaggagggtgacctcttatttatcctccagaccagaacacttctgagtaaaatggggtgctgtgaataattaaactgggataataagtataaatggggactgtcctgtcctgggaaaacctaaaagtaggaccctctctgagaccattataggcaggaactgaatccttaccactttggttttttgtttttttcctgtttttgttttgttttgttttgtttttcagtgttacccgaggcttctctgaagagctagttttcccagctgaagagacataacacctcccaggcctggaatctatgacatcaaagaccaatggcctaaacctgaagactgggcagttctcatctgcttcctgtaggagaactcaaggaaaaacagtgagctgagaagcacagggaacccatttgtcccttattctagcacacagaggacacggtgcagcttcgagaattttccagctcttctgcagacaaagtcacagtagttaaagtacataagtgggtgtggccagagaactgcccctctcactggttatttctggacattcccagactgtccaactggaccttcagaagaaagcagctttagtagtctcagggtccccatgggacaaatccagaagagaggtctctgtgacttgatttttaacacagcgaaaggatcagtagtaaagaaatccagtagactgtcacacacgctcaccccccaacttagagaaacatagagaaacaccatggtctacacacacacacacacacacacacactccagggtctgtattgtccctgtagaaacaccaaaacaaagcccaaaggtgctgcctggggatgtcaagaccccccttgctcagggcataggccagagcacctcaggggaacgggggtgggtaatggtgtccacactgcgatgaacaacaccagtctgccaagtcagaggagagcggttctcacagcagcacagaccctcccaagcaagttgaatccagtcaccaaggtcctgctgttcagagtcacaggcagcacctgctccttcctccacctcctggcagtaggagtttgggtcacaaggacttgtgaatcacggcaacacctaataagaaagggggagaaagttatcatcttagcttctccaaaattactcagagtcccagtgagttcatgaatccaagatatcctgagtcacagccaagggaaatgtgtgcaatttttatcctaatattgaagtggactcaggctgctagcagctggctgttccccactccaacagccaagtcctggcaagacacttgaacctacgagcacagtccctcaaacaccactgactagtggcctcaccctgtgtcatcacatggactcactgtggtgactcccatccccagccctagcacccagcccaacaatgctcagcgcccaggggcagctatgcagttctaaatttgaatcactgtaagagaagcaatgggtgattcatctctacttttagaagacactggaatgaagcggaaagtacagcaggctgccttcatgggagcaagaaagactgaattccattcctagctctgccaccagtcaacctgcactatggcctttggcaagttctttgacctctttaggctcagttcccacacaaatgtcatctaagagaccctgccagtgtgacaatctcgactttgataaatgctccagacatgtatgctatgttactgttttagtccgagtgaaccatgctcagcacctaactataaatccacgcatgacccaaaatctcactgtaagggactgaggctacatggcagatattacaggttgattccgtcaacatccttcctacttgctatcctcgactacagccaccagcaagttgcaagctcaggttcccagactgcctggcagctagatgtgccacgtgacccagtgctggccactaagactgtaaaggcaagtgtgccagtgttgcaacgctggctttgttcttgttgtgactggaatgctcacgcaaggccaaggggaggcagcagcccttgataaagctggcagaatagaaaagagaagagaaacctggttctgtcagtctgagcccccaggccaaccttggatttctttctacttgagacaaatacactcacttccttatttaggaaagtatctgtcagggtttctggtgcctgttgctaaatgaaatcctaacttacaggtgtttacaggcaggatattactgcagccttattttaacatagtcccacaactatgaaatgttctgattgaagatgagattgagagaacatggctaaaatcaagccaggataccccactggagatattctgctaagacatctatttcctgtttattcctggctaaaggtgcagacacagaagcttcaaggcaggcagaacctgagtccaggtgcctggtcttgacagcatcttacttgaatctcagacatctctttcagaaggtagcttttttttcttgaaagcaggctcctgtgttgctttttcatataacctttatcttaataataaaagtaatatattctcattatgggaaatctggaaaatgcagaacacaaagaaaaaatctttaatcccttcacacaaagaaaaccaccactgtctttttggaatactttctagcatctaacaataatcacaatcatttactgcatggtgtctaatgccaggcaggcattgtgcttagctcttcacaagtattactgcatttcattctcacagcaccctaaaaggcttagtctaattttattcccattttacaaataagacaacaggggttcagtatgatagaatacctggcccggagacccagggctagtggcagagctgggattcaaattcatatctgactccaatatccatctgtagaagaagcagcagctattcaacccccactcccactaccaccaatacaggactatatgcgtgagttcacaaggttcatacaactttgcatccttttttaacctaacaggctattacaaatgttttctcataacattaaaaatccataaactatataaatatcccatagattattagctatttccctcatgtcagacattaagtaattctcagttttttgctattacaagtaaggccccaataaatttgtccataaatctttgtattttggagcatttccttagactttaagataatagactcagtaagtgggtttgaacataaaattgcaggtttgcttgtctccttcctacctacttctggagagggcagacaatgaagaaagggacatgaaatattcagcatatatatgaaattctaaccacccacacttaactcttcccctctcattaaggcacacatggagtcaagggaagattcctcacttgtctcactcatcccagaacagaattactccaggaccaaacttcttctaaaatgttttatacttagccaagaaaagtattacaaggtgaaaaaaactctaaaggaagaaaaaagttaaagttcattacaacagaagtcttatgttgaaagaatgtgctgcaaactccttcaaatttgcacagcacaatcttcctctgcagtcaaacaagatggaatgactgacctttataatgcaaaatgggaatcggaagaatattcctggagtcgtggtatggattaaaagagataatgactataaaatactttggataatgcctggtatgttctgtgcatgctggatcaataatgttatctctattccaggttctggaaaaccagatacaaggaactgaactacaccatggatatatatttgctcatctccccatggacccaaccttagtagtaccaactctgatgccacccctgcccctgctactcaccaaacccctcacacacactccccaagaagcttccacacccgcctggtgccttactctaaggcttaccctgagctggggtagcacaaagggcatggacttagaactctgggtttgaactctgactttgccatttattagctgtgtggccttcagcaagttacttaaactctccaaacctgttatatcatccataaaatagacggatagagtcccattcagcccaagggttgttgaaaagatgagaacaaatgcacactctgttcctaacacactgccccatggcacggggccagccacgcagtaaaggacagctatttgtgtgattgtgatccaccctcaaagtttaattgagcctatctcctccaggaagggttccctggctttgccagttctcaccagtctttcatgtgctaaaacctgtctagcgtatgtcatttagaacttgtatatgcatcatcttgtcttcccagttgtccaattcgaccctggacaacaacaatcgcatcttatgccatctaggagcctggcacaaagtaaaccaggaatggcaatgaaattctaaaatcacttgtgacaactcagttcagttggaagtggttcgatggaatgaatgttataaattctgaggctatcttcaggttcacagggttcgggcaggggcaggggttaataagtgctaattatcaatatctgtcatgagtgcagaatgaaggagtggtggccatgtaacaattacctgtcatccctggaggaggcactcaggcccaagttaagcaagctcacatcccctcatcccactggcccacccaaccctcattcccccagtgtgttggaggcctctcggatgggcatggagatggcacacactgacctgcatagctccgccccgtgctcatgttcgttggaagcagcgtccatttgtcagtgacaggattgtagtactccaccgaagccaagttgcaggatccatcatcccctccaaccacatacaggagcccatttactgcacagacccctgtgagtcaaacaaaagccatgggagacatcacagcaggtgcactaagagatcagaattgatcaagagacaaatctggatagcctgggaggctcttttcctcccttcatggcaatacaacagagatttggctccacaggtttgagtttgctaagtgaaagaaaatattgacaacagccactgggctccaaggatccttcttcctaacaggatcatttctctgaccagggagttttgattacttataacgtgtatgccccccgccacacacatacctatactataagtatgtagagcatatgggcacagacccctctttaatggaaaggtgtatacagacctcctgtgccaggcctgagctagggaataagacaattcaggggacttcatgcatgctactccttctctgctgctaagtttttccctgataagccctatgttatattcacactgtgtgatgctgatggttatgtctctaatccctttacaagactgggtctacattcacacacaactcccagggatgcagaacagctcctactctgatctcaaagggagatggattttgggcaaggtctcatacagcagggtctaaggcataggaaaatgtaatgaattattgctcattaagactttcaaaggccacagtccaatatgttgtgtattttttcaaaattagattaagggattggtgatactctaaaaagtagtaattatcagtgttgctgaaggtactctcaaatactggtgagacgaaaaaatggacaccctcctggatggcgtctaaaatacatgtgcttcctctgattaaaaaattctacttctggccaggcacagtggctcacacctgtaatcccagcactttgggaggccaaggcagatggatcacttgagcccaggagttcaagaccaacctgggcaacatggtgaaaccctgtctctacaaaaaatacagaaattagccaggcgtgatggcgcataactgtggtcccacctactcaggaggctgaggtgggaggatctcttgagcccaggaggcagagttgcagagccaagattatgccactacaatctagcctgagagagcgagatcctgtctcaaaaaaaaaaaaatccatttctggccttttattctaaagaaataattttaaatgtgtgtactaatttagctataaagaccatttataatcactcaagtattacttataggatagaaaagatggaaataacctgtgtccaatagtagattggttgtttaaattatgatatagtcatttaaaataatatcatataaataagtttagtgttgtaataagacgttcatgagagattgtaaagtgagtttttttaaaaaacaggttataaaatagtgttatagtgtaattccatttttgttattaaaaaatagaaatatctatgtatgaattttatacaaacacacatttacatctaaactgaattcccaggttctagatagactagctgccttaagggtcctgtaattctttgctcatgtggcttaaagccaaatgagaacttggcagcaggcttaggcaatgagtaaattagtaaatatcaccacccccccccccggtttacacttccaagtcagccacgaatgggcttagcaaacaggtaatatgagaataatgaaaatggatctgcctgaaagtcacctgtgtgtccttccagcctgggaagttgggctaagccaacactttcctaaagcaaagaggcataaaggatatactgacacagtacacgacccacaaggcaaagctcaaaaaggaaatagcttaaaaggggcctcatgctccaagaaatataaacctaaatacactacagtaaatctttcctacaggaaggcataggagacaagaaggaaagcaaagacaggaatacaaagaaagcaataaggaaaggagaactcatcaagggtccaactgtccctgcaaggaaggagactgctttcaagtaggaagtgagaagttctcctagccaggcactggcaaagaaaagatagaaccaagtgccattgtctggcccttgtccacagagccctgtccttagctacctactaaagctgttgggcagcgggcactgatggcaaccagaggactttcccaggtctgtgctcatctgtgtgcggtaaaagtcatcacccttcactgcggggaaaggggatcctctgcatctaggttgcaggatctgcagctagcttttggggtctcaatttctcccctcctctaatcaagagcccacctggcaaatgcacactccctgttcaggatatacgctcagctccagaccctgggaaatctccctgctgtttagagccagtgtcttcagggagaaaaggcacacaacccccaaaggggagatggagagagcagtcattacctgcgttgcgccggcacatgttcatgtctgccacttgcttccaggtatttgttccaggatcgtaaacctcaacgctcttcctcaccaaaggcccatcatgcccacctgtggcgtacagctgtccgctaagcactccaacccctgaaaggcagagcacagcatcccagcctcatgctgactacagtaaccagaaatcaggaggcctggcatccagtcctggacagccctgaccagtgaggggacttggggagtgccattttgtctccctggacctcagtgtcctcatctgtaaaacaaatataatgacaccctacctgcctcctcataagactagcaacctcaaaactttgaaatataatgcaaatgtgacccaaattctgtttttaaaaaacattaaaaaatatatatatatatatacacacacacagacagacagacatacatacatacatacatacatacatacatacatacatacgggagaggatgttcataagcaaagaaaaaaagacaaaaaatactgaaataaatccattaaaatattaagaataattatttctgagtggtaaattacattcattttccttttttgcctatctatattgcctagttttcctacaatgctgtattacttactcatccttatattagttgagtaaaaagagttaaaaattgaaactagccacacagcaaaagtgctgaaattatcatcagggaggcctccctgctggtcgtgtaagcagaagctgacctttctgcccacttctctcctcctgtactgcagagggcattatcagatcactcaccgtgttgatcagcctgagctgagtgctagaattgcttcgtttacaagttttagtataatcttttaaaatccttttatacaacaagaagatgaaagccataaagaaggaagacagcacagtatctagaaagtgcaactgacctggtagctaggacacctgtgttctggacctgtctctctgacttgctcactgggtgacccttcccctttctgggcctcagtttccctatttgtaaagggaaagagttgtactagatcagtagttcacatggaccacagacttctccactccatgggcaggctgcatctcaatcgactgggaagctttttgaaagacagattccacactggtcaggagtcagaaaaagttcctcaggtgactgggatgtgcagaaagttcctcaggtgactgggatgtgcagtcaggtttcagacccaagaaccagacttgtagactataactccatatggatgaggactgtttttaccttgtcctcgtctgcttccctgtgctccacagcagtaggttctcaagagatattgcttgaataacaaaaatataaattaataaaatccctcccagcaattatgcaggtatgctagtagctcctagcagttgctctaaactaacagcagatggtgctgttgtaccaacaatggctctctctaactgacaggtttaataaaatttgttgagttccaaagctgcctcaccttcctttcctccatgctcagcaggaacacgcattccctgagagatggcctcttttttcccctaaccatctggtggcattgcccacaccctgctgaggaagcgagctgcgttccaggcactcaggcaactctgcctctgccctagtgcagcctcatccataaacattcatgcagccgtttcctggacctagagccacaggggctcctggcacctcaaagggcctcaggcagccaaaggccagggcctttggtctctgggtcttcagccaaaaacacccacctcgacatgcatgtgggttcccaactccagaggtgagacttgcccaaatcttacgaaagtgaagcactgaagaaaggctgacctgggagcctgaggccagggctctgacagtaacctcaggaaaaaggcttggttttgatttcctaaatcaaggtcagtgtgcctcccagggacactggactcccaggcaatagaggtgtcaccctccaggtcctccagtgtaggtaagagacaggactagggccaggtgatgtccacccagcaataaccatttcagcagcgtggcagagacaaagcagctgtagtctccaaaggcggctccctccacagagacaagcctgagcttcctaaggcaggtctgccctccaacttcgtgcctggctgcctccccaggctttcggccctaggagcagtcacacatctcagggtgtgctgccccaggcatgctgagctctcacccttacgtcacaacagaggatttctagggagtacgaagactctaccaaaactttagaaaccaaaatgtctgaaagaggtttatgacgggaaaagaatcatgggatttgtggatcgacttggttcttagggaacacctactacaaccctacaacccactcatttcacatataaggaattagaggccagaataagggaagggatttgcccaaggaaggtcatatggcaaatgacagcagacccagcaccaagtcccgggcctcctgacttccaggcaatggccccacgttcaggaagggccaacctgtcagaatcagcagagacaaaaattctctaaaaatagcactccaaacacaaacacttcttaaatggaatcatgcagattttatttttgaaaccagtgagcacacaaaggctctttaaaaatattaaaatagcatactttttaaagaatgatgaggaagtggtcatatgtttggtactataaaacgagatcacaactcaatctccaaaaatacaaaaaaaaaaaaaaaaaaaaagagagagagagagagaaaggaataacattgcgggaatgtggcttcccttctcagaagtcacacagtcttcccgccaggatcagattggtaatcagtcaccactgaccacaggaaccagcagtaaagagccagtggactgatgcctctgtctgccctcagacccttccctttgggcctctaagacaatggatgggaagacaaagcaggggagaaggggctgttgctctgcttcctgaaaaatcccaaaggatcatagagcttctggttttctgacaaaaagtagaagtggaaaaccttttgaaaagtcattttcttcacatgttggggaataggttgaagtgaggaaaagtgggagtgggggacataagttatctccagacatgaacactaatagcttggctttcaattccagacaggcaagctcagctttgtcaactgaagacttgtcctactacttcagaggaataagactgataatttagggatttaaaaagctaactctggagtcagcattactaattatatgaccttgggcaaattactcaaccactggcagacctcctttctaaatctgataagtgcaattcatattgtatccacctcgtagggctgcagtgaggattaaatggattgaggcataaaaagtacttgttaggacagtgcctggcacatagtaagccttaactttcaaaagatataaacaccttcatagaaacataaggtatgatgaggaggagcgtattatctcatccattctctagtgatcccccaggaaaggttaacttataaagtactgtgtctagctgcaaaggtgctagtaggattatatacagcaaaatgaaaggaggaggaggaggtaaaataaaatgttaagttgttgaaccaatacccactcatgactgattaaagaaatcacagattacacaaactggaaaaacatcccatattcatggattggaagaatcaatatcattaaaatgaccatattccctgaaggaatctacagattcaacacaattcctatcaaactatcaacatcattcctcatagaattagaaaaaacaatcctaaagtttatacagaaccaaaaaagagcccgaatagccaaagccaatcttaaccaaaaagaacaaagtcagaagtatcacattacctgacttcaaattatattacaaggctatagtaactaaaacagcatggtgctggtaccaaaaatagacacagagaacaatggaacagaatagagaacccagaaacaaagccacatacctataacaagctgatcttcaaaaaagtcgacaaaaataaaacaatggggaaaagactctctattcaataaatggtgttgtatgtggctagccacatacagaaaaatgaaactagacctctatctcttaccatatacaaaaattaactgaagatggattaaagacttaaatataagacctgaaactataaaagtcctagaagaaaacctagaaaaaactcttctgggcattggcctaggcaaacaatttatgactaagatgccaaacggaaagtgcaacaaaaacaaaaatagacaaatgggacttaattaaacaaacaaaaaaagcttctccacaacataagaaataatcaacaaacagtcaacctacagaatgggagaaaatatttgcaaattatgccccccaacaaaggattaatgttcagaatatacaaggaactccaacaactcaacaaggaaaaaacaaccccattaaaaagcaggcaaaggatatacatacagacatttctcaaaataaggcatgccagtgtggccaataatcatatgaaaaaatgcttaacatcgtaatcatcagaaaaatgaagattaaaaccacagtgagatatcatcttacagatggctattactaaaaagtcaaaaaaggccgggtgcagtggctcatgcctgcaatcccagcactttgagaggccgaggcaggtggatcatgaggtcaggagattgagaccatcctggctaacagggtgaaaccccaactctactacaaatacaaaaaatttgccgggcatggtggtgggtgcctgtagtcccagctactcgggaggctgaggcaggagaatggcggaacccgggaggcggagcttgcagtgagccgagatagcgccactgcactctagcctgggcaacagagtgagacttcatctcaaaaaaaaaaaaaaaaaaaaaaaagtttaaaaaaaaaaagactttagcatggttgcagagaaaagggtatgcttatacactgttgtggaaatataaattaatacaacctctatggaaaaacagtatggggatttctcaaagaactcaaaatataactaccatttgacccagcaatcccactactgggtatctatgcaaaggaaaagaaatcattatattaaaaagacatgtacagttattatgtttaaagcagcactactgactaccacaaagtcatataatcaatctaagtatccatcaatggctgattaaagaaaatatagtatgtatacaccatggaatcttatgcaaccaaaaaaagagtgaaatcatgtcctttgcagcaacatggatggagctggaggccataatcctatgtgagataacccagaaacaaaaaatcaaatactgcatgttctcacttatatgtacaggctaaataatgggtatacatggacataaagatgagaacaatagacactggggattccaaaagggataagtctgggaggagggtgaaagttgaaaaattacccattgggttcaatggtcactatttgcgtgatgggtacactagaagcccaaactcgaccattatgcaatatatccatgtaacaaacctgcacatgtaccctctaaatctaaaataaaacaaaaaaatttaaggacccacttgtgagcaaatcagacacagccagcaccccgaggttctcccatacctgcgccactgcggcgggtgctcatgtccgccacgtatatccattcattggtcgctgggttgtactgctccacagtgctcagacactggcgggaagctccatcataacccccaacagcatatagcttccctgcaatagacaaagtggctgagtgtggtgccagggatactggcatgaaaccagagctcagctgaaaccctatctgcaaccaactggggcacccttacctcagaattctgttccctctttctccaggggaccaccaacttactcctcaaccaagcaaagcatccttcacatttcttcacatattctacttgctcttaagccatgagctccttagaagcaaacacttaacgtctttctaaataagtacccgcaaatacccagcacaaagctatggcctggcaccactggggctcaacataatcttgctgatgaattaggttaaattttctctagaacaagacaccagcaccagatagatggaaagctagaaggcccccagctataggcaggcagaccatctttctggctaaaggcttgacatagcagatgaagtaaatatggaaaattattattcaatgagaacccaaaacctgtcttagccattgtctctaccccttccacaaccttggcaggtagagtgtgtgaatggagtgttctttgtacattgtgggccagggtggctggaatttttctgcagactaccctgtgatctctgagccatgcacaagagccctgaggtgccgtcatttacttttaaattaaaataccattaagctgctacccaagagcatcatttctgcctggggctgggggctgagggctgagagtgaggttggacacaggaggaaaaatttggcatttgagctatcccaaagcagaaattcaaacattttgggtttaaaatttagtcttaaaatgcaatgggatggtctcttctgtgggaacagggggaggagtcacactagctgtagactaaataaatatcaccaaatgcaaatctatttaacaggattacttactcagtagattttttggtcacatgtgctttcttgatggacagacaccaagaatactactagtatttgaaaatctgcaattattttaagttagaaagattctcaggctcaaacctatactctgctaccagaactactgctgtattatcaaatataaaaatgtttttcttctatcatcatcgagcctggctttgttttctgccccagggtcctctcaattgacccatctaaaagaaagaaacacatcgtcctcagttctgcactcaccaaagtcaaaattttttaaaaacctgactaagcagctcttctagggtccaggctacttgcatggtatgtgctggttcagatgcgaaatatccatagcacactctctgctctcttaggagcttctgcctacactccaatccacagagtcttttcctaaataggtattcttcgaggcagccagtagcaaattattgtgatttcctccatttttttgttcagtgtcattcaaactgtatagccatggtaatgagatgatgagagggaggagaggaagccagacagtgtggagagctgtctcttcaaggccacagtgaagaagacagagtccacttaagtccctccctcaacattctcaccacagctgtaaattgaactctgctgccccagggtgcccacagctgaaagagcttcagattcaggaagggcagaagaaacaaattcccagcctgtcttccacgtcaacagggcatgctacaagacagcacttcttccacatacagaacatgctcacaaaagcctttgtcaaggggagtattttaaattaccaccattatggcacctcctctaacccccatcaaccattccatctgcatcagctgaaaaaatatgcactcaaggttcctccttgagtctattaacagggatttgctatttttaacccctactctattgtttgatattcctggctaaggaacaagagaagaaatgagaaggtggctagacaaagcacttacacttggcagacaaatcaatttctcttccaccaagagaatgagattgcaagatacaatttaccttggtaggaggacaaaatccttgccctcacatagatgacttatttagtatgttagaatagtacacctttaaatgaaaacttaaattacacaataccagtgcagactgagaaatacagtgtgagaaaagaatctttctattaatgtctaactcgctggatgttacactcaccccagggcacatttgtgtttgcatgtgtatttctgagtgtgtacatgagagatggaatgtctgcatacacgtctgaatgaacagatattccatctaaattcccacattactacaagttgatgaatcagtgttgtcctgcaaatgacaacattttagttcaagtaatattctatgctttggtacattgaattcacacatatttacagaactcctacctactggcatttgtcagcattttgaaggagcatagcacagtggaaagaacaccggcttaggagtcagaagacctgggttcaaggacaggctgtgttatttactgtcattggaatgtgggacatctggaggatggagagaatctgaggcctgcctatctccttcacaagggttttgcaaacaaaacaagagactagaaatgagaggtttttttacaaacaaaagtgtaccatctgaccaggccctagacctcaccactccctcctaccttaccctacacagctttcctgactagaactggactcaatcaccagcctgccctgcagagagtcatcagacctaagaagaggtgcctacctcactcacagttctgttaatgttcaacatatgaatatgaggacaaaattaattaagcacatttaactctcactctactacattatcctcctgggttatatgctgaatatggattccctactcccttcccttccccaacttctagcagagctattgacacagggccaaaccacaggccggcatttcccctctaggctccttctactcccccagcccagctccaacatttagcagccttgggccaggagctccaccacctctctgagtctcaactttcctcatccgctaaatcaggataatagtacctaacccagaggagtgatctcaggaaaaaaaacacggtagaggaagcaccaagcatgatgctggacccaggacaaggcccgtgggccaggtaggcctggccactggccactgccgcctccttaccctccacaacgcccacacccacactgctccgccgcgtgttcatcggggccacaaagaaccactcgttggtcttgtagctgtaggcttccaccgatgctaggcctgggagacaagagactcatgagacttccgtggcaccaggcctcaccctgctgtgtgagaagcagtgaggatgggggaggagtccaaatgcatgggctggaaacctaaatgtatggctcagtaccacctctgcatcaccatgcggcctgtggcaactccctgaaacacatctgcagtgtctgcctgcagggactattaagacttgactcagagagtgggctgtgaaaggacaaggggtgtgtctgaaatgcatggcaaatgtagatcataaaaaccgcagagtgggatactttgattccaagtagtcacctgaggtagcctcactgaacacctattccaatcccctttcccccagcttcctctatcttagcagtggaaagctaaacacttgcttcccaagactcccttgcagctaggcgtgaccaagtcaatgagacctaagcagaagtctacggggatttcagaaacagcctttgcttttctaatatagataccattcccctttttgattcttgctacctggaacacaaatgtgttggctggaggtataacagccatctcacgatcatgagaaaaaggccaagagaatcttaaagaatgtggcctcaatgtccatgagttactggaccaactcagcaactgctaacctctaggcttcttgtttcatgagtaaagcaaaatccctcgtgttttaaggcagagtataatcaggttctctacttatagccaaaagtaattcccaaaagaaacaatgcaccactaccctttccttctctttgttccactcactaaaggcagcctccagaggggctaaagaccctggaattatatgagtgaggcaaagagaaggctgagaaaggtccccagattgtgaagacacaaataaaaattcagcgaagtaaaaaatactgctttttacctccctgggggccaaagaatatcatattagtttaatagagctactgtctgcagagacatctacctggcagtataagcagagatgagatcacctctctgagtttatgtcaactaacagttttgggttgaaattttgaagctagatagagtccagaggcaaggaggctcacctatggtgaaaaagcctggcaaagcttcagtagggtagtagaaagggcaacagaaaaaatgggcagcctggcccactgcatgacctgagccaggtctcttccaagtgctggactcagctccctcatctgtctagcaaagggttcaaactggagacctgaggcaccccctagctaagcatgctctccttctaagtctcatcttctgagtaaataggttcccagacactggaaagtaggaaagggactcttctgagtcctagaaagcctagtacatgggtagttacatattctgtctggaagaaggcctggctcttcacccaaaagctggatgaggaagaagagtggatatgtccctggggcagtagctacaaatggacagaaagttggtccagaactggctgaataaaacagggttgcatggaggatgtgtcccaggctaggaggggttgggaacacaccctaaacctaccagtactgccatcaaagcctcccactgcgtagagcaagtcattgagcaccgctgcgcccagtgtgctccggcgctcctgcatgctggcaatggacgtccactggtccttcacgccgtcatacacatccactgtccgcacccgcagtgagccattaaaccctcccacggcatacacgtggccagccatgaacaccacacctgaggcacaggaaaccaagacatcaaggtcaggtcaggcgcatgactgctcatgttgatggatggcaatggaggagcaagacagacacaggaaaagtcgccaccgaagatactttaggtatttggcagtcattatgggattcactggatttctttcctacttgcttttctaattttgtctgattcaagtaaatatttgaatcagctttaactccccaagctcataagaactgaccccaaaagagccaaaaactgtgcaagtggccgggcatggtagctcacgcctgtaattccagtaccttgggaagccaaggcaggtggatcacctgaggtcaggagttcaagaccagcttggccaaaatggtgaaacccgtctctactaaaaatgcaaaaattagctgggcatggtggtgcacgcctgtaatcccagctacttggaaggctgaggtgagagaatcacttgaacccaggaggcagacgttgcagtgagccgagatcatgacactgcactccaacctgggtgacagagaaagactctgtcttaaaacaacgacaacaaccaaaaaaaaaaaaaaagtgtgcaggagggaaacgaatgggagcctgaaatgcacagatgcttgaggaaacaaggagtagctcacgacttctggcacggagtggggaccagcaggggaaaaacagcttgcagaactgggaggctgctcacctgctctgcatcttctggaaggaagctcagcaatctgatcccaccggtcctcctcgaaatcatagcactccacactgcggattgccttgggtgcctggccgccaaccacaatcatgacctccggagagacaagtggacgttagcggggtcaccccaaaatctggatttatggtatccctggtacttccacatggcttatcgcccagggtgtgtggatgatctgagatgccagtttacagagctacatacatggggatgctgctcctggtcaccaacaggtatgagtattcaagaaaagtctaacaagcatcttcccacagaaacacagtcataagttctgtttcccaaatgccccactcggggctatcttgtgggtatgtgaagccgcacagggcatcatctgtaatctcagtgccctcagattgggaatggggggtgctaaatcttatatcaaaacaaacttgaatatactttgaaaaagagttcagaatttggacgtatgttttaaagtattactcaaaagcatttctgaatgcctagaatgtagggtgcacttatgcactgcagtatagaaaaaaattgaaaaactcctgtgagatgtttattacaaaagttattaaactgatgatgttctggaaactagtgctagcagtcctatttccacaagtaaggtagtagctaccactgctaggtaccatgtgaaatgtgttgtcatttacttgtcaccacaactgtgaggtagatatcatcatccacattgacagatagcaaagtaaagctcagagaacacatgtaagtggcccaaggtcacacagctaagagtgtaggcagagactgaaacccaagtctacctgacagagggtgaggccagccaccccccccaactcctgctctagagacaggatccaagcaaacacagcttgctgcatctatgtttgtcaaaacacaggtcgctttccattagtaggtcatgaaatcaatttaatggattatgaccagcacatatatttttaaaagcacagaaaatatgataagaatattatttcatgaaatattggttttggctatacacacttacatgtgtcttctggatagcaatttaaatgcattttgtattgcaagggcatggtcaaacacaatgaaaactactgctctggttaggttaatagaactgcagtacttaattatggtatcactgctgtgtctttggtcacatgttattaataaataaaaaattaaagtaccagttacctatagtttacatattttaataaacatgtacaaattcatagctgtccccacaatgatgtcactctcactcaacggcattccaatatgctttcttgagtggagagaaagggtggaagtcacaaccagcaaattcatttgatcattacctgtagcttgtcttatttacccagtggttctcaaacttgagcatacatcagaatcacctagaggacttgtgaaaacacaagctgctgggccctatccccagagtgtgattcagtggatctggagtggagcccagaggctgcctttctaacaagttcccaggtgctgctgctgctgccactctagggttcatactttgagaaccacctttttaatccatgctctgtatggatttcctgatgatatgccatgaacaacttttgccattatgaattatcatagtgctttttacttccccatgatgtatttttggggagagaagtgcccatcaaaatctgtgtgaactcgcaaaggcacatccctcaagtgaacacttcccaccatacgggaggcaaaaccagagctcaccaccattactacagatcaaccatttattccccaatattccagaacaggctcacccactgccatgtgggtggtcactggtcatcagacttagtccatagctgtctgtcaccaaaagtgggtaaccagtgttcaaaaattcagaaatcagttctgacttctaaagcattccaaaggaacccaggacacaaaacccagcctcgagctgctgctgctgctgcttccagacagaaacttgactttcctgggtgcctcagctcagagggtccactgctctgtgtcaagagtagcctttttcagagtaaacatgaattctacattacttcccatttgtaattctttgcttagacaggcatccatgaacagttcaagggggatgttaatgaacacagccccttggcaaacaccagataatgcctaacctactcttcaagggcagaatgacatgttcgtaaatatgcccagaacttgcattgtctttccggttttgagttggtaaagctaaactgaaggaaaatactgcaaggattttctttgaaatctgatttctgaagctgagtgagaataaaagcagttttaagttttctttctgcaaggacttcaggcaccccacaccctcccacatgctgttccctgactcgaaaccttcccatctctgagcactctgccttaacacctgcttatctttcaggtctcagtttaaatgttatttcctacaaatggacttccctggcctccaggtcagaactacatatccgtcctctgagatttcacctgccctgtgtgttctgcattgtgctggaccatcagtgtcttgtcttttgcacctctagacagtgagccctgcccaggcagaaaacgtatctgcctcagtcaccaagataactccatatacttatgttgccaggtaaaagtgagggctcaagtgtttatttggaataaagaatacatgaataaaaagtaaatagcacatgcaaggagttaaacaaacaatacagagtttttaaaaatgaaaaaagaaactaaactagaacgtcattttctttagttaaaatatgttggaacaccaggttaaaattctggagacagtgaggaaaaagcaagcaaaataaaaagagaaagtgagagcttttcccatcttttgactcaaccaccaaaagaaagtttgcttatacttggcataagctatccagcttcttttgtaaattaaaaaaaaaaaaaggcaaagttttcaggaaccctcaccatgccccagaaactatctcccaccagggaagtagagggtacatgcatattggagaaaatctaccactcatctctgagaattttcacagaaacagtattacagaaatgcaaattttttaatgttaaagtaaagcctgagtagaaatacaaaaatgatacacgacagctaggtgcagtggctcatgcctgtaatcccagtactttaggtggcagaggcgggtggatctcttgagtccaggagctcaagaccagcctgggcaacatggtgaaaccccgtctctacaaaaaatacaaaaaactagctgggtgtggtggtgaatgcctgtagtcccagctacttggaaggctgaggtggcagaatcacctgagcccaggaatttgaggctgcagtgagttgtgattgcagcaccactgcactccagtctgggcaacagagtgagaccctgtctcaaaaaaaaaaaaaaaaatagaatacaagataaggttttcaaaacaaacttggctttgagctcataaaaccactggtaagagataactttaaacaaacaaaacttgtacaactatctgggaaaatgaattatgaggttttgtgggataggaccatcagtttcagaggtagctcaaggcagcaggaagagcaggtatacatctgcttctctcataggcataggaaactcaatttttttgttttatttttagttggcacataataggtacacatatttatggggtacagtgtgatgtttggatacatgcatacattgggtgatgatcaaatcagggtaatcagcatacccaccatctcaaacacttattatttctttgtggtgagaacattcaaaatcctctcttctagctattttgaaatatacaatacattattgttaactatagtcaccctactgtgtaatagaactccagaaggtattcctcctctctaactgtaacacagtatccattgatcacccccatctcccctccctcctcccttccccagcctctgataaccactattcagctctctacttctacgagtttgtctgttttagatttcatatataagtgaaatcatgtggtgtttgtctttctatgcctgggttatttcatttaacataatgttctccaggttcatccacgttgtcacaaatgacaggatttcacctttttatttatttaattttttagacagagtctcgctctgtcaccaaggctgaagtgcaatggcacaatcttggttcactgcaacctccaccccccgggttcaagcaattctcctgcctcagcctcccatgtagctgagattacaggtgcccaccaccacacccggctaattttttgtatttttaataaagatggggtttcaccatgttggtcagtctggtcttgaactcctgacctaaggtgatccactcgcctcggcctcccaaagtgctgggattacaagcatgagccactgtgcccggcctttttatagttgaatagtatatatacctcattttaaaatccattcatctgttgatgggcacttaggttgatgctgttttttggctattgtgaatactgctgaaataaacatgagagtacagatatctcttcaacatgctgatttaatttcctttggatgcatacccagtatgggattgcagggtcatatggtagttctacttttaatttttcctggacacatacaaccaaccaatatagaatcatgaagaaacagaaaacccaaacagaccaataacaagcaacaagattgaatcactaataaaaagtctgctatcaaagaaaagcccagaacctgatagtttcactgctgaattctaacaaacatttaaagcagaactaataccagttattctcaaactattctaaaatattgaaagggagggaatacttccagatttattctttgaagccaggactactctaataccaaactagacaagggcatgacaaaaaagaaaactatagaccaatatccatgatgaacacagatacaaaaatccataacaaaatactagcaaatgaaattcaacagcacattgaaaagatcatttaccgtgatcaaatagattcatcctagggatgcaaggatggttcaatataacacaaatcaataaaaacgatacgtcacattaacagaatcaaagacaaaaaccacataatcatttcaatagatgcagaaaaagcatttgataaaactcaacatcccttcataataaaaactctcaacaaattagaaatagaaggaatgtaactcaacataatagaggccatatatgacaaacccgcagctaacatcatactagaaaggggaaagttgaaagcttttcctctaagaattggaacaagacaaggatgcccactttctccacttctatccaacatagtactggaagtcctagccagagcaatcaggcaagagaaagaaatgaagtacattcaaattgaaaggagaaagtcaaactgcttgcagagaatatgatcttatatattaaaaagcctaaagacgccaccaaaaaactattagaatgaataaatgaattggcaaagtggcaggatacaaaatcaacatacaaaacttagtggtgttcctatacactaatagtgaactatctgaaaaagaaataaagaaaaaaactcattaacaatagctacaaaaaaaaataaaataactaggaataaatttaaccacagaggtaaaagatctctacaatgaaaactataaaacattgacgaaagaaattgaagaggacacaaataaatggaaagatattccatgatcatggaaagaattaataatgttaaaatgctcatactacctaaagcaatctaaagattcaatgtaatccttatcaaactaccaatgacattcttcacaaaaataagaaaaaaaaaaatctaaaactcatatgggaatagccaaacaatctagagcaaaaggaacaaagctgggggcatcatgctacctgacttcaaaatatacagcaaagctagagtaactaaaacagcatggtactggcataaaaacagacacatagaccaatggaatctaaaattagagaacctagaaataaatccacacatttacagccaactgattttcgacaaacatgccaaaagcacacatttgacaaggtgttaatacccagaatatataaggaactcaaacaactaaataacagaaaaacagataatctgattcaaaaatgggcaaaaagatctaaacaggtatttctctaaaaaagatatatgaatgaccaacaagtatatgaaaaaaaatgctcaacatcactatttatctgggaaatgcaaatgaaaatcacaacgagatatcacctcaccccaattagaaggtctactgcagaaaagacaaaagataactgctggcaaggatgtggagaaagaggaactcttataccctgctggtgggaaagtaaattagtacagcccagtatggtcaaaagaaatccaatttttatggtaggtgttgcaagaagcactcatacatggagcactacacccactactgtgttgatcatgcagagtaaaaagaataaatttcctatcatgagtgctaatggatagttgtttccatggatacctgatgttagcaagcagttaggcaaatacgagtatttcccacagtctacatgtatcacatctctgaaatcacaaacttctagctacttaagaagaccacaagatgttagaggaagagacttgaaccattctctcctatatgccctcattttatattccagaaacacccaggcccagggagttcaacaagcatgtttctttctttccccaacactcctaaaccccaatatacttaagattaatatgcctttattagaaattactcaatcaaatcagcttatttaatgatcactatttttaacatttatctttcaaggtaaccctgagtaagaactatcagtcacgtaggaatcacaaactaaagaactggctctaggtgaacaattatgctagactgaacataatttaatcactctcgtgaactgcagcatacttaggagtttggcagggtgcctcaaagttctgatcccaagtctcaactgtcactgtgttgaaggctgcagaagttctggtgaatggaggttctctggttgacagaatatgagtgagctgaactccactgtagcagagatggttattagatacctcccaaggaaaacactgtcattttgaaaagtcaaatagccatttattttaggaagattagtgagcccaagcaaaagactacctgattccttaggaaggaaattttactcccagcataacatttttaaaaataaatatataatgctctcttgtttacatagatgattctgattctaccagcgtgactgtgggattgaaggcatgttggtccctcctcaccgaaatcacaaccaccctgtgtctgagagccattaggtgccagggactagccagggaaagggacaatccatgaagagaatagagatttccagcctacgtgtagatcaagaccctagccctggcctcaggactacataggtcattcaaatttctactcaggtgagaggaacaatctgggctctacacacttttttcatcgggcaagagtagaatgcatgtccaaactctcttctgtgaccggtgagctgggcagaaggcaggcccagccagtcggtccctcgggccagggcaggaagcgagagtctctcttaccctggtgcgtggggccgcagggctaacaccaacaattcatccgatggagcatgtcgaggtcgagccagaagacttgtccaagcaggttcctgagcaacagttgctctaggcaagtactgatagcaaggtgcagagaaaatgggggtctgagaaccaggtaatatgagggcaaggcccggggggagagaagaggagtggaaaaaatgggctttggaatcagacacatctgggcccaaatatagtatcagcccagtcactatatagctgtgtggctatgagcaagacattgaaccttgctaagcctcattttcataacttgtaatatcaggataataggatgcttcccatatgggtgtcaggaggcttaaatgatatgaagcacttagcacaatgcttgataaatagtaaacactaaatgttatctgattaacactagtgtcattattagcttctaaggcaggtgctaaaaaacagattcccaatgaaaggtagaaaaggatactatgaacctgtgagggagggtaagtaccactaattctaggggtgattatggggctttttcaggaccccagggtgcttgtcagggtgtggaccaaggtggaagggggcagtgcccatccaggggcctgggccaaatgagaggtcatcccatccaccctgtcaacagcttcttcaaataccatctactgaaagcaggacagcccaactcaggagcaagccacccacttccagcccaaatggcgtttcagtagcatttttaaagagctgaatagagatgccaactgaactggaatgacagtgaaaagtgccaggttcagtacatttccaaaaggttcatttgcatcttcctgaaacctcatttccttgctgccatctgtggaacagggtaacgtaggagacttctgagtggctgggagacagcctcgggttgtccatggcaacccagcctcaggaaaagtgctgggcggtgaatgtgtgggagccaagatgatgctgttagctgttccggctgggatgtgtcagtatgctctgtgcatatatggctcaggaaaaacacctttattagcctctgcagctatctcaaggcagagtcctgttcctctcagggaaaggacttggctggcaaacagagttactgctgagaattactgaatatagtgcaggtctctctccaccatgttgtttttcaaagtttgctctgccagaaagcctatctggactgaatttatgaaagcacaaaccagcctgcccttggaattcctatgcctgcttctccaactagtccaattatctcctgatttttcttctttctctacttatttggttgttcatatatgtctatcttactttctcagagagacttcttaaaattaaaagtccccaaagggcaggaatcaggtttctttcaacacagcattcggctataatgcttttgtgacatttggaagcaatataataaaacagttcagagcacagggcctcgggccagtcatcctaggcttaaacctcaactcagccatttactaattgtgctttaaagatgggtcacaaattctgtgatactactacactcagacgtggaacttaatacctctccccttaagtgtgggctagacttagtgacttgtatctagcaaataaaagacagaagtgatgggacatggattttgacattaggttataaaaacactacagcttctgtgttagatgtgtgctctcattttcttgctctagaatcaccctctctggaagaaagccagcatgtcatgaggacactcaagcagcttatggagaggcccacatggcaagaaacaggcctgccagcaaccacatgagtgagcttagaatcagatcctccccaaacaagcctgaaataactgcaccccgaccaacagcttgactgtatgagagaccctgggtcaaaaggacccagctaagccactccaggattcctgcccacagaaactgtgagatgatagatgtttattgtgttaagccatcgtagggtaatttgtaatgcagaaatagataactaatgcataataagtgggtgacataacccaaggtccaacttcctcatctgcaaaatggggataattacagttatgaaaatcctatgagataacaaatataagtcacttagcccagtggctggcacatgataagtgctcagtaattgatatctgctgttatcattattgtgggtactagtatcatgtagtgattaaaagcccaggctttgagtcagccagacttggattcaagtcctcacactgccacttaagcgctgtaaaaccctgggcaaatcactcagtcttactcaatctcaccgattctcagttgtctccaacattaaagcctccagagttgtaataaagacaaaataagataatgggcattacatacttaggctaataatgcaaagaagctgctcagtaattagtatttaaacaatactacttgtatcatcatcaatacctttggtgatgatgaccaggacaatgacccagggaagaagatgcaaagtacaaattattctaagtggtcaccagagggtgtaaaccagttttctcctgcagtcacctgaaccagtttctggatgttcactctcacagacaatttgcgttttaccttggagacacagctcctgtcagctcctgcagaaagctttccttaactccttacccctctctgtgctcccagagtgtttttcctgtacccctatgagggcatttactcactccattgcaattgtcctttcacaactgtttcccctcctcctggtctgggagtcccctggggaagagaccagttcatatcagccttcgtgaatccagtacttaccccagtgcctggcaattagtggtttctctatggaagtatgttggatgagtgaattaaaaagtaatgaattggcaaggcacggtggctcatgcctgtaatcccagcactttgggaggctgaggaaggtggatcaccagaggtcaggagttcgagaccagcctgaccaacatggtgaaaccccatctctactaaaaatacaaaaaacgtagccgggcatggtggcaggcgcctgtaatcccagctacttgggtggctgaggcaggagaatcgcttgaacccaggaatcagaggttgcagtgagccaagatcgtgccattgcactccagcctgggcaacaggagcaaaactccatctaaaaaaaaaaaaaaaaagtaatgaattaatgcatacatgattgttgatagctggatttcagatttaaaaaaaagaaagaaagaaagaaaagaaacaaagaaccttacaacccttctaacccccaggaacgacaactggattcattcaaatttggacttgtaggcttgaatcaaacattctagggtcaacctacattagtggtcaaaggaggatataaagtaggatataaatcctcactaaagccatgtgaaaacgcaggtatgaatgctgataagcccatcaggaaaaaatgaggggtgatataaatggtcagtattaagtctctatgaggttatttcttctttaaaaatgtatttctttaattgaggccgtgtgccaaggacacagatgagtaatgcctgctgccatggaacctacagttgcgtagaggagctaacactctagaagagagccctaaatgcctgcctgaggcatcagcctgggctactcagtaatcttctgaaactactgtccttgttgttcaaaaagcaatgaagccatcaccaacctgacctctcccccattaaataacctttctcatcaatcacatttctacctatcagcaataaacaattagaaattggaatttcaaaagaaaacatttacaatagcatctaaaacaataaaatacccagggatagatctaacaaaagacatgtaagacccataaactgaaaactataaaacactgatgagagaaattaaagaagacctgcataaatggagttatgctgtgttcatggatctaaagatttaatattattaagatggcagttcccccatttgatctagagattcaataccattccaagcagaacccctacaagcttttttgtagatagacaagttgattctgaaatttaatggaaatgcaaaggacctagactcacaaaaacaactttgaagaacaaaactggaggactcatattgcctaattttaagacttactagaaagctagtaatcgaggcaacatagtattggtgtaaaggtagacagataaaatggaacagaagagagtccagaaatagacgaacacatatacagtcaattatttataacaaaagtgacagggtaattcaatggagaacagagaatcttcccaataaatagtgtggaacaactggacattcatatgcaaaacaaatgagccttagactctcacctcatgcaccatattaagaacaacaacaaaaaaaaacttctcaaaatggatccataggcctaagtgtaaaacctaaaacttctagaagaaagtataggagaaaatctgtgacttcaaattaggcaaagattttttatatagagcacaaaataaaccataacagaaaaaaattgaaaaattaaaaacttatgcacttccaaatacagtacagccaccatggaaaacagtgtggaacttgctcaaaaaaataaaaatagaactaccatataatccagcaatcccactattgggtatatatccaaaggaaatgaaatcagtatgtcagagagatatctactcttgtgttcactgcagcattagttgcaagagccaagatgtggaatcaagctacatgtccatcaacagatgaatgcataaagaaactgtggtatacatatttagtagaatactatttagccttaaaaaagaaggaaatcctgtcatctgtgacaatatggatgaacctggaggacattacgttaagtgaaataagcagggcacaaaaggacaaataacatacaatctcactcatacgcggaatctaaaaaagttaaactcatagaagtagagaatagaatggtggttaccaagggataggggaaggggttggctgggaagatgttgaccaaaggatatgaaatttcagtgagatgggagaaataccttcaagagatttatagtacaacgtggtgactatagttaataacaatgtattatattcttgaaaatagttaagagaatggattttaagtgttcttaccacaaaaaaataagtatatgatgtaatacatatgttaattagctaaatttagccattccacaatgtatctatatttcaaaacctcatgttgtacatgataaatgcatataacttttgtcaattaaaaaattaattagtggccgggcgcggtggctcacgtctgtaatcccagcactttgggaggctgaggcaggcggatcacgaggtcaggagattgagaccatcctggctaacacggtaaaaccccgtctctactaaaaatacaaaaaaaaaaaaaattagccgggcgtggtggcaggcacctgtagtcccagctactcgggaggctgaggcaggagaatggcatgaacccgggaggcagaacttgcagtgagccgtgattgtgccactgcactccggcctgggcaacagagtaagactccgtctcaaaaaaaaaataataattaattagttaaaaaactatcttccaaagatactgctaaaaaaatgaaaatataaggcacaggttgggagaaaatatttgcacaatatatatcttattaaagacttgtatccagaatacataaagaatgtttacaactcaataagaaaacaataacccaatttttcaaatgggcaaaatattttaatagacacttcaccaaagaagaaatatgggtggcaaataggcacatgagaaaatctcaacagcacagtgattagagagatgcatattaaaaccatagtgagatactaccacagacctactagaatggctacaatttttaaaaatagataatgtcaagtagtagcaggactgcagaataactgaaactcatatattgctggtggaaatgcataatagtatagccattttaaaaaacagtttagcaatttcttataaagttaaacatatacttaccatacaacccagcaatcctactcctaggtatttacccaagagaaattaaaacatatgtccacacaaagatctgtaagtgaaatcacagcagctttatttgtaacagccaaaaactggatacccaaatgtccaccaactcgtgaatgaataaactatggtccatccatacaatggaatgttacttagtgataaaaaggaatgagctcctgatacatgcaacaacggggatgaatctcaaatgcattatggtaagaaaaacaagccaagctcaaaggactacatacagcatgattccatttatatgacactctagaaaaggcaaaaccatagggacagaaatcagatcagtagttgtcagaggctgggggtagaagaagaggattgactacaaagcagcacatggaaactttttgtagtgattaaaatattctatgttttgattgggatggtggttacatgactgtgcacttgtaaaaacttatcacattgtatctctaaaaagtgtgaattttactgcatataaattattatacctctactaatctaaaagaaaataatctctttaaaccgctaacaaaacctgaaagctgtttctcaggaagcagttcggtgtaaaaggaaaagcatggactttggagtgagacagaccgaaccccagctctgcacttagccagtacttaactgggcaaatttcttaacctctctgagtaatctaagtagggatatgaataggacagacctattgctgtgatgatttattaagacagtacacgatctgataatccctaagtgatcatttccctcagcataccctattcattcttcaagccttcagtggggatcccctcactaatttaagtgcttaaacaatggtgatgagagtatagtttaagaagcacgttagacaacataaccttaaatcattcaaggattaaatacaggagaacaatgagacaaagagtagtgatgtcttctttctttctttctttaacagattctaaggaagtcatggttccagttgcctgcagaaggcccaggaatctaaatgttttcattcagaaaataaatgtttcttaaggagtagggatgacagaaggatggctttgacctcctgaaacaaggggtagactcttctttctcaactatagattaaatccctgggatggaacaggggtgatggtggagcagctctcagcatgcttagtccaggctcaggcacaaactgggctttaattttaaaactatctttttatgggtatatgaggtaagagctaacatggagtccaaaaaaggagaggtcactaggtatggtttctacacaaaaaagctgggccagtgctgaaccattcccttagctccaagctacactcctcaggcaaagatgtcattcttctgatatcatagaggatgagaaccaatttccaaagggaaatgtcacagacagaagaccagctgaaaacccagggaagtaaaaaggctaaataaaaagcagcacacttagaatcaacattctcaagacatgcagcttgtggaaatttagatcataataaagatagtattcaaaccaatgggggaagaggggaattaatgaataaaataaccttgagacaattggctcatcatttgcaataccaataaaactgaatccctgccctcactccttacacacaaaaaataattctaagtgcatcaaagattcaaatgtaaaacaaaaattataaaggtacttgaagaaaacatggggacattatttaaataatttcagagtaaagaaaatatttctaaacatgacacaaaacccaagctataaagcaaaagatagatcaatttgactccttaaaaactggggcttttttggaccaaaaaattactataaacaagaggcaaattgcaaactaagaaaaaacatatttgaaatacatacattcaaaggcctaacctctttcatgtacaaagagcctttagaaactacaaataaggccaggcacagtggctcacacctacaatcccagcattttgggaggccaaggtgggtggactgcttgagctcaggagttcgagaccagcctaggcaataggcaaaaacctgtctctacaaaaaaattaaaagaaaaaaaattagctgggtgtgttggcacacacctgcagtcccagctacttgggaggctgaggtgggaggatcacttgagcttggaagatggaagctgaagtgagctgagatcactccactgcactccggcctgggtagaagaacaagactctgcctcaagaaaaaaaaaaaaaaaaaggaataaaaaatattaattaaaaaatacagtctaatagaaaaatgagccagggacatgaacagagaattctccaaaatagaaatacaaatgccgataatcatatgaaatcaagattaatctcactcccaatgaaagaaatacgaactcaaacaatatgccaccttttaaaggatacttgacacagaaatgtttacattacaaaaaaaaaaggaaattactgcaaagcccatcagtagaggactgtccataatatgcacataatagtgcataaatacaattaaacaccatgtaccattacaatttaaatgctgatttcacctatactgataatattaaaagcagtctgtaccacatggctgcatggggggaaaaatagttcaatctgtatagcaatacactgtacatttgtatctatctgtgaaaaagtgcagagagacatgtctgaaagaaaattttccaaataatagcagattttttatcctaggagacatttcaagtgacttttatttaatttcaaaattgtagtatccttttaataatccacaataagcacatatgtctataattaaagaaagctaagttattttcactttgaaaaatatgaagaagtttcaatgcaatatttcaaccaaacaaaacaaaaggcatcaacctgcagtaagaccaatgtccagccagaccaaggccttgccttgcggctgtgccttcttctaacctgcactaggcaacgtgaggccaacaggcaagtatgcactctcaggtttacaaaggtgaagccaggtgcaggatggtatgagttcagagaacaggtttggagagtgataaagactcagttcaaatgctggttctaccacattagctgtgttgaccttgggcaagtaaattaacttctctgaaactcagtttcctcctttataaaactaggataactatctctaccttgtagtgttgttgaaaagattaagtaagatattcaagtgataacctcagcactcaataaaggttagctgcttgtattattatctgggacactgagacatttgttcacattgcaaccaatatattccccatgatccaaggtcaaggagcagaggggaaagaaggtcctgcaaacctcagagaattccaacacctggtcttggaaaacaacatgcctctagccactgtgaaaccttcctggaagaagcaggcagggaggatggcagccagctggaaagaggaggaggaggacaaagcaagggcctaaataatttcctggtgctgcctactgtgtcatcaatgagacaacacgacccactcctctcctcccacctttcctcctgggttgactgattccttcccccagacatcagcatgttagactcctaaaacgactactttggtgccacaccagacaggactttagggatcgagtggagcatccctcattctatagataaggagcctgagggtcagagaggaaagaagactcgcagggaaccaaagcagccagcacacaccataaactctaggtctctagatcatggggtcccctcctgtgtcttccttccctttccctggctgctccctcacaaattctcatttctcccatttccttcctctgcttcgtgacctgtcaaactcctcaatttgacagggtcccttttcttagaaccccttttcttctctggggcagccctaattgtcctttatgtccttccctgagtggggaaaagaaacagactaggactattctgactcaaagaatggcctagaaagaggactactatggccatcactaagtgaaaccaacatagccattcctctgcttccaacagaaatagagcacaagccatggtgtgaaatgagaagtcagggtgggggtgagagggagctctgagttattctcaaacctccctgatgacattggaggttaccttgaaactcttaggaaaggaagaccccagaagagagaggtaccagcagattcaagaggaaccagcagactccatctcctaggttgtaaatgcaaccaagatgcagggcagccatgggtgaggaaagacttggaggcaggagtggaaggccactttcccagggcacagtcctgactcttggtggtgattgggctggggcttaccttgggaaggctgactggagtcctgggcttggtccttgggttcttaatcaatagtctctgatccagagggaggagatggtatttcatggcctcaatgaggaagtctttacaggtgttgttattctttatcaaagcttcttcttcaaccgtctagaggtaataatccacagatgatcctggagcacagctcagccacatttcccaagctttcaccctgggctcagtcattcctgcactcccacactcattcattccttcaccacatcatctcagacccaaagagttacaacttactgctcacctcctgcattttaagagcacagtgggataagggatcaagctctggcattagaccagatccactacttaacgtctctgatcctcagtttcctcatctgtaaaatgggcatattaaaggtatctacaacctcactagttttgtttgttttgaggcttaaatgagtttatgcaaaacaaaagacaagtagccatcctgaaagcctctaaccacatttctcctgatttgaatgcattataatgcttagggcaaacagacatctgagaggaggagtgaggggaaagaggaaagggtgtgggagccatcagccaacctttggaggcattgagtaaaataagcttgtcaaggagaaagattcatattcgttgtcttatagtgaaggtctcagggcagaaaatcggccagtgaggctccttctaacagagtaacaacatcagagcagaaaaattaccctgcacaaagtcccacctattgacctcacctaggactccatctaagctggggctctggcttctttatctcttattccagagcttaggacctaagcaggtgctcagcacatgtaagcctaaaggtttcatgagcaagaccaagcatgaagccattctggtgctctaactctccaatccccaccttttggcccaggtcagatcactgtgtggcatatctggaatgggtaatgtggtcttctggggctgctttgtgttaggaaagatcaattccattcaacagctaacactgattgaatgtctcctggttgggcagccctgtgctggtccccaggaagaaaatgatgaacaagacaaaatttctgaccctgaagaattcaagtccagtcagagaatgagaagggcctcccacctcaattatctcagccctcaagtcagtgatgcacaaggcatgactgagcctctcctgggtccccatctgtcactaggaatgaaagcatggccagggccatcatctgctgggcagcattggagctggcagggaaaaaaggattggcaagagaaggcctctgtgtacctctgaccacctccctccccagagacagtccccaagaactgttttccttggaaggtttttttttcccctcccagtaaggaactgagccagcttgagacaaatcataaacttctagggtcaattacaaaataaaaagggtgggagaggatgcctgaaaaagcttggaaggaaggagaaatgcatgagcagctatttctccagaagaacttactcagcttgaattaaaagttctcctggaaagttagtgcttcatgggtacaagagtttcaactttgggggtgatgacaaagttttggaaatctttatagtaatggttgtactgaatttgaatgtaatgaatgcctctaaattgtacacttaaaatggttaaaataacaaagtttatgtaataaacattttatcacaacatattatacatttagtacaatatttttaaatgctgagtaaaagcctaataaatgctaccttttgtgaaagaaaaaaaaacctcccccagaagtcaggcagtgttggtggaggtctgcccagggctttcccttccttctcctcctcctcctccaccaccatcagccatcccagcaattatactcatttgaagtttcaaagtcaaatgaatgtaatgaaacatcctattccagaggtgttcactctgagaggcctgataaaaggcctttctgcaaaaagggcaaagggaggagtcccacacaacagttctcatgcccattgcctctgacccccttcttttccagatctaaattctgctttggcataataacccaggagccatttcctaatggtgacgtttgttaagcttcagttgtggatgcctgatgaagtttgtgaccaacggtctctaaggccactttagctttctctggaacccaggtccccaggttgccaaccctccctgtggaagcgagactatactggagtccaggtgcctcctccacctccagccagcttcccacaggacagtgggaggtttgactgacactggatgctcaggcaagttcacttcctccgcttaggggaccttttctacaggaaagatatgctgccaccaggtggcagtggtatcacccaaagtagcatgcatgccccatttaagagcttgcaagcatatccctcagcacctgagaaggctgaagtacggcgattcagggaacatttcactgacccctcatatctgcaatctacaagtgttaccagcagacgagtttacaagtgctcgtgaggatactgtgtcacctgctactaagaatcacagcagtggtcacaaagactacagagtaagatcagtaacattcactgaacactgtattataggcctacatggattatctcattttattgtttatccccaaacaatcctataaaggcaagtgccattttttcccggtaagaaaactgaggtttaaaaaggttaagcatgtacccagtattatatggctggaaagtaacaagagctgggctgctgggctgctaggctgctaaacctcctctttatccttgcatcatatcttcccttccttccagagactccttggagacagctgagggctaacctgctgtctcgatgttttgttttgttcatatattttaaggtttattctctgcttataaaagtgtctaatgccatttactgtataaaataagtcacgtaatgggtatgcagaaaagagcgtatcaatggtggcagctagcttagcggaagaactatgcactgcagagccagaatgacatggatttgaatcctgagcctctctaaggctagtgaccccgataaatcccaacctccataagcctcaaggcctacatgtgtaaaaaaaggagttacaatctttgcccctctgggttattataaggattaaacgagaaaacatatggcaccataaggaaaccccataattcttaatttttctttccttttcagaggaagtggaagtactctgtattctaggcaccgtttttacagtcttgaatttggcttcaagttgcctaaaactaagacataaagggaacatagaaacattgtggacatgacccttcttgcttcagtcctcttcaacaaagacagctaactttcatggaacatttgttaccccaggctccacacgaagcagctgacttgcatactctactcctttagtcctcacaacaaccctgctgggctctactataatatctgttctatggaagaaaaactgaggcttgaagaggttaaataaaaatccaaaactaataagcagcagagcagagactgaaacctaagtgtcctattttcaagcctatgctcttaaactttacaacacctaacacttaacccagtgggctggttccctcagcacatacagaagacccactaaaccctcaactactccatccaaccaggattgcccattgctattcctacaggtctgggtgaacacagaagtgcttggctcttcatacaacactcacttggactaggtagtccctaggtaagagaggaagtcggacatgttccatcagctttgccatgtgctctaaacgggtttctttctcataattgatccatgagatcacagcttcaaacacctataaagaaaagcaacatgggcaacttcagtaaagagacaaaagctttcaaacaaccctcaatctgtaaaaaaaaaaaaaaaagagagagagaaaaagttatgagtcatccacaaaggtgtttaattaatctgagactcatatttaaaataaaaacagaaagggtttgtttacttgctggcctcagagagtgatcacacacacactctacacacacacacacacacacacacacacacacacacacacacacaaggacaaacctgctatcccaaatgtagaatcatcatggttcattctaaaataaaaaccagttccaatagttttttaagggtaaaaatacagagcagtaactgtgaaccaaatttatagaggctgctcaggaagatcagaccctgggggcaatgtcgtcatctccccatgcccccgtttcctcacttatgtcccgtgtaaagttaatgtagaataaaaacagtaagaatgccctctgcccaaagctggctgtgatggtcaatgtgacactgaatgacaaggaatggcaaacatttctccttgaggagagatttcatttctatgcaaatcaaaactggagggcttagaaccaaaaaggcagacctatactttggatgttcactctactcaaggataagtccaaattcaaaccctgtgccaccacatacacataggcagataaaattcaacgttggaggggcaatggggaaaccagcagtgtctgtaaaaatttcattaataatgatttttaagaggggagggaagtattggcaatatcgatcaaaattttaaatgtgcattctcgttgactttaaaaataccacttctagagctctagcttatactcacatcagtgtaagagaacagaatatgtgctccaatatctttgctgcagcatggttgtaaagggataaaaaaatgaaacaacctaaagtccactaatagagaaattattaaaggagtatccataccattagatacagttatccctcagtatccttgagcactcgttctttttttttttttttttttttttttggttcttactctgtcgcataggctggagtgcagtggcacgatcttggctcactgcaacctccacctcccgggttaagtgattctcccgtctcagcctccctagtagctgggattacaggtgtacaccactacacccggctaatttttgtatttttagtagagacggggtttcaccatattggccaggctggtctcaaactcctgacctcaagtgatccgcctgccttagcctcccaaagtgctgggattacaagcgtgagccaccagccccagccccagggcactggttctatgaccacccacagataccaacatctgccaatgctcaagtcccttatataaaatggcatagtatttgcacataacctccgcacatcctcccatatactttaaatcatcctcccatatactttaaatactttaaatatatatatttaaagtatgttaataataaatatactttaaataattatataagattgcttataatacctaatataatacccatacatcacttcatgcaagtggatatgatgtagtacttggtgttgcagcaaattcaaattttgcttttcgcaactttatggaatttttttcttctgaatatttccttagttgaatccctggatatggaactcacggatacagagtgccaactctattttcgctattaaaaagaataaagcaaacatcttatacgtgattaaagaagacatgtcaaaaagagccagctggatggggctttcaatgccaatatttgggacaatttaaatatcagtgagaataatgaagaaatcacatcagtgctgcctctttgaggggaaggagggtcagggaatggctgaaaaaggttcaaaggaaaccttttgtggtttagggtgggcattacatgggcatatacatgtgtcaaaactaaccaaattgtgtatttaatatccatatacctcaatataaaatattcttaatttttttttaaaaattataatatggccaggtatggtggctcacacctataatcccaacattttgggaggccaaggcaggcagattgcttgagcccaggagttcaagaccagcctgggcaacatggcaaaaccctatctctacaagatacaaaaatcagccaggcatggtggtgcatgcctatagtcccagctactagtgaggttgaggtgggagaactgcttgagcctgggaggtcgagcctacagtgtgccatgagtgtaccactgtactccaatctgggagacgaagtgagaccctgtctcaaaaaaaaaaattaaaaaaaataattcatgcgcccatatggatactaaaaaagtgtaagaaggtctcttatatccaaaaaaaaatgcctgtaaaaggaatgacggaattagaaaaacaccatttctgcaataccaccaatgtaataactgattgaacaaagatcaccaatggatgctaaaatcgaaagttgttaaaggccaggtgcagtggcttacactggtaatcccagccctttgggaggccaaggtgggagcccaggagtttgagaccagcctgagaaacttagcaagaccccatctctactacaaaaaaaaaaaatcagtcaggcatggtggcacgtgtctgtagtcccagctgcttgagaggctgaggcaggaggatcacttggtcccaggaggtggaagctgcagtgagctgtaaccatgccactgcactccagcccgggcaacacagcaagagcctatctttaaaaaaataataataataaagttgttggatggggaaagagtcacaattctcaaagaatcacccaacagattacatactatttacatggagggaaaatatcctcaaatagagagatctgatagacaacaccttaaacaagggaccaaatttaccaccacccataagaggacaaacttatattcctgattgtgatttaattgaaaagacacagtatctcctaagtacaattcttcctaaaatattaatatataacctgaatcttacggtgaggaaacgatcagacaactctatgtttgcaacattctataggacggctggcctggattttcaaaattgttaatattatggaagacaaaaaaaggtagggagacagttctagattagagagatttatagacaaggcaactaaatgccgtgcataaaccataattagattatggctctaaaagaaatagccataaatgacttttgggggactagtaagaaaatatgactatccactatatgttagataatattcctagatcaatattaaatttcattggtatgataattggttttatggctagaaaagagaatttcctcgttcttaagagatacatgctaaaatatttaggggtgaagtgtcataatgtctgcaatttactgtcaaatgattaagcaaaatgaaagattaagtctagagagataaagtaaatgaagcaaaatgttaatggtgagtttaggtaaagactacatgaatgttcattctttcaaacctacagtaggtttttaatttttcagaataagcagtgtaagagagaagaaaagaaattctaaggaaaaaaactacaacaaaatttataggatggcagaaagttgaaatgaaagctttatctgccaggaggaaaaaaggactccaatttttcttaacctaagtacattttttttgtgcaaatatgttaatgtgcttttcccctaaaacacttggccctgttttctaattatatacttaagtcaggctggacataacttgaatttggcaaggaaaggaaagggaaggggaaaggggaagggaaagggaaaggaagggaagggagcagaaaaggaaaggagtagtatgtatgtatagtttgctcctatttctatatcaaataacctatatgtgtacaaacataagcacatacaccatagaaatccctgtctagttcattttttattaggaactcttatcgagctatgtccctcatcctcacagcattgtttgaacgactatgtttcttccactagcccttaagatccatgagagaccttgtcttatttgctggcacataacacaaactcaaatattttttaagtgaatgaatggaaaatgagttcagaataagcatggaaggagatgtgtggaagctgcccaggctggagcagagagcagggctggggaacaaggggttggaatcttagtgggtaaggcagagtcaaaggcagatagtctgcctttgccaggttaggtgatgggcagccacaaccccattctgccttgtatgtggttggttagccacacctctttctacttccctttatagactgtgagcctatgcagagtgagaagtgtaccagctctgtctctgcacgccatctcccaatgctgcctagcacaacacaaggtaactgattggcaaagcttagctgaagaatgaactacaagtccttaagcgggtagcatttattgatcacattcttccccatcaaccagcttaatttttgttataaaaacaaaaaagcaagctgaatctaccaaagtcgatatttaaccttatctttatttttggcttcacttgtgtaactagttccacttagtcacactgtttatctactcagctatgaaagccacagcattcggcaacaacagtgaccttctcagcagctagagaaggccacatatttttttcattcagacttcatgcttgaaaaataaacaagcaaataaacttccaacttgctttagctttcaatgtacccaaaatggttcccaataacccttcccaccaagggactctccataaacatcgcctccccaaattctcaagataacccaatgattaaatactcttaagccttattaaatgacttgcccaagtcccagaactaaaaagaagcagagccagctctgcttggttacatacaaaaccaacttcagtgcttatgctctaaatccattattcttagctgactctcaaatgtctaataggtctaatagcaggggggttgcaaactgctgcccacaggccaaatccagcctgccacctgttttggtaaataaaattatgttggaaggcagccacactcatcgtttacatattgtctatggctgctttcacattacagtagcagagttgagaagccacgacaacataaagcctaaaatatttactatctggcccttcctagaaaaagtttgtcaacccctggtctataaaatctaagcagagactatagattcaatcataggatagggtgatatctacttagctactactttttgtgatgaaataatcagctgctcataggtacacttagggtttcactttttaaacaaagaaatagccccatttcctcactgattaatgtcctagaaccaatttcttgcatgctacaagactgtcaagtggaaaggagttggagaaaatcagattccatagctcccagctcaccacacttcagatgtaagcacaggtcttggccagagaataccagatgaatccagaccttccactccaacactctggacagacaggcagccaagctaggctggacttgcacaccccaaggaaaatgaggagtcctggggtactttccctgctttcaaaatgtgttttgaagatcaagaagcactccagttaaaaaggcagggcactgacttggcaaggggagaagttcaattgggagcaattctcagcaaaacataggaagaagagaaagacgctaattttgacaatatcagggaaaaaaaactaggttcctatacatggacctgaattgttactcaatctgagaaggactaactttattaataacaacaagcacagtgctaggcattttacacatatgatctcatttaatccaccaacaatctctgtgaagtaggtgtcactgctcacattttacagatgaggaaacagcctgagagaggttagcaagctgtacaaggtcacactgccaggaagaatagatctgatgtgaattcacctctaactccaaaaacccatgctcaaacattatgcaatttgcatctcagagacacaattaattttaaaaacctaggccaggcaaggtggctcacacctgtaatcccagtactgtgggaggccgaggaggccaaggtgggcggatcacgaagtcaagagattgagaccatcctggccaacacagcgaaactccatctctactaaaaacacaaaaattagctgggcgtggtggcgcacacctgtggtccccagctactcagaaggctgaggcaggaaaatcgcttgaacccaggaggcggacgttgcagtgagccgagattgcaccgctgcactccagcctggtgacagagagagactctgtctcaaaacaaacaaacaaaaaaaaccctgggcagactgttgagttggggaactaacttcctaaacctataatcctaattacaatcctccacgccctcctgggacacctcccctaggtctcctattcctttcccagggattgaggcaataccatttaccaaatctcctgccatgcttttaaatcaagaagatagtgcttctagacaaaagaatgattctgttggattcctgtttttgtttcttaaatgaaagcttaacaagacttgtgttaagcatactctcacctcattgccacacacaactccagggacaactgggagcagtggtgtgcggcaattggagctcactgtgcacgtctcttcctaactccacgtttagtgacattacactggtagttgaagtcagccttgatgaaaatatttacaccatggaaatcagcaaatgaatcaacagatgaatcagggcttttagaatgttttttagcgagccagttgttaaacatttaccagcacaccactggctgagcgatgtcctggtctgaagtctccctagaaacctacccagttgaattcttctttctgaccataccatcaccatttcacacaacacttaaaagctctttcttgtagttgcttcatttcagattcacaaggaccctgtgaaactgctagtcatttgcaaaaggagaaagtaaggcagagagagacgaagtcatttgcctgacattacccaacaaattagtgagaagacagcaattagaaccactgatttcaatccacactttcacagcacactgcacatttcattcataccacatctctcattttatagctatatatttgtgcatatatttgataaaatatctctcctctatgtgaatataagttctgcaaaggcaggtatcttgttttgatctgtttgccaatgtctctcctgtgactaatacgctacctgccacacagagaaatatttcttaataggatgaataaattaataaaagcatgaatgaatgtatgtatggttctcttcctacagcagcacactgccagatatctgacttcagataaccaaaaatgatgaaaaaattaaaacggtaacatcacttggcctggaaattgttcttcagctttctattactacctacagccagtaaaaaagactttcactatgagtccacaaagaataagaaaaggactgaagcacaatggtttgatagaaacgtctacaagctgagagacgtcagtggtactaatcctaaccatgagtgcaggatgacatacggatggagaatgtctgccagtcaatatggtagactgagctgctctggaaggaatctttccctgtagctccaaacacgtgagcatgatgtattacagaaaaaataaagatttgagccatacgcaaaagcaagaagaaaatgcctgagtgttttaaataagaaggaattcaatccgggcagctgagtggaaattgaagccaaaatggctcacagagacaattcagatatgggctttaattgaggactggtgtcccattgggtagggtgcctaggccacaggctcctgtggacagatttgccccagctgtaaaactaagactagatgaactctgcccatgtgctatgagtaaggggaaggaagctcgccatctcctgtgggctgaggaacgcagtggcgtgggaggcaagggagaagggaaagacagggagtaaaatctacatcttcaagaaacccaaaccctagactcatgccacataaaaattgagagtttgaactgacatcacccaggtggtatgggaaatatctaagacaatatctaatacaaaaactgtttcctaaaccagtaaacctgccctacagggtccacagcccagggcaacctagattcccaggatatgacatcctctgaacatgaagtcacaatcaaaaattataattcattttggaaatgaattaccaaaagacatatcaaagatgcaaaaaatagtagaatatctgggacaaccaatgaaaggtggcttaaagactctactctataatgtgttcctaaggatactagatgcaggagatattctgtagtaaaggggctcaggggccaaatgagcctaagaaacacatcatactgtatcctcaaatatcccttaaaggttcacaaagctcattaccatataaaagctctgacaactcctgtagtaaagaaacctggttactttgttcagccagtgtctcctaaatgtatctgacctgagaatgcttaaaacaaacaaacaaacaaaaaaacctggccaagtgctgtggctcacgcctgtaatcccagcactttgcgaggctgaggcaggcggatcatgaggtcaggagttcaagactagcctgaccaatatgatgaaaccccgtctctactaaaaatacaaaaaaaaaaatagccgtaagtggtggcgggcacctgtaatcccagctactgaggaggctgaggcaggagaaacgcttgaacctgggaagcggaggttgcagtgagccgagatcgtgccactgcactccagcctgggcaaagagcgagactccacctcaaaaaaaaaaaaaaacaacaacaaaaaagccccaaacacctataaacatcttgtaatactgtgtctttatgggatacagttaagcaaatactgacctgaagaagaaagctctcactccttaaatctcttcacagactcctaccccactcccagcctcatttcccaccattctccacggtccttgattcttatcacagagtttacttttctccccaggtacgagctattccaaacttccaagtctttagtaggaatagtcctactattcctccaacctaaatggctttccaaaattctaccctcattcaccaaagtttaactcaaagactctcttttccatgatgtctttcctatacaacaacctggaataaaatattccaggtactttccttgaactataattataagcaattatttctcttggccacgtactatggacacatgttttcagtccgtctgcccaccagtctatgagcccctgaatagaaatgactacctgtcactcatctctgtacccctcatcagggtgggggtgcattcataaagagtggggcttgggaggcagacacacacagcttcacatcatggagctatctacggttaatgagctgtgtcacctctctgaaccttagtttcttcgtctgcaaaatgaagacaataatctctgccttgcaacttgttgtgaggattagaaatgatgttctctgaatgtcatgctggacaggaaaaaatcagacacaaaagcacacacgcaccactgttcaatttatataagcttccaaaatgggtaaaactcacctaaggtgtgagaagccaagaaggtaggtgcccttcccagggtagggagtagtaactggaagggggttctggggtttgtttcttgacctgggtgctagttatgtgggtgttttacttcgtaaaaagtttagttgtatacttgatttgtttacttctccatgaacttacttcaatacaaacttcctgtttaaaaaaaaaatgatgagtgaaacatacctggagaacactggttggtcatggtagatttgggggcacggtgctgtcatattctgtgcatgggtagttattgaattccaccatccaaaggagaacagtaaaaagagtaacgccaaggtagggcgttaacagatcactgttgttggcaagctgagaagctggcaactctgataacctcagagtaaggcagggctgccaacagctcggcctaggcagcagggtacacctgctcagtcacctggcaatgcctcggcagcaatcatgcaagcccagcccaccggccaaggctctccagcctgcctcccacagcctgcctcccacaaccaccttgctggaaaggcaaggaattcagacagaagggcatggaacaccaatgatcctgggagacaagggcccagtccctcccaagaaataagatatcaaaatttggtctctaaaatgcagtttaaggagacaacagcgcattttaaaatgtgataatgcaaagagaagtaacctatagttcttattccagaacatacttaacactaattttttaaaaagacttaataaatttcttcctgaccggtatctaaaatgcaggccatttccctgttaagactcactcagaggtgtctctgaaaagcctcaatagtgtttcataagaaggcaagagatcttgagatggagacatatatttaccagctaggaaagccaaaattcaaagaagtccagtaacttgctaggtcccacagcaattcaacagcaaaactgcactcgaactcaggagtcatatctctttccttagagtgggtttgtcccagaaggttgtttattctgcccctgggtcactgggtcactgaggatgttcatggccagagctgaactttgtgtctcaaggggaaatacaataaacatgccgtcagctcacaggcttagccctaacccctcaacacccaccatgtggaagaatcagatgcctggctttaatcttcttgtctctatcctcagggtagtggagtgtatgatagatgcacctgacagcaataacttaagcataccctgagaatgactctacggtctaagaagaatgtgtgttcagtgttccacgctaaggaatcaagaacctggagattcattccttatctatgaggaacatctgaaccccagcccatcctgggaaatgcaggccatataggggattgaggccctttgttttgtgttaaatgaaggttgccaggtgaaggtcaccagcaggagggtgttaagtgaaaatgctatataaactgcatgcattttacaagcagttgcaatttcctgtccagcctgccaccactggacagccctgtacgtaagtgccctcaataaaccctatgtcttgttcgctgcctccgggcctcttcttcaacctcttgaacatgatgccatccctattgaagttaataggggtctggcatgacatgaggaaggggaaggtcctacacaatgaactagtgattttgtgtgactcccatcacatccatttgacctctctcaataacaagaattctaaaataaaaaccacatgaaggaaaaacaagagcaaaaatggcaaggattcatgccctcccctaccctctaattcccctatctgtccttactctctagaaaactgttaaaattattcccataacctcagctggctcagtgcaaactccagccccagtgtacctcaatcccttgggggacatctgctgagtccttccgtggcacctcctggggcactgagtcaggtactgcatgtgatacaaagatgactaaggtaccctcacagccctcaaggcatctgagggcagtagaggagataaggaatgggcaaaagcaagtgatgctggaagaacagtctctgagctctgggaggggcccaggcagggctggggacactggggagcatgaggtcacaaccactctctgaccctgctaggcactggggccccaggtcatgccaacaacccagaccaacatgggcactgggaagactcccccttaggaaaggctccagtcaacagttatgactactactaggagcagtactagtagtaataaccataataatagcagcaataacaacagtatcttacagtaatgaacacttcttatattctaagcttttttcatatatcatcccatttaatcctcatagcaaccttacaaggtagatactatactaccattactcaccttttacagatgagaaaactgagccatagggaggttcttttattcgtcctttcaacagctatttttttagtgtctaccatgaacctgataccactccagcagcgacaagcagacagacaaaattcctgtctatctacttgtatacggtacatacattcttgtgggagataaataacttgcccagggttctcagcttgtttaagtagggaagtcaaaattcaaactgagcccctctgactgtagaagttatacttgcaaacttacaagatgaaagctgcctgttacttacactcatcattaatagtaaaatattacatttcctctattttaaggcgtatgtgttttttacatgttaatgtctgaaatctggcttcattttataatatatgttcaaagaaatctgtgggctgcatgcagagtaagtcataattgccgttatgctgttaagtgtggatttagtggaacaccagttacttgattaccaacccagttgggttttctgcaactgttaacattatatgcagttgaattttaacttaagatccctaatattacttcaaatacattttaaaattccactataaaacagtattgaaaggaaaggttattatgcatgcaagagattgcttatcacacacaatgtaattaaagggcgtagaaatcactaaatctcctggagcagacacagaattttcaaagcctaaaggactagcattaaaatgaaaaacatctaattgtcagaagcttccagctatttaacttccagcaagacatgatcaattatggagaaataaaactatgaggttagccaaagagaaaatgtagaccaagccccactattctttaataaacctcaaaattacactgccaaccttaaaggtactaaagggatcaagatcatgagtaatctgctttatgaaaagcagcacataattctgaagttacatataagttccaagaagcaaatatgaaatagaacttcgttaatgtgaaaaatacctatactccaaactctggctatacagaaagagcaactcatatgtaagtatatgaattattgagcaacactgcaaacaatttttaagtgtatacattttaagtgtatacattaagtgaaaaaagtcatgtttgtttctggaaagatataattaactcaatggcatattttaccattatcaatggcaaaattggtgccattatcattattaatggtgcttaaaaacagatgattgtgacaattacaatgacaactgccatttattgagtgcctgccaaacactatatttggcgttttatatccattatctctaagcctcatgacaactctatagaggagggactcagaattcccattttaaatttaaggaaactaaggttcaaagagactagtgacttctcaaggtcatacagccagaaagcagagactagaaccaggtttgcctgcgtccagagcccaagtggtttccagggcactataatgcctctccctattaacaatccacccctactccccgccagacacagcaagcacagattagccttcacatgcagaaaactttctatgatctcaagagcaagatgggccagcatgaattcaaagtaacagagtcccccaactctcaacccacatatcccaagattattcaaatcctgctgtttatatgagtgcttccattttctcactctacacttagaacatgctcaggggggccccaaattgaccaactgtctcaacattcacatagccaatcaactgactggttcatcccttccaattgtgccaatttgacagcataatccagaacagacagtaaacgtgcttggtaagaaggaagggcatcctctcagtttctgactttaaggcaggaagggtcctatgcacacacacgcattcaaggaagccaaggcctccctgagcctaagggagagtccagtatattgtgccagtcaccttctgggaatccattgctaatttcagggaagcccacagttttaacaaatgacttttttattttaagaaatgtttttcttcttgatcaaacttttccaggatggcaggcaggggtttgtgaattttaccccattctctggacgtgtgaatacaatttcatctcagatataaaatccttttcaatgtttgtcctgaagtattccctcaaggaagagcctcaagcttggatgcaaagagtgaactaagacattcaaaaaacatttattgagcatctctgaagatacagaaaggaataagatgtagtccctaacatcaaggaactcagctgaatgtgggaggaggatcagctcagaactaaatatgtacaatgaaaaggagaacaaggtgagtgttatcctgaaacacagagaaggaagggattaattccaggtgcagggtaaataataaactgggctaatactgattgaacacctactaggtaccaaggactataccatgcattttacatatattatcccaattaattgccctatggaatatgttctaatactattatcctcactttacaaaatgaggaaacacaggagaggcaaagtacctcacccaaggtcacataactaatttgtaaatactggagctgagatttggacctgctggccaacactgaagcttatgctattttcactatagtagactacatctactggcataaagaaatttttactggtagaagaggaatctgaatttgcttcctcttctgtaatgcagggacaatagtaatgtctgcttcacaggggtatggtagaggtggaatgagcccaagaacataaagcacttagcatagtgtttggcaaactgtaagtgttcagtaaatagtggcagctttgtcatcatgatcatcactgttatttcttctctaaagagtctagaatgtagcagtcatgagccagaaagcctttttataatttttatttttaaagggattaaaaaaaaaagctgttgtttttctctgaaagaaaagaaaagattggccaagcatggtggctcacacctgtcatcccagcattttgggaggctgaggcgggcggattgcctgaggtcaggagttcaagaccagtctggtcaacatggtgaaaccctgtctctactgaaaatacaaaaaattagctgggcatggtggcgggtgcctataatcccagctactcaggaggctgaggcaggggaatcacttgaacctgggaggcggaggttgcagtgagccgagatcacaccatcgcactccagcctggccgacagagcaagactccatctcaaaaaaaaagaaaagaaaagatctcaccaaaccacaagtccttcccatgaccacctgacgagtgaggttcccgtttccccagtgagccatgtcataccttctcttctgaagaaacggtcagcttgtcgctggatatcaagctgcacacctggtccagactcaggctaagaaattcttctcctagcatcacctctggaaagtgctgctctgttccaaaaaaaaaaaaaagaagttaagaaaacaaagttgtaacacacttctgcccttccatgacaatctgtgggattcacagtagagtcctggagcaggccagggggaccatggagggaaagggagtgaaacaaagacagagacatcatggctggagggaaatttgccttttaattcagcagtgatggcatcacccactatgatcctctgtcctgaacatcaacacagatgaaaatggggcagacagatctgagtttgtattttttccatgctccatgagattaataatagcactgcagaaaagcctcactgggacctgcctccataattgagcttatttcccctcagagtgcaagctggtagagttgcagacagtgcaccctgaagctcagccaaacaaaaatgggtcagaactgctgtgtgtctgagaggtctctgggggttcttataggaagtcaacattagaaggtcagtagatgggatcatcctttcttgcccaaagtcaagcctactattgtgagtctctggttcatgaggaggcccaactaagcattcatccaggtatagtggcaacaaggtgaccctactacccctaggaacagtccacagagccaggcctatggaactgttcaagacagagggaaatttggtgacaactagaataagataaaacccacaggcctaagatccacaaaagggaaataccagggacaattcctaccctgacatttttccaggccatcatcctgctattagagaattatattcactgaaatgtcatctacttcagaaagaaggagcctaggttcaaatcctggctttgccatttatgattatgtttttgggccaatggcatcactgctatgttgcccaggctggtcgtgatctcctaggctcaagtgatcctcctgcctcggcctcctgaatagctgggactatagacacaagccactgcacctgacttcatcaacttcataaaaatcaaacaaagaatttaagatttaaatcatttcttgtgaaaatcatttttaactttttatattgaaataatttcagacccaaataattctcatacaaatttctaccttcatccagattccctaaacgttaacagtttactctcaaatattgagttataaacaatattttccatcttccactggacaaaaagggctccccacttgctctacaccagcctattgatattactatggtcacaactaaaggttgtccatcttgaaactcaggaatatttacacataacaagacaaatctgaaagtcagtttttttacgaaggaaaccaactgtcaacatcaacatggtaagaagctggtctttgcttctctgtatatcaaaacaaaaaaagcctttagtttttaagttaaacattcaaaaaaccttcctaactatggaaatatttaagactagatagtactattttttaagtgttcattgctaaagatcttaaaataaaagcaagagagcaatcttctttggatggtaagaatttattcttgggctggaagctgggaaagtactggattctccctccattccctttctgatcccagaagtctttggaccacagtcccctgtcaattggtaacacccaagaaacagcagatagaaaaagcagtcaccacacaagccaccacaccatgagcaagcacaggacattgaggctctctggaccagccacagctgagctcagcaggaccacacggttctcaggagagtcctgcaaaccagcaccaacatctctggcccagagccacatctggccttcccacatgtatcgttggctgaccaaaaagctgacagccggagaagggaaaagaacaagaggaggtaagaaagtaaaattctatgctgtgaaataaaaatttccttagagctcgtaagactgtagataggcttagattttgaaagggaagataaaggaagtgcagtaatatacattctaggtgatgtggggaacaaattagaaatccttagagataaatcaagacaaaaagtagtcagcaccccacctccatctctctgtccctcccctactgcagggtttgaatctaaaccccttctttctgaagtgggctgcttctctgcccatctggaaccttccactgaaatcccattcagaaatcctcccaggaagcagtatctggtggggaaggggcaacaagagaaatagcaggcagcagcttctcacccagggctggcacccagggatctgtgaggtttgtagggcataagcagaaagagacaaagaaagcaatcaaagaggaaaatgccttcccgtttccatttagtctgaggagacaggggtaacccccaaagtctttgaactagggtcccctctctgttaccaacactcaagaaacaacaggatagaaaagacaggaacaggatgctccagctaactccatttcctgggaaataggatttccccagaagactttgtattccagtcagccctctccacagctgcttcctggaaagaacccactttgctcccagaagataccttcctgaatcatcttctattttgaacaattatttggggttttttgttttgttttgttttgcttttaatgtattaatggagaatgtagtaaagagccttggctaagggtcagaagacctgggttcatgtcttatagtcacttcttcccaggcttcgccatccattttatggatggcatgctcatccataaaaggcaatcataatacctgacataggtctcaagattgttttgcagcccaaagataataatatatattaattcattttgacagctttaagaaactctttagaaatgaaggataaatattaccagcctgtgttcccactttccaaagtccagttctgtgagcagcaacactttttctttttttttttttttgagacagagtttcgctatttgcccagggtggagtgcaatggcgcgatctcagctcactgcaacctctgcctcccgggttcaagtgattctcctgcctcagtctcccaagtagctgagattacaggcgtccactaccacgcccagcttatcttttgtatttttagtagagacggggtttcaccatgttggtcaggctggtctcgaactcctgacctcagatgatccacccgcctcagtctcccaaaatgctgggattacaggtgtgagccactgcggccggcagcaccactctttaacagagaagattttctatatcaagatatcccttgggaccaggcacagtggctcatacctataatcctaacagtttagaaggctgcgcaggaagatcatttgaggtcaggggttcaagactagcctggtcaataaagtgaggcccctctctatttaaaaaaaaaaatgttaagacatcctttgggactgcagatcctatgggcaaggctgtggacctgcaagatcttagagaacaaatttaattctatcgaattcaacaaactgtccagtggtataggttattcagttccttgaggctgcaggtttcccatatattaaatggaaataataatagtacataaggtgatatgggcattaaataaagaaatagatgtgactcacatttactgagtccattgcaggtgctagataactcttaacgtatgatgtatcaaatgcagcatttcttcaaaaatgaagaaaccagaactgatgtctacaaggaccctactgcctcacaagcaagataagacaaggcatcaataactccatcccaaagtccacctctcacatgactgagagaggtactttcagtacaaacaaaggcagggaacaggaaaattcagagcatatgtaaagaacagtaatagtgaagtctagctagaacctaggtgatgtcttcattcatccaacaaaggtttgctgagcactccctaagtatgaggagctctgcaggctcttggagatgcaatggagaggcagacaaggctagatcctgggggagggatgcatgtgccgggggcatagtaccttttaaccatgggttaaaagagagttattattggagagttagcccttgaagggtaactctccaataataactaacttttcttatcgtttcgcttctttttctttaagaggggtggacacagagaaaaataagtcagttaattaagagttctggttaagagtcctaattagccaggttttactataagtaacaaatattgtttaagttccatgtcctgattggtaaaacacaatgagtatgttcctgtccatatggatgggaaattatggagaagaggaagaggcaccatataactttcagtcttttccccatcaagcaacacaaacatatcttcccaatgttaaaaggataataaaatttgggtgatatattcccaggcaagggctttctctgggggtacagttgggtctcggagacagttgaggccatttcctaatactagctaacaccattctaagcattttacatatattatgtctctcaatccccgcaaaagccctactaaagtgagtatcaacatccccattttacagatggagaaacagaagcccagaaactctaagacaggtgcttaggtttacagaatagtaaacctggtagagccaggttttgaaccaagactgcccaattataataacaaatattctgatgagtatcttaggtaccaagataaacacctatcctgagcagtccactggggtaaaattcaacacagacatcagaaaaccttaagaatccctctcaggggtgctggacatagagagagagagagagagagagagagagagaggcatagacagaggatatgcatctaaaaacctttctttggggaaaaaagagaataatcttagtccctaaattcctaacttcttggcattttggagtcagttctaggttcaaatctcagacctaaccccagaattaagatatttccctaatccccccatccactaggctagaggaagtgatagtctttggggttcccaaagccccccaaacaagatataacaatcatatccctaatcaccctgctttattacatgaatctttctattctattcggactgggagccccatgaggtcagggatcaagtctgtgttatttgaagctgaatcctcagtctccagcataatatctgtatataccgagctctaaaattattactgcactttcctgactgttcttcaagactgcctagggttcaggcaacctctcaagctagccccaggactattcttctctcttcacggaatgaaataaacctaaacctttgatctggttcatctaacctacaagctcagaacaaatggaatgatgacccatctgtgacttccttgactttgcggggattgagagacataatatatgtaaaatgcttagaatggtgttagctagtattaggaaatggcctcaactttctctgagacccaactgtacccccagagaaagcccttgcctgggaatgtatcacccaaattttatcatccttttaacattgggaagatatgtttgtgttgcttggtgggaaaagactgaaagttatatggtgcctcttcctcttctccataatttcccatccacatggacgggaacatactcattgtgttttaccaatcagagatgaaataaaccccataagccccataattcccagggccagcagccccagggaacaggtgtgagtgcctctgaactgaaccacaggtcacaccctcaggagacactggctgacacaggtggacacacaaacaaaatggaaacattttggcagggtgaaaaaacaaaaccacagaactgccttaaaactctctcttctgccccttattactctatttttagaggccagaggcaagcttccttgaatcaatatttagctttccaggctcacagtttctctgctctagggaaaaggctcagttcccacagggaagtaacagagacccaccttgacctcttctcagaagggtcatgaccaccagccctcagactctaaatattactacctccacactccctgggaaggcaggaaataagctctctttccatgttgccttactccagaaatattatgtgttgtcctctccctctctttctctctctctctctctctagctctctttctctctctctctctctctcacacacacacatgcacgcgcacacacacacacacacatacacacagccaagggccataatagtgctattgattcaacagtgaggttccccataacccagaaaatggaacaagtgaagtttcctaaaatcctaacaaagagcaagcaacgaaacctatctgtgtctgcacgactgcctcatttgccaacttcaaattagatgcagaaaatccaagagaggcaggagtgaggcaaccatcatagaaaataggctaggctggtctgggtgggtgggaaataagtagcggggcttaggacacagacctctgcagtcagctggcctcactctggcactgccacttataagctgttaatatatgatcttggacaagttactaaacttctctggggttacagtttcttcacctataagctgagaaaataataactcttatacttaaatgaacaaaatgaggccatgcctatgaatcatgtagcaccattcctggcacctagcaagtattcaaaaatgatagaaatgcccatcattatgatcatcattatttcatggtgacaagttaggagcagcaattttagaagaggactctcactgagtcagagatttatgttttttaatgattttccaaatttttctgctgccttaattacttcattccatgatctcaaatgactcaatcaatcaaaaaaaggccatttctctccataagcacgtgaaatccaatggcttttccatcccatggctggaggtttttgcttagctttggcagactgatgtaaacaacatgtccaaagaattttaattgctatttcattaatgaagtcccattaacatccctcccaaacagctctgctgatggcccagtgtatggctgtccaattaccaaacaacaaagtccccataaccctaggccctggcctctgaggttaaagattaagcagtccctggaaacaacaataatgaggtataagaaacaggctgtgaaagacactggggtccatttcccagctactagttgcccaggaagactgtgatgccactagctaaggcaagagtctgagcagtcagcttctaaatgcgggacctaccctccctaccccagaataacatatatcatagcaaagatctggggaacttccctgagggggaaactgaatccagaggaagcaggagggactgccacagcaggaagagacagggcccttccaaacaggaaaccaaataggcagctggacatagagatgatgcttcagcccccacaaagttgtgctctcgctggaaaagccgaggacctatcagaaggcaagactggctttaaaataaagtcacatttgtttagacagcaagttggcaaaatctatcaaacaactttttaatgtacattctctttgatccaacaactatgctactaagattgtaccctacaggtatactagcaagtgtactccaaaatattatgtacaagaattctcatggaagcattttaaataaaaaaactggaaacattaatgtccatcaacagaagactggttaaataaattatactccatccatgagatgcagcagactaaaagaataagatatagccatacacaagggtgtggaaataattgcaagatttgtattgtcaaacaaaagtacaacgagtacagagtgctttctgttgtgtaagttaaaaagcataatatataaattctgtaaggataccaaggatctccccacttcagagagacaggctgggagaagactggctttgcattttatacctctatgtactgcttgcattttttggtcatgagtataaattgcttttattgaatatattacctaaatgtttcaaacaatggtctagaaatgtatctgctaacatggaaagaaattcagaatatactgctaagaatgtttttttaagagatggggtgtcttgttatgttacccaggctggattcaaattccgtggctcaagctacacatgaatgcttgagctatcaacctcaacctcccaagtagctgggactataggcacctgctactgtacctggctaaaatgttttttaagctggaaagcatacatatacaatgaaaaagatttggaaggatatacatcaaggtgctgccagcagttctctctgggtaggattgtggtataattctttccacccatgtgctttttctgtaatagtcagggatgagtttttattaaaatagcaataataacaacaacaacaataacaacagaaaaagaaagctttttagagaaggaaaagaaacagaattcagcagctaaactggaatctacagacaagtgaaggcaaagcaaagctagccagaaactgggaagagtaggggaggctggacaggacatacctgcctgcactatacatctagataaagagaaaacaaaaccagaagtcctggaaatccttcctccccaaaagtgcatgtggtctgcagcagcagtgacctgaggattcctgtgtctcctgcctggacccaactgtgaagctccctcactgcagatgatgaggctggcagggaggctccacagcacagcgcctgtggtgtctacttccatagaatgctctcctccccattccccctgttccccagatcatcctggaaacaggataggatgcgctactcccatgatagagagaagaaaataggctcaggattactcagctccaaagtgttagctggtctgattcctagttctgatctggaaggtctccttgtagtttgttggcatgaaataccttctaactcaaggcctgggtccagggagacctgtgaccacagagaccaatgctttcccttgtgtgtgaccctagtgggtgcctgcacccctgcacttacagtagagtgaggtcacaggtctgtctcaagaggcagcaatggtagagaaccccaggctccatctaaagtcaggggtacaaggaaaaaagcaggcccacgtcagtgggtgggttcaagggagtaagcatggataatcattttctacttctcctctaaatactgcacaatctaaccttcattcccttcttctaacatctttgcatcatggccttatcttctgcattatactactttaaaaatattacctccctgaggggcgcctctgcccggccgcccctactgggaagtgaggagcccctctgcccggccagccgccccgtccgggagggaggtgggggggtcagccccccgcccggccagccgccccatccgggagggaggtgggggggtcagccccccgcccggccagccgccccgtccgggagggaggtggggggggtcagccccccgcccggccagccgccccgtccgggagggaggtggggggatcagccccccgcctggccagccgccccgtccgggaggtgaggggcgcctctgcccggctgcccctactgggaagtgaggagcccctctgcccggccagccgccccgtccgggagggaggcgcgggggggggtcggccagccgccctgtccgggagggaggtgggggggtcagccccccgcccggctggctgccccgtccgggaggtgaggggcgcctctgcccagccgcccctactgggaagtgaggagcccctctgcctggcgagccgccccgtccgggagggtggtgggggggtcagccccccgcccggccagccgccctatccaggaggtgaggggcgcctctgcccggccgcccctactgggaagtgaggagcccctctgcctggccagccgccccgtccgggagggtggggggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtgggggaaaaattgagaaatcggatggttgccaggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacacttcggaaggccgcagggacctctgcctaggaaaaccagagacctttgttcacttgtttatctgctgaccttccctccactattgtcctatgaccctgccaaatccccctctgcgagaaacacccaagaatgatcaataaaaaaaaataaaataaaataaaataaaataaaataaaatattacctccctagtgtgcagagcatagtgggctgctgagaaagccacccaggagaggatcacaggcaccacagaaggcctgcataacagggaggagactctcagcctgaagatcatgctgacccagccaggaaaagtaggagggcctgctcactcattcagtgagggaacaggctccatgtgtctgggaggaagtcacccgacagggaagagaagaagacacccacatggcgcttcctctatcccaagatgatgacataccctgtgtctagcggacagctggatgtctgtctacactgtctggttgttgggatttggtgactacattgcacaggcttccaggaacatgctttcaatggaaaatgccaactctagccacatgcactcctcagttactgattcacagggcatccttatgtccaaactgggcctagaagctgtagaatgtaataaacactggctctggagtcagcaccgtctgggcttgaatcctgccttctgtcccttctgtcactatgtgacctcaacaaattacttcacctctctgtgccctggtttcctcagctatcatatgcattaaacgggatgttgccaataaaatgcttagcatagggtatgacccaaagggagagctcaataaacactagctaagaataattcatcaggatgtctgcatacacagacccataatgcagacagaactcaatcactataacagcaacaggaccaaggagcaccagaaagatggatgtgttcccagctgcatctgctgcactctcccacagatgagtctcatcatcagatagtgaaaggggcaaaggagaaaacacagacgttgaaagttgggaaaagccaggccagaagagcctgggagccctaataaaggtggggattcacattagagaaatgcacatcaaaactaccaagtgataccatctcataccagtcaggatggctattattaaaaagtcaaaaaacaacagatgctggcaaggttgcagagaaaagggaatgcttatatactgctggtgggaatgtaaattaattcagctactgtggaaaacagtctggagatttctcaaagaactaaaaatagaaccaccatttgacccagcaaccccattactgggtatatacccaaaggagaataaattgttctaccaaaagacacatgcacacatatgttcattaagcactattcacaatagcaaagacatgcaatcaatctaggtgcccatccacaatggattggataaagaaaatgtggtacaccatggaatactacgcagccataaaaaagaacaaaatcatgtcctttgcagtaacatggacacagctggaagccattatcctaagttaattaacacagaaacagaacaccaaatatcacgtgttttcacttgtaagtgggctaaaccctgggtgcctatggacataaagatgggaaaaacagacactggggactccaaagggagtgggggcaagggctgataaatttcctattgggtactatgttcaccatctgagtaatgggatcaacagaagccaaaactcagcatcacacaatatacaaacataacaaacctgcatatgtacctcttgaatctagaatgtaattttaaattttaaaaaaggtggggattcagtatactccccaaacctcagacaactgtatcagccaattagggtgggatatgtgctaggtgtacacacacatgcatcacacactatgtggaaggagagggctggtaagaggagacacagaagaaggagacagaatttctgacatctaagcactctccctttgccactgcactagcaaacgtttgtgaaaagaatctgcaggccaggcacagtggcttacgcctgtaatcccagcactttgggaggctgaggcaggcggatcacaaggtcagtagatcgagaccatcttggctaacacggtgaaaccccatctctactaaaaatacaaaaaattagcctggcgtggtggcaggcgcctgtagtcccagctactcgggaggctgaggcaggagaatggcgtgaacccaggaggcggagcttgcagtgagccgagattgcaccactgcactccagcccaggcgacagagcgagactccatctcaaaaaaaaaaaaaaaaatctgcagagaaaatgcttgccttagcacacccatccatctagaaagtgacctcttcaaaggcttcactgggagccctccccaggaagagaaagggctccctaagtgaaggtggaaaggcagtggagaatatgcagggaaaagagagcacaggaacggcagagaagcagaagggtcaaggttcagagccagaaagaatcagcaggactcagaattgaggctactgggtaatgtccttcacaaaaatcatcatatcaagactatctttacaagtcttcagaaagaagacttgtttgtgccttcagaaacaggctgcagggagacatgagagtctctgcaggctcctggggtcagggacttaatcagagagaaaaagcatgccaagaaatggagcaaatgcttgttgctttgttgaccaagaggctaacacagcacaggtagctagctggcaggtgggcagccagtaggtcctcagctaatttccagacactggccaaacaggagacacggaacagaatagcagccatgacagtgcttgagcaggggtaagaaggaggtgttttattgcaagggaagaaggtggccatgactgaatttatcaagttaaatgatcagacctatttcctagtcattcaccatctttcttcaggctggaacaagtggcaatgaagatttctttccagctagctaaataaacataatggactgaatataaatgttcatttctactccctcccaaaaccccattaaaataatagaatgacaagctctagtgcagagaatgtctccaagaaaaataagtgaaccaacagattatctgatgtattgaggactgttctaacaagaattagtggtagaaccatacactatgcaagagaaaaagacaattattaactgcccttcttattaaagttttctgatttaaaaaaacactataattataatagatggcttagttcagttgtggaaatggtatttggacaataaagaggggggtggctgcatgtgtataaagggaaagtctgcaaaagctcaatcttattcttctggagaagtcaacaaataatatctaaaactaatcaaaaaatagcagttgcacatattattttgataaatggaagtgagtagcagatgaagtagcttttagctggatcagaacctgcattttaattccttaaggattgaaaatgagtggctctggagcacaagactcagtgtggaaaggtggagcagggcactcctcatcgttataagccctgcaatagtacgtgactttttttttttttttagatggagtctcgctctgtcacccaggctggagtgcagtggcgaaatctcggctcactgcaagctccgcctcccggattcacaccattctcctgcctcagcctcccaagtagctgggactacaggcgcccgccaccaagccccgctaatttttttttttttgtatttttaatagagacgggggtttcaccgtgttagccaggatagtctcgatctcctgacctcatgacccgcctgcctcagcctcccaaagtgctgggattacaggcgtgagccactgcgcccagccagtacgtgacttttaaaagaatgtttatggaacgctcagataaaaacaaagcttttcttaacaataacaagacgtagctcaagacctagctcagtttgctctccccactccccaaatcttcttggatctccttcctctactctagtgaaaattactgtctgtaccatccccttggcaattaatcattttccacttggcaatgagctaaactgtcctatcattaattatctttccacctgtatccctaactaaatcatagctgcttcacagcagagaccacttctcataatctttgaggagtctgcagaagaccaggtgattagatccacaaactcggaggaggtgcagcagtccggctcccccttacctgcgtaggcattggcctgctgcagaaggtcagtgcaggtgtgtacatctgcaaatgcacggatgcccaggcaattggtgggatgcaactgagactgcaggaagtcacagcagttctgccgaacatccatgagctgcagcaagctggctgccgggagcagcacctgcaagagaaggtgacattctcagatattggatcccactggcagagactcatctgccttttcctatcatatcactcccatgctcaagatcttttcatggctctccactgcccgccagtaagtccaaacttcctagcctgctttccagccttatttcccactactctgcccttcacggaccctaaacaccagcagattctctgtatccctacagccatgcttcccagtctttaatccctggggatcttattaaaatgcagattctaattcattaggtctaggatgggatctgagagcctgcatttctaataagaactcaagtgatgcttgcagttgctggtccacaaaccacactttgagtaacaaaactctacacacacacacacacacacacacacacacacacaatggttctcatactgggctgcacactggtattaccttaagagttttaaaactactgatgtctaggtcttgccctaaaagaatctaactcaataggtatggagtgtggcctggacattaagatgttttttaaagctccccaggtgcttctaatgtacagccacgtttgagagccactgtcccacaaccttcagtgtactgtcctcattcagaaaggtacttaatgaatgattaattactgaacatctatgtgccaggcactagtttaggctctgggattcaggggtaagcaagagaaaccagatcctgttctcctggagcttagagtctactggaacaagattcattccaaatccctcaggactcaggcaacgacactttattctcccatcaaacagatacaaagcaaagaacatctttaggtacattcttagagaaaggagagctaagtttccatttaaaaggtcacaggacacatgactatttatactatatcctgaaagacagaaatagttcttgctcaggtgtatatgcatgtgtttttcctaagggtcagggaagactggcttgagcaggcccgctgggtgctcagacagccaacctctatcaattttccctaggactttccctcagctgctgaagcctgcctctagatcaaacatacaggacaaaaggccaaagtcctgtcccactccagctctgctaccctgcccttcacctatggaagcagcaggtagtctgagaatgattttccaaaaagaaatttagaaaaaaaatcacactacagaatagcttgatttaaggctgcttatcttggggaccctggcatccacttcaccccaaaataatccccttgccccaggcctttgctctcagctgctgccctggctctgagagagtgactgagccagctacactctagctgttcccagccacaagggcttgcccaggaagatatgggctgcagatgcatttgttttcttgattcaggacacttgaaaaagacttcttttttttttttttaagtgctttaaattctggactctttctcccaagacagctctgagtcctcagctctgactctcatcacttttatgtactcaggccaaaaactctgccccactgcccatttgggggctttgtccctccactgggtttaccaacagtcctagtttttccaggactgggggtttcccaggactttcagggctaaaaatgggacagtcggtcacccttcattatccctgcccacagacaataaccaccaagagccaccactatcagtgctcgaactcctgagccaaatgcctacgctcaacaaggaaagctgctcctacccacaggcttacacttctctctcacgacagctgagttctagaaaacgtgctccttttcccttcctccatcctctcttccactatcctatatccccagcaggaaaacagtaaattaacaccatgtctgtgatattttctgaaccactaatacattcctgagaaagaaaaagataaaatcaccctcttctgaaagttttggactataaatgaacacagccaggatccaaatctaaccacctgaactctctccccactaagcagccatcatctcctctaagcagccataaactgggaaactcaattaacctgtgagcttgctcagcccggccgaacagattccaggaccagattagtctctgcctgctagtcaaatggggatccattaaccattcttgctgaatgcacaccaggaataaaaagctctgctcccagtctccaaatgacctccatgacaccccctggccagtatcagctagagttaagactggtgtcaaggccataggttgaccaatcatgctgatttacctgggactttgccatttttaccactgaaagtccccctctcagaaggcccctcgcttctgggcaaaataggataggtgttcatcctagggaggagtaacctctaaccagtgaccctcagaagccctgagggagaggaagccatcaaatgttggccagcacaaaccctactcagaggtgtggtaaactccaaaagggccagatgtgagaagaggcaggaattcaacagcaaccctctccccaccacccaccatccaagaggatttctgagagtccaatctgccctcagactgcattccagcgagctccccaaccccatacgcatatacaagatcatgccagtgacacacagtcccttcccccttcccctcttccaaggagacagcagcacagtgtggtgcttaaattctcaagctcatgacaaccagccagagaaatgaaataataaatatttcctgaatatactccttaggttacactttccatttttaaaacctccctggatagagctacccacatggctttcaacttccctactgttcacaatacccacttagtaggcaaaaattataaggctttctacctctccacaccccttatcctgtttgagtccactcctacccaaaagccttcccaaaccgacttcctaaaatgaatgggccttctggtttctctagttgctctttccctctctttgactctgagactagcttagagtcaaaggccattttcttccttctacttgcttcatacagaaaagtgtgggaaaaaaaagtcaaggaaatcagaatgctgaagggaaggcttggaggctggaagatgtatcactgctcagactctgggtctcagggataaattagggccccatccaatggggttctgggatctagacacaagtacaaaatacattcccagaggccctgaaagaaaaaagagcaatacatccatgaaatgactgtcttcagttccctctccccacatcaacagggctttgagaggacttcctcttctcttatcttgcctgaaactctacttcttcaaagcagcagcagtgacaagattatgaacaaaaggccaagtgcaggtcctcagctctgaagcaagaccatcctcatagaataactaaggcagtactgcctggtccctggagggaggaggctgagatcagaggagtagttggccaaatccacccatcaggatggaagattaccgtaagtcaaaaatcttctagcttgccttctgccacctcagcattacagttcttggaaaacaggccctgaaatggcccccagcaagagtctacaggttacccttcagcttgcaatggcttcccctccatttttcatgtgcaggccccgttttgtttttttttcttcctcagataacatgaaaacacagcagaggatatcctgccacagagtttgcttcctctagcaaaaacaaaaggaaatgccctgcctcagaaagcaccttctcctggaattgcagggaggcagggccatgcacagagggagggcatcagccagggggcgcaggtgttggggccacccagggtctctgccccaatcacacagtgggtctggcacagaatcagtgccacataaagaaagaaaggaaaagaggtgggggggtatatagatgaacaggaaagctggcagaacagcactgtgattaagcgtcattttgaattttgactcctccacttaccagccatgcaactgaggacaaattacttaacctctcaatgcctctgtctcctcaaaaataaaatgaggacaataaggtttgttatgaggatcaaatgagaaaaatttaaagcagttagcacagtgcttggtacataggaagtgctcagttgatgttagtttttattattgtaaataattatgagccaaagtcaaggttctgatcattcatttcatgagaaactagaattcatcatagccacagagcacagtgagtcagagggggctggcttcagcttccaactctaccacttactctctatgtgaccgtggcagtttatttaacccctttgagcaccagtttcttcagctgtaaaggaggaatcatattggtatggtccaatgggtgattataaaaattgaatggaataatgcatgtgaattgatgggcacatgcttgcttataaaagtatgactgctggtacctccaccacggaacaggaactcagggtccctccaaggtacgtgtgcctgggaagggactccaggtgtagctctcacagccatttaaccaagccccagatctctgacccttgtttctaaggctttcaggaaagccccagtgcctccatgctcatctcctcggtgcaccaaatcctcaatacctcctgtcttcacagacaacctgtgagcaaccgcctcagcagatacataacagcatgaagaagaatccatgtttttatccaaactctcttcttcccaatctttttttttttttctttttggagacagagtctcgctctgtcatccagattggagtgcagtggtgcagtctcagctcacagcaacctccgcctcctgggttcaagtgattctcctgcctcggcctcccaagtagatggaattaaaggcacctgccaccacgcccagctaatttttgtcttttcagtagagacagggtttcactgtgttggccaggctggtttcgaactccttacctcaggtgatctgcctgcctcagcttccaaaagcgctgggattataggtgtgagccaccatgcccagccccttgccaatctttcttgttttttctccaacatcacccttgacctaaccacagtttaaagtgaagagattaaaagtccccaaacaatgaggttcagagaattttcagtttggtgaatgcatccacatgctgggagggtgacataacccaacctcataagacagaagcttctggactcaggaccaccaaacagtgaacattatgtccacataaactgtaccttgctttatgtacctcttaatcctaaccaggcaataaggatccagagtagaatatcttctaattatccaagtttgtaaacactttgtattttacaggaaaaaaaagttattaaataaatacatgatgaaaagagcaaagagagctggttccaattatagacttctactacctcccctctactcattttatgccaaattactttgcacttactgttagtacccaaaagttattcacctgtttgaattctgagatgagacgatgacctggggagaataggagtcacctaagctcccagcttttccttcacaagattttgaagacatgagttaaagatcttctactcccggggcccaggctcattcagggatatcatggcctagtggctaaaagcatgggtgcccaagccaggaaggcatgagtttgaggaccagctcgaccacctcctggccatgtggcccagggcaggtcacctgacctctctggagctttagtttcctcttcagtaaccaactgaattgttgtgagggttaaataaaataacgctgtaaaatggtgggtcctgagtgtgcaatacactgagctattagtgagcctgagtttacctggacattctcttcagtcacctcgatttcagcagtatagatgtagtcaatcagcttactcagcgtctgcccatccacgtccttgatttctatctttttggctttactctcagacatgtcacctagagtttacaacaaaaacaaaatgacataaatgtggtacctgggatatgtttaccttccagatggtctcctgccctgtcttggaaacataaaagcacttcctgggctccaggaggcagcagaagggattcaggcacagaagaggataaaccaggtaacatcaaggtcacatcagctttgggtctgtgatcacctacaaacccagccttaagcattccttactctatctattgcccacttccattgtgaaggcaaatctgtgtgcaatcactcatttaaccaacatttactgtaaacttccatatacaaggccagaaaaagtgaacaagatatgcacctgtccttaaggaacacaagtctagtaaggcagatatacaaaagtgtttataaacagaggtgataagagcttagtagacagttatacacaaagtattgtgataacaacaataataagtaacatttcttgagagctaactatggccacacacttaagcactttaaagtcttttaatcctcacaacaaccttgaggtttattaatattattgccattttacagatgaagaaactgagcacaggagggtaggtaattcattttgcccacagtcacacacctaggaaaggccaagttgggttgaaacccagggagtctgactctagagtccatatttgtaaccactacgctatactaaatcccaagaacacagaggagggagcaacaaatctctcctgggaactccagtcaggcatcctattaagaggtcacatttgagagaggtattagaggatgaggacgagttctacaggcagcaaaggtgaggaaggatgagctgaatctgggatccattcgtgcaaagagaagaaagtaccaaaagaataaattttggtgaaatggcgagaggttggtgtggctggtacatggagtaacagtgagaagaaggaagctggagaggtagatggggccagggcttgacaagccctgtaagtcaagctgggactttatcccaggtgtagcaccattgagaggttttcaacagggaaatgacatcaacagatgggcatttttgaacgaaattttggatgcagggtggaagctagatcacatgcagggagaacagctggaggccctgataataatccaaaaaagagagaaggcagggctgtaaataacggcaatagcagcaccacatttccacggtcctgaggccccttgccttcagcctgcactctatatacaacacacgggtttatcgaaagccaggcccattcaacaagggctgctgatttcaggaaagacaggcaacacatgtctttgtagactgaaataaagggcaacctaactgcaagaaacaagagatccagaagcctcaatgtgagtgtgaaaacagagcctgggcagttgttttctctctgtggaattcatacaccagagccaagaaaataaagtacagtacagcatgtgggctgcagacacccacctccaagctgcacggactgcacatgattcctccaccaatccaaagtcccatcctgacacagttctagagctgaatgactggaacggagagaaaagtagcgggggagacattccaaaccccgcctgctcccttaactgccagatcaggtggacctgagaccctccaccctgttctctcttctctgactgccagtgaaagcctgtgaaaggcctcagcacagtgccctggggcagaatgaacaggtaaagaaacaagggaaaaacagtatattactcctccacccataagacaggatccacaatctctctcttgagtttattgagacacacaaacaaaaacatgcatacacaaggaaatcagaagttaagctattaaaaagttcattgatgagggtccagttggtaattacactgcaaaagataatcaaagatagccaattctttgtttaaggagttagccctcaaaaaataagacttaaaaaatagagcagccggactgtaagaaccaagagattcagaagccctcacagcagtgtaaatcagagcctgggctgactgttttctgcctgtggaatttgtggttgaaagtcaggttagggttttgtaactttggggtaaataaatggaaacgcctggaattgtaagaaaatatttttatatatgtgcaaaagttcactttttctagggggatgacaggtcatttttatcagattcttacaggcgtctatgattcagaaaaggttaagacacagttttctagacagtaggtctttaggagacttctccttgctcctttacatgaccctcaaatttctaattttctatattaagtacttaaaacttaaacaagcaagaaaaaaatgatgtgaaagaaaaactaagggctcaaagacaccacttattttctgagaaagcttgtagaatccaatcttattatctcttatgaaccagcaaaaatgactacaccaaactaagactttagtttaaatgggccctaaaaatagtcatactaatagtcactactgtatacctgaccttctgctaaggtacactaatgtgtatctgacccacattatttcatttaacccttgaaacaagtccaggaggtagacagtattatttccattttacaaattataaaactggcatttctttttttttttcgagatggagttttgctcttgttgcccaggctggagtgcaatggcatgatctcagctcaccgcaacctctgcctcccgtgttcaagtgattctcctacctcagcctcccgagtagctgagattacaggcatgcgccagcatgcctggctaatttgttttttgttttgttttgttttttaagtagagatggggtttctccatgttggtcaggctggtcttgaactcccgacctcagacgatctgtcctccttggcctcccaaagtgctgggattacaggcatgagccaccgtgcccggccaaaattggcatttcaagagggatttacacatagatactaagaggcaggactgagatttgaactttggcctaactctagaccctgtgtcatttctaatacatccctcaataaaatctcaccctaactaataaccttaataaaagtattcccaaactcaaggcattggtccaaattctgaggacaagttagtacttaatacctagcaaagaaccaagcggcttatcctcaacacgtaacaaagtgcttggcataaaacaagcattgaaaaagtatttattggagtagaaaatttaaaaaaaagaagggaggttctcttgacatctcataattccatgggcttcagtaattctggaggaggaaaaccatcaaggacttggtcactcttgctccttcactcatctctaatagtttgagaaaatatttccagaaaacagaagatgagccctgtaagcccttccatgtttgtggtcaacccaagtgctctcttctgctagctcttcccaagaggcccagacagccacctcagactctgaactttcagagaatgtctgtcaactgcatatcttgttagccctttccatcttccacttacatctgctaacatgcatgtcctgtttctccaaagagaacatgattctctctagggcagatatttgctcatttattcaattcaccaaacacatatcagatgtgtcctcatgtgtcaagcactgtgctaggcccagagaatacagtggttaacaagtcacagccctgccctcatggagctcagtctggtggagagagagacaagaaaaccaacaactgcaaaagatgtcaaatgttagaaaaggggatgtagctttaaaggttcttaagccagggattcctgcaccctaaagctgcatgcaaaatgatgagcacacaagagcaccaggtttgctcttccagagatagagtccattgttttcatcagattgatgcataatggttaagagtcactgatctggaggagtcatagttattcagaagagaagtgagaatgagggaagagtatcccagacagacagaatagtatatacaaaggtctggaggtaacaaagggtgtgacctgtctgggaaccataacaagttcagtctggctggagcacattagggaagaatgatgagacaaggctgtagatgaaagcaggagctggaccatttgagggacttacaggccacgctaaggagtttagacttcatcctaagggcaacagggagcccctgatagattttaagcaggtaagggatacatcagatttttatattgggaaaatcactgtagccacagtgtggagaatgggtggggaatgggaaaacaaaacaggtggcagattgaccaatgagaagactgctgcagaatatcaggtaaaagatgatgttggcctgactgtgtcttgaacttctttaaatacgtagaccattagggccttgcacttagcagcctctgagaaccacggagggcccagaagagcaagcaatcccagaagcctattaggtaaaagcatccaagtcttcattctagatcctaacaagcacactatgtgcacagctgagacctttttaggtggaagactgccaaagaagagcaagagggagaaggatggactggaggagggaaaggaaaatctttcattatcacagaagactcaagatgtccagaaaaatcactagctcatcttccaggttattaagtaaataaagccttgagaatgaaaatggaatagattggttggcaggtctctctgacgaacaccacagctaaaccaccgaccacccctacatagttatatgtccttaaagacaagaaaagggagtgttcaagagtccttatgtcacagaataccttcttgctcctaacttgaattagtactgtaatttagtctcatgttctgggtagagagaacaaaggaaaatccttaccctttgcgcaatgattcttcatgggcactaagatggttatggaactttcttccccccaaccctcatctaagtcctaaaatctgggctgccaactcatttggctagagctgagcactaaggccaaagacattaacctcacaggagaaaaagaaatactctgccatctccttgaatcctgaccaaccctgttgcaggtgagtggtctgggccatttgactgcagatcagggaatgtccttagttcacaggtccttatgtcacattgggagtgaacagcagtctgtattcctaagtgccacacagtcctctgttgaagcacaggtcaccctatatcacctgtgaaataaggacattctctgttctgcctttatcccaaggttgtgtgagaatcaaaggagacaatgagattgtgaaaggtgggacagcaggatccagcagaaccacagtgatagacaccgcctcatcacccgccctccctggaatctcatccctcctccacctggaaatatctttctgctcaactagaagcacgagaagcacaaagtcaggaaaaaaatgcctctgtgtcattacatagtgactacaaaaaaaaaaaaaatcaaccctaatcacctccacccccgacatccacaagaattttaaaaactatgacgtgctctacaataataaaagtagactttattaactatctacacagtgctgagtgccttatacccgttacctatatttgttccctacttattgttattattccagtcccttcaataagaaagctgaggatcagagaggaaagtgaattctccacgcacctatgcagttaagattggaatacagcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggtgtgaacccgggaagcggagcttgcagtgagccgagattgcgccactgcagtccgcagtccggcctgggcgacagagcaagactccgtctcaaaaaaaaaaaaagattggaatacaggtcattattactccaaagccctttccaagataccacaccatctcccagtgcaaggcggcattaccacacttgtgtttaatccttagtaaagaggcccccacatcaccaactccaaacctcttctatgaacattcataaaatattccttaccaatagtttatctccaatggtggtctcaattttaaggctgagctactctaaacccaaacaagtctacctcagaccatcttggtcaaaccagttgcaccttaatggagaaaccactggaagtgaatagcagtctctattcctgagcaccacacagtcctctgttgaaccacaagccaaattcctgctcaagaaacttgccatttctgcatcaagggtaacattattagacaggactactggctccctcaccttcaaatctgggtatctgggtctcttgagccagaaaaagatgcctgactttattgtggtatgatagggacaggaagaagaagccctatgtcactgtcacttagcccaaaagtgactaactctagaagatagccacgtggaaggtgaagccattgctccttcatcccaggcagcctctgacaccgccatccctttttctctgaactattctacctaatccctgactcctcaggggcaaaactctcagaaaccagaccctatctactaccactattactctgcaacctccctgaaggcccactttgtctaagaaaagaattctattccctagttctccttctctcattgtccattgccttgtattcagttttgctgagctgcatgttatgcagagctcttcaaaggcatcaatataccacacaaacactagaacacagacacagccacaggccagggcctggtagagtctggcttgcagcaagggtgaaacaacagttctgtggaaggaacttcatgcctgggaagtgaataagacagccaggccctcatggttctgccttgtggatgattcctgcctactccaagtctaagccccttgtctctcacccccagcacattcctgaactctcctctctatttctacttaccatatattcaaagataccaaacatcagcctaaatctaataaaaactggacagtaactcctctttaaaaaacaaaaaccaatctaaatcagccactacatacagtacaatatgaccagatgagtgggacagatcactcccagggcttcatttgggatggaagcccaagtgtcttttagccatgattatgggcataagaccctgagcccatatattctgtagacctcagttcctttaacaccataaaataggggctgtatctggatgacatgtaggcagggacccatatggagtacaaatactacagtatacagaagccatggtaaagggcatgataaagagagaaacactgatgaggagattttgggaaaattgcttcccttgggatggaggtgctggatggggaggatggggaatgagtcctagacatttcatctttataggaaaaagatgggcagaacacagcactactggcctccccactcaagttatgctgaaagcagtaaagggcaaataggttgactgctcaccccagatcttcttatagactggttggattgggacactctctgatgggcactcagacttcagtttcacatttattccaagttattgtccacaggacaatggtcaagaagtgtgggattggtatttggaaccacctcaggacatttgggcaacatgaactcggaagacaaaaaaataaaaacatttaagcttgagtaaaagaccataatcacacaactcaagtcagaagaaagccatgtgtattttactttccttttggctttaaacacactgatagaaatggatctaacgagagtcagcctcttactctcagtacacaatgcattttacacgttttgaagctgaacctgataattagaacaaaattttgcaatgttactggagatttttagtatctgtttaccaaggtttaggcaaagccaatgggccttaaaaatatataaatcttagatatcttgctgatgggagcataagctggtacaactgttctttagatcaatgcggcacatgtctcaaaagtcttcaaagtgtgcataccttttaatcgagtacttcttattctaggaatctattctagtaaaataatcaggaatgtacataaagattaagatgcaaggatgcccattatatcattatttataataacaaaatattacataaaactataatttccaacgaaggaaatgaattttcaattagagtatatataatggaatcttatgaaggcattaaaattaggttgtaactgcaatttcattgacatggaaagatattcattatatattgctaagctcaattaaacaaatttttattgatcacctgctatatggaagaccatgctaggcagcagggacatggtggtgaattttaaaggtatagttcttacccttataaagagtatgattggccagggaaatcaaacattgaggaagtaataagatgagtagtaatactaaagagaagtataaagtaccatgggagtaagtagcaaaggaatttaacctaagccaaagaggtcataaaaggccttcctgaggaagtgatgcttaagcagtaatgaaggatgaacgggagtcagacaggccaaaagatggaggagagaacattccaggaagatgaatagcaatttaaaaaaaaatacatacatcaaaaaaggctatttaggctgggagcagtggctcatgcctgtaatcccaacactttgggagccgaagcaggtggatcacttgaggccaggagttcaagattgccttgccaacatggcaaaacccactctctactaaaaatacaaaaattagccaggcatggtggcacacacctgtagtcccagctactcaggaggctgaggcacaagaatcacttgaacccaggaggcgaaggtggcagtgagttgaggctgcaccactatactccagcctgagcaaaagggcgagactctgtctcaaaaaaaaaagactattcaactgtacacattaaatgaacttatgttaaaatatatattttgtatatgtatacatttataaatataaaatctaaaaagatataaaccatactcttacctagatgttgtagtacacgtaattttttactttttgcttgcccacagtttctggtttttacctgtaataaacacatgtgaacagtatttggatggacgggtgaatggatgggtggaaggatggatggtaaccaggtttaatggaaggcttgggctgggcattgcattacactgctttcttctcttgattctcccgtcccttccattcctagaatctaagaatgccccagaagcactttttcttccaatttgtaaaatcactttggttttgctatgacacttccgctacttcagaggcaagttcgttaacaaaaagtggagccagcatgacaattcattgcaattccaaacagattcctctctcaacactgaactttccaaactccacacacaaagaataactggcagagctatttattgaagttacagctaaataactattacagacaagatgaactattttaaaatagagattgatgaaggaaagggggaaaaaaggaaataaaggccttgcagctagggtttaggacaactcaaaagggaatgcagctcaaaatttccagatactgaacttagctagttttctgggctacagtgtgaaattcctggcccaaggctgaaagtaaggtaagagtagcctggtccacttagcagaggcaccactccaagttgagaccagttccttcacatgacaagccaagggggacacacatgtgacaaactctcagtgcacaagtgccaagtctctcccaacaaaaccagtcttgcccagctgtgtaccatattaggaaaagggtcacagcccattcagcaaaaatgtgcctgcactcacccctccttagcaagcttgtgttcattcttcagacattcacttattcaccgcctcctgtggtgggcatggaggattccacagcaacaagacatgttccccaagtgcccaaagctcacagtcaggtgcaggagatacttcactcactcatttaaaaaatatttgtgtcctaccatgtaccaggtgctcagtatatggtaacaaacaagcccaccaaggtccctgtcctcatggggcttatattctagtgaggagagacaggtaaaaaacacataacaacaaaccaagacgattttcagatggtgataaatgttatgaaaagatgaagtcaagttataggatagagagaggcctggtgtggaactatggccagagtggtgagagggggcctgcctgaggagacatttgcaggataaaaagcagtcagttacatgagatacagggcatgggcattatagattccaggaaacagacaagaatgcagggtgacagtcgccatactcagagcaggcacaagcacttggaaagcatgtagaagggacacctgacccagtctggaggtctcaccaagcccagatggcctccttctgtcggcagtgatttatagagcactgaaagtacctggttcaggggaagtgctgagagaaactacagacaggaagctcagcctgtgggtttcaggtaattcaatctcagaactaacagatgggaaatatttggacaagactattgggcatgcccagtaaacagggaccctggaaagttggcaaaggtgctgaaactgaatgccagatattgattatacctatttctcatccccctcaaaacccaccatcatttttccaaatctcctccactcctgtaaagactagcggaggtccagggcccctgtctggaatgaaggtctagggaaggacaataggtaggccagctagtaaagcactgggccaggtgccaggaagccaagtcccactcattcactgtgaccttgggcaggtctcttcccttgtctcagcctcagtgtcctccatctgcaaagtgagagatcagaagacctggccatgtgcccaggagtctacattgttaacaagctcccccacatgattatggtgcagggtgagttttgagaactaatgggctatgtgagtctaccttttttcctcatggtggacaagggctacatgcccaactggcctggacctggttccatcaagtcctccatggcacaaagcacactatctggcgtagagaagcccctcatagtgggctaatggctttctctttcctccctcccctcatgtcaccacccccaacattctcccagtggggctgcagccccataaccatgggttaatggtggccactcaccatacctgtgaacatcgcacagaagtaggggctgcaggctgccaggaccacacggtgggcttctatctcgacatcttctgccacaatcatcacgtcacacaacagctgtttactgtaagacaccagtgagaggacaggatgggttgcagcaaggacacctaccctcatcttacaagggtatttttttctcccacccagatttcacactatcactatacaaagctgtcacagggacttgctctatcttgagttagggaggggggtggattcattgacttttccaagtccctgataaacctgacattcatgctttcctaaggtccatggagagatccaactactctgtggctgtaaattccaggctgcttcatttgtcttcacctctctgttccccaattctatcagttcagattgagaagtaggggttttgcggctcagggaacagtggcaaaagcttggggctgtcattcgagtgactgaatgaatgctgaggaacatgagcataccagtgaagtgtgtcaccagcaagaccaagtactaacaattcccccaagggacccactgtatatgcaacaccagtaagaggcaagccggccttaggtatttctctttcgacccagatttaacgctttcaacaagaagactctgcctgcaaacacagtgctccctaaagaccctgtgcaaactccaatcactgtaattattaaaaatactgtaattacctttctgtttgtcaccccaactcagaaagggacttgtcttatttaatgttgtatcctagacacctggctgcatacctagcacatagtagaccctaaatttttactgaataaataaattaatgaatgaaatgtgatcaatccacattcatagacagaatagggatctgactactttagagattgatagggtgccacaagctcccatcaacccaagaatttttccttcatcattcttctaagctcttatcatgcctgttatcaatataatagttaatatttattgagttatatgtgccaggcactgttctaagcacttttttacacatattacttcatcctctctaccaccccatgagatagggctaattgttatgcctatattgaaaatgaagaaactgaggtccagagaagtaattttcccaaggtcacacagaaaaggaacagtggaaacaggatttaaatgaaggcagctgaagcccagaacccatgctcttcattggtatcctgatcaccactcatccctccttgagattaaagcactagagagagtaggaaagacaaggaggacaaacacacttcaactgtgagccaatggtagtggttacttggcacactaccctggtttgagaaggctgaggtcatgactagattctgtgtgagaatgttgaggccaattaatgagtctgccatggttgacggatggaagaaaagctacatatttgctatctctggtgtagcacactaagtcactgtcaactactaagatatttgtttaggttcacatatcagagaaatagaatcataaggcctgaaaaggctggagctgcaaatgctactagagatcatctggtctatgaaactcagagaggtgaaaagatgcccaaagccacagaagtctaagtcttgaatccagttctccttactccagacacagtgacttttccatggtatcacaatgcctcatgattggctgacattcagaatgagaaaagacagaagacaggttagccccaacagggagaagtggacaggaagtagaataaagtatcgttaaggaggcttcctggaagggtgagacctttggacagcaagaggcaaaaccgggggattgagaccttaccctgcagtggacagcagaccttaatcaccaactgtatcaggataaaccagtgcaaccaggaacagaactggctcttcccctaactggctatgagaccatgggcaaataagctcaccccatttttctcacctgttttagctgcctttgggacatatatcatgggggccaaatgggattacaggtgccatctgaaaatggcctttagtctcattaaattttattctaaaattgtatttccaacatgaatagactcatcttggacatttttacttacatttaggaagaaaattgagttatcactgctatttaagaataaccacactttgggaggctgaggaaggcagatcacttcaggccaggagtttgagaccagccttgccaacatggtgagaccccttctctactaaaaatacaaaaaaaaaaaagcccggtgtggtggcagatgcctgtaatcccagctactagggaggctgaggcatgagaatcgcttgaaacccaggaggcagaggttgctgtgggccaagatcatgccactacactccagcctgggtgacagagcaagattctgtcaaaaaaaaaaaaaaaaaaaaaaaaaagagtaaccggttatattttttggtaactaataagaaaattgttggcagagaagagtcagaaatgctgaacaaatgttcagtgctaggagctgaacaaacaaatgtcagggtgtgttatcttgcacaaacccagggagcctgacaatttttgaacaaatgggaaagaaacacaagggaatgaagaataaagatggagaatccagttaagcaaataaatgacagcagttctgatgggtggaaagtgtatcttaaggccagagaaacactaacctgggaaattggccaaaagaaacttgccaaatagttaagatgggctttccctgggggtggggaagcctgtctgcacactggagacatctttatgtatccatgctacatggaagagggaagtagtagctctaaagcactgcatggctcacaagcactcctattcaatttacctgggatcctatgggatccttttttccgagctatcacactactccatcttgaggggagaaaagtaggactagacactttgccatttgtggaaaagtacaatgtagctgttaggaaggagctcaggctctcaaatcaaactcacctgagttcaagcctctcaaacctctgtcccaccactctctagtgtagacaagtacacaacgtccccagagtgtcacagaattgacatgtgctgtaaatcagataatgcatagtgctaatagtaaatatttagcaaatgttaacttttcatattttgaaaaaaaattttaaaaaaatggttttttttcaattgtctgcttcacttttcctccatatcttcttttttccaaataatatttcatttaagattagaggttaagttttgaacatgttaagtttgagctgcccactggacacataagtaaggttaccaagcaggcaagtggttacatggtcctggaattcagacatgggagatggttaagaggttgaggggaggaataaccagcaaaaaaaaaaaaaaaaaaaaaaagtgtgtagctgggtgcagcagtacatgcctataatcctagatgctcaggaggctgcagcaggaggattgcttgagcccaggagttcacgaccagcctggacaacataatgaaaccctatctcaaaaaatatgacagtgtggtactagtataaggatagctatatagatcaataaaataaaattgagagtccagaaataaacctttgtatgttcaattgatttttgacaaggtagcaagatcattcaactgggaaaaaaacagtcttttcaacaaatggtgctgggacaactggatatccatatgcaaaataatgaagttggatccctacctcacaccatatacaaaaatttacttaaaatggctcaaagatctaaaagcaagagctaaaactataaaaactcttagaagaaaacataggggtaaatcttcatgactccaaataaggcaatggtttcttagatatgacaccaaaagcacaaacaataaaagaaacaatgataaattagttatcaaaatttaaaacatttgtgcttcaaaggatgccatcaggataatgaaaagacaatccatagaatgagaaataattttttgcaaatcatctacctgataatgagcttgtatctagaatatgtgaagaactcaaactgttacaactcaataataaacagaaaaataacctaattaaaaatgaacaagagattttttttattattatacattaagttttagggtacatgtgcacaacgtgcaggtttgttacatatgtacacatgtgccatgttggtgtgctgcacccattaactcgtcatttagcattaggtatatctcctaatgctatccctcccccctcccccaaccccacatatttctccaaacaagatatagaaatagccaaagagctcatgaaaagatgctcgacatcattaacaatcagagaaatgcaaatcaaaaccacaacaagataccaccttacactcactagaatggctataatcaaaagcacaaacaataagaagtgttagagaagatgtggagaaagtagaagctttgctgttgatggaaatgtaaaatggtggcagctgctctgaaaacagtttggcagttcctccaaagattaaagttgccatatgacccaataatcccactcccagacatatacctaagagaaataaaaacatacatccacacaaaaacttgtacatgaatgttcatagcaacattatttataatagccagaagtcaaatgtggtatatctatacaatgaaatattattctgcaataaaaaggaatggtgtactgagacatgctacaacatgaatgaaccttaaatgcattatgctaaatgaaagaagccagatacaaaaggctacctattgtatgattttaaaacaggcaaatctatagagacataaagtagactagtggttgcctagggctgatggggagtggtggtaaggatggggtaaactatggaggggatgactgctaaagaatacagcgtttctatttagggtgatgaaaatattctaagattgtggttgcacaactctgtgaataaactaaaagccattaaattgtaactttaaacgggtaaattgtatggcatctgaattatgtcttgataaaactgttaccaaaagaaaaacagaaagcaatatgctaagatggttcataacaataataaaagcatagtgacagaccatcaaaaaaaaagatgagagcagagaactgtttgcaatggtgaaatgggagattaaaattgtcaaaatgagaaaagaaagactgcatgtggattctactcattggttgttccattctctctgccccttcttttcaggcctggttaggatgtgctattctaagaaggcccacagccccatttgcttgctggatggtaagtcaggagtaagagtcactagagctctgccatccagaagcagcagctgtggtctggccacagcagagcaacaaagtgcaaaaggaggaagaaggcttggcagtgactatgccaacagccattctctaccatggaggtaaaaagaataggaaactcatgaattgtgtgattcataaattgcaaagaacatgtgtgcttgaactaaaatagcttaaaattaagggaagggaatgtgaaagcaatgcaagaaataatcccaaatccctggaatatcatgtaacatttcattagcttaacccctggatggcaagatgctttagcccaggcctccataagtatacccagcctctctctagttcccattaaactcactcagatcaataaagtatcaatgcagacccccttcctccctgcctcccctttccactctatttttcataagttagccatttaaataccttggaatttgatgtagcctttcaataacatgcgaatacaagcttcactaagggcaagattttagtcctcttatctcctgccatgttcctgaacctagcacagtgcttagcacatcatcatcatcatcatcatcatagctaatgcttacagaatattcattatgtgccaggatctcacaacaatatctaaggcatagttattattattattctacaggctgttcaaatcagcaattctacttctcttctatacaaataatcatgaatgtgtacaagtattcaacaacagtaatatatgtgttgtcactgttttaagcacttcattcattaatcttcttaacaagccagcaagactggtactcttattagcctcattttatggttgacaaaagtgagatcagagagattaattaacttgtctagggtcacacaataagtactagagccaagatttgaagtcagagtctatgtttgtaatcactatgttatatggctacaaagataaccatagcaggggttatttatatgaggaactgggaaaacctagacatccaacaacagggaactgtctttaaaaaataactcaaaaatagaatatcattgatccacttaatattgtagaacagttaatgacatagaaaaatgtgttcaatatagtgttaagttaggttgagacgtaaatttctttttttttttttaatgagatgggtctcactatgttgcccaggctggcctcagatttctgggctcaagtgatcctcctgcaaagctgggattacagtcacaaactccaatgcccaactaaggcatatgtttgtttgtttgtttgtttgtttgtttgttcatttgtttgtttaaaacaagaggaaactttatttcttataaaggttacagcctgcagggtggctattctgacaggctgggaagcacagcctccagccagaagccagaaacaagatactttgagagaggggcaaaggaaacaggaatttatgctgagcaaggcggccaaatacacatattcaataagctatagaaggagccatgaatatttatgaaaggagaaacatgcacatgtgcaattgaggttcttgctctccaagttcaaaaactgaggtgatcagagggcggagttttcagtcctctgccattaaaaagtgaagcagaggccatgaaaccccttactgcgcaatctcaaaaaagactagccagaaccactcctgtggtcagtggtctcttattaggcaaaaaagtaagggcagtgtcagaaaatttgttgatatcagtggtggggtcttttgaaagggctggcttttgttagaaccttagggaggaaagcttagtcacggttaccaagagagggggtctaaccaaccccccttcccatcatggctgagaactccattttcaaagttaatcaagggtccccttggccaaaagatggtctgttcagtccctgcggggcttagaattttatttttaatttacgttctcacccttttagacaagatctgccaggggcagcactgatggccaaactttcattttgtcctatctctgccagggcagtgtgcctgcctgccccaggtccatcttgtcccttggtgagacccctatggccaaggacttagagccaaaagacttacagccaatttaaacattcccagtcagatgggaatggaggtgggccagcacccatcaaaacccacaaaaccttttaagcaacatagacaaaaaccaaagccaaaatgcaaagttacaaaatctgtaagttctatacattgagctactgtaatcttggtcttagctacagacttgtcgccattagctataaaaaacataaacatttggctgggcatggtggcaggtgcctataatcccaactacttgggaggctgagggaggagaattgcttgaacccgggaggtggaggttgcaatgagccgagatcacaccactgcattccggcctgggccacacgagtgaaactctgcctcaaaaaaataaaaataaataaataaatattttgctaaaatgatttaagctaaggaatgtagagacttttattgtgccacaatgtcttttgcaatgagacatatattctaaagaagagaggtatactgtccaaagtattacaatggttaccactatgtaataaaattatagatgacttgttgctcatttgtatattctaaatgttctataataaatatattccttttacaaaagaaaaattaaaagaaaaatgataggaaaatctatgcctaaacctgaattaaaattttcctagccagtcaaatatatatagattgtggtccatttgaaaaaaaacaaaaagagggagaataagattattcacttaaatttcagcaaaggactatgtctggtattagaaaagtgtttcccaaaacaaatttcacaaaacacttggtctatatgcaacaaccaccaaaggcggctctatagtcaaatatgtgtggaaaacctttggtcagacaagtttagtgcaggacttctcacagcgtttaatatgccagtatgcattatgaacctcagagaggggtacagtatatagcattcttcaaactcattggggcacagagctcttttttctcacagagcatcttaagggaactagcatttctcagaacagagtttgacaaatgctgaattatacaaaagagaagaagaagcaggactgttagagatggctaaatctaagtcaatgcttttggggaaagagaaaaacctagtaacttgtaacagaagtaatgagaactcaggatgtctttttaaaaaattatttaaagaaaagggggctgggcatggtggctcatggccataatcccaacattttgggaggccacggtgggaggactgcttgaactcaggtgttcaaggtcacagtgagctgtgactgggacattgcactccagcctaagtgacagaccaagactctgtctctttaaaaaaataaacaaacaaagaaaagaggttagtaatagaaagtaagggtgcagggaatcttgtgtacatatctattcctaagttctccctttcaggcatcactggagttgactataataccaggcaaaataaggcctggtgaaagactcctaaatcagacaaagggcacaagccatacccaaaagaactaaatgaggaatttcaatagtgtctaggaaagacaagacaaattcttcagttaacaagagaaccatgcccataagcatggacatcagcacagcctgatgcctaagacagctatgggcagagcttccaggaaatctggcaggaggcctgataaaaattgagcagtggagcataagacaaatttaatttaacttggttattaatgccaaagactaggccctgtagaaaggagacataagaaaacaaacatagaatcaggtagaacttttgttgaaaagtagttcaactccccactcaacacacacttctttggctatgtgccattttctctgcctggaaggcttctccctatccccactacccttcatttctctaactcttatttgtccttcaaaattcagctcaagcatcaaccctcttctccaaagttcccacctgtcatacttgcttctgtagccctctttaagaaacaaataattattgcgtacctaccacctgtcaggcactggatgcattcctccatcataatacctatttgtactatagaaagattattttcattgatctatttatattttttactttgtaccccaatgacccattccagggcctagccagtgcctctgggcatctttggtgaatcaatagaagctcctatgaagtgccaggtgctagagataaaaattactcaaaagttgcctctgccttcagagagttcatgagctacagaaaaaagatgaaataaacaattacacctcacaacaggatgaagtaggcagtaaataactgcatgggcaaaggaagcttctgagctctctggtaaagaagagatcgtgtccacaggctttgtacaaaaaaacatgtacagaaacacatgttcagagccccgaacctgccttgcaacaagcttgtcaaacatgcacattggccttacaaatagcctgtgtacccctcactattagctcagagaggatgagtatattcacatttcatttctctctttacatttaaggagccaggtattcttccaccgatgtggctgtcttgccaacctaagttcagaccagtgaaagagagagtgaaaaaccagaagaaaatacatgacatccagtctttaatctgcaattgtgtgtgggtgttgcaatcattctattattggttttcaagcagctcgttctgttggaaatcaagtttatgaatagacttgctgtaaccataaaggatttttcccctgtgattaatcattaaaatgataggtgttaaatacatacaaaggaaagacagttttctggcaaagtcattctgtctcaagcagagttcgaaaggggaaacctgccgggcgcggtggctcacgcctgtaatcccagcactttgggaggctgaggcaggcagatcacaaggtcaggagttcaagaccagcctgaccaacatggtgaaaccccgtctctactaaaaatacaaaaattagctgggcgtggtggcatgcgcctgtaatcccagctactcgggaggctgaggcaggggaatcacttgaacccgggaggtggaggttgcagtgagccaagatcatgccacctgcattccagcctggatgacagagcaagattccgtctcaaaaaaaaaaaaagagagaaagaaaggggaactcaagtgactaagaatggatggaaagagtcagaattccctaggtggtcatgttctgacttctgttctcagtccttgatgaagctcatggacaagttccttctgcaagggcacggacaagatagaaaaagtacctccgcagttcattcataaccttgaatgctttccccatgtgggcagggttgacagtgatcgtcctctggttcttctcatcatccccagcctgtatcagagtctgggagctcagcttgacactgtgaacaggaaggaagagggagggaaagagaatcactcattggtaaacccattcatccaactgccaaaagcccatgcatttacccacctaccagaggcatctatcagcctgttctcacacagacccaataggaaagacaatgtactgggaatttcttcatatcttccaaagcaaagtgcattcctctgaaggaaggcaggtcatagctcagcttcttccaccaagtactgtgtgattttgtgtgaggtccttattctccatctctccatcctgaaaactgaaggggactaagcactctatcactcacttcacaggtttgtttgttcattaaacaagcatttactggaggctactatgtgccaggcactgcgtttagatttaagggaaacaaaacaataggcaaagccaccatcactaccctcacaaagcttagagttcagtagaggagaatgccaagtaaacatttaaacatcacatttcaactattatgatttcataggagctacagaagcacaggggatggccaactcgtcccagtgatagcaggttgatggaaagcttcctagaatctgagacttgaagtaagagcagaaacgagtcaggtaaagagaaagaagagtattccaggcagaggaaacagtatgcacaaagacctggaggagaaaaagcacaaagtgtgttcaaagtactggcagttcagtaaaactagaggagagcacaagagggaatatcaagagaaaaaactagaagaccaagcagccttttaagtgtcatgtaagcaaagctaagaagtttggatttctttctgaaataatgagaagccatcaaagggttttaaacaaagtaggacagaaagcaggtaaacaaatctgtgttttagaaaaatcacattggctacactccaggaagcagtcgaacaacagcgaaagcttttgggaaactgtaatcccatagaaagacaaaggattataagtattatggaaagaaaggctatctatgtagactaactgagtaagtagaaactagcaagagtcaaccataatctcaatgccttctgtactgaaatcaagagacaagggtatggtggctcatgcctgtagtcccagctactcaggaggttgaagcaggaggactgcttgtgcccaggggtttcatgccattgcaccccagcctgggcaacagagcaaaactctgtctcttgaaaaagtgaaagagaaagacaaaatactcaaatccctgtggggtgccagctagttacccaacaactcctgagcaacatctttcaactttatggaaggtggaaataaggaatcaaaagaatgagcaaggaaaggtgtttctccccaaattggtgaaactattcagctcccaggagtagtgtgagaccttggagttaccggtttgatctaggctaagctttgctttgctactaggaaaacagaaccttctccacttgtatagatttgaggacccatagttcactccaactctaggacaatgagggtactctcctttgattttccctagtgagcctctatccatgctaccacttaactttgcaaactggctagagaaagaggcttctatgctttagagtatatttcagaggcctgagaatcactatagatctcacactggaattcgtaactattggaacattcaaatacgaccagcgtggcagacccacagcttgtctgaccgtaacagactcctcttttggctcccttccccaccatcagttcatcatgcaaacgtaagccacaaataactgaactttggggctgtttggattctgtgcacaaggaagttagctgagcagaggaagatatgcacaaaggaagatgcttagagttgtgtgtttaaagcaggtaaagaaagtctcaagccagaaaatgtggcttgagacttgaatcagagaggggaagcaaccagcaaagatgaaaattttcttcaaaagatgagctattccataagcataatttattttatggtgtctttctttactataaagctagaaaaatgttaacttctatgttctactaaaggtttaacatttttgcttttggtatttaagcccttatttcatctgatacttattttttctctttttttgagatagtttcactctgtcatccaggctggagtgcagatcttggctcaacctccgcctcctgggttcaagtgattctcgtgccttagcctctcaagtagctgggattacaggcgtgcaccaccacaaccggctaatttttgtatttttagtagaaatggggagtttcaccatgttggtcaggctgttctcgaactcctggcctcaagtgatctgctcactccggcctcccaaagtgctgcgattactggcgtgagccactgtgccaggccctgatactgatatttatgtcaggatatgaaatagggatctaattttctccataagtttgatgtatttaaaactttttatttttctcatgcatctgtcatgccatcttaggtcacatattaaagttccagatacaaagagatttctttcttgacttactaacttattccactggtcagtttgtctgtctctgtaacagtaccacatgatttctgtagctttataataaggtctgatatctgacagggaaagtccccagtcctattattatttttgagaagtgtcttcactagcttgtcaaattccataaagaactcgaatgggattttgattaaaaaactgcattgaatttatagatcaatttggatagaaccatcatttttctgatactatgccctcctatccatgaacataggatatctctccatttaagtcctctttaatatcactcagacttttagatttttctgtatgaagaccttacacgtttgattagatttattcctaagtactttatggtttttattgctcttttgtaatagaaatgatgtatttttaaattatgttttctgattgttatagtttataaaatgtagtttttgcaaattcaccatatatccagccattgccaatgttcctattattcctaactatttgaacataaattaggtgtcctatgtagacagtcatattatctgcatataatgccagagatttttcttctatcaaattcttaggcctctaatttcttttttgaaaaaagtttgcactggctaggatggccacacaatgtcaaacagaaaggatgctaatgaatagtattgtcatattcctgctttcaaagatgtttctaatgttcccccattatgtatgtttgttacaggatttttgtaaatgatttttgtcagattaagaaaattcccttctatttttattaagagtttttaagtcataaagtaatgctaaattttatcaaatgtctttgtgtatctaatgagatgttcatatgggttttttcctttaatcttgcctgtgcatcaagggtggaaagggctctggatggatttggggaaagcgatgtctttcctttaatcttgtaatgtgatgaatgacacatatattttctaatactaaaccatacttgcatccttcggataaatctataaactgtaaaatactctacaagtattcattataaatattgtcttcaaactgtggagagacttaaaagccagaatgagaaagcataatttggtatagatcaggaaaccactgaaggttcttgacagggaactagtaagattaaagcacggaaaagcctagtgaacagatattattagcttcacttcaaagatatataaactaaaaagagccattttagaagcactgacacaatctccagtgtggctagtgaacaggaaagctcactcttctggtgtgttgctctttgcactttccagaatggtccaataatgatgtatcccctgttgtgtttaccaatgttgtgtttaccaaaaggtctcaaacacagattgcctattatcagaggatcaatgttcaacaaaatataattcacactagagcctccgtaaaagagcaagtgacttgctgatgaccatagggctggctagggaaagacatcagtttccccaaatccatccagagccctttccactcttgatgcacaggcaaggcttgacatctgaaggaagccaaggttcctttcttcccctgctcctccatgaaaagacacaggaagtttggaggagactctgagtccctggtctctggaaggtacacgcttcttggcaactctaaccttccagagaacaagaaattaagaaaagaacatctgagggcccagagaagttcaaaaattcttcacaagactgtacaaataataagtggtagagatgggatctgagtttaggtatcctgtacttgaagctcacaacctataccctccagcaatatagtgcatgcatgtacataaatgcacacacatatacatatgtctcaacctaaggtcacatgcccaggcacagagttgctagatcttaccatttcatcccctaaacctttttccctccattcattccagatcttaactacttaaacctcaatagattgccccatccccaccctatcaagtcccaatcccaagcattctcagttcttatttccaaataaggctagtggatcccctctcctcgcctgtgaaacagaccacactaaggtatattcccactatcttgttcaagtctaacaccatacttttcaccctacccagacccagccaaaatcacacacacacacacgtgcacgcacacaaattttccaggcagactcagccatgagatgttttctgttgaaaagcatttcacagtaaatgcccttactctaagcataaaatggttgatttctccaagagcaaaaactggccccagattctactaaaaactatagtcagtgttaattcatatgtgcccctcccaccagacctgcagctcaagctactacacaaaggaaccttcatctgtatcccagtgtccagggttccagcaacattcaagttgagcagccatatttaagattcaaatgggtcaacaattgtagatgtagtgagaaagtatgggccaggcagaatctctgctctttgctatagaaatatacagaaatgatcatctaagccattttctaaataaactctagcagaatcagaacacatgaatctagtcaactttgtcaaagcaccagatatctggctcaatactttaattaatttccacactggcctgttactagtaaacttgcttatatgaaccactactggtgccatgatgaacccactgcagtggatggttcaacagcccacagaaagggtgttgcaaattggttctgacttatctcacactcacagatacccactgaccccattcaggaagacatacatgtgagacagtcaagcttcatagccataaggatagacatagttggcccttcttttctgggctttcagcttctcttttcccctgacttagactattacagtggcctcccacctgctgttccccactctagatactctccctccaagtatttcctgcacaccatcgccaaactgatccttctaaaatgtcatctgaccatgactttcagatcctcactgcacacaggtctcttcggggctgtgaggtttatgagctgaagcttcagtcacagccctctgcctccatttgttctatatgttgagggtccacataaaatttcctttcaaaggactctatagctaaaaagctgaaaaatcatcagtctacaggataaagtcatgattcttgactagtattcaaggacctccttgacctggactgaacctaaatgccagccttacctctctcacttactcaaatatttactaagtacctattatgtgccaagcagatgaaccgttcactgcagacacctatatttcccttctctttccctgtatcataatctaaatacctgttctttgaggaccaattaaactttacctcctccatgaaaccctcgggatacatcagttctaagtgagctcttccttctctgaattcctgtagtatttctggcctgtaactcaactggcacatagaattctgccttgtgcctgattactttttcagggtacaaatccaaccacctacctgcctcacactagattcaacatacccagagggcaaggaacatgtgtctgaggactctgtatagcttagcctgcccagcatgaggtcatgcccacagtaggtcctcatgacatatttgtcatctgaactctacctgaagacccttcacttgtctttacaagcgttagatggtagagtagaaggggatagtctgaccaacacttttattttttaatgaaagcagagttggccttcagagttaaattataaataaaatatacataaaatagtaattataaaagttataaataaaaatatataagctctaaaaattaggccctcttttagcacagcaccttccaaagccttctttcttgccctcctctatcctctaaattacagatccacatatccaatgtcttatttgactcccctaattagattttacacaggtaattcatacttattcaaaatttatgttccccaccctcccttaagcctgctactctttctgtattctctatctcagaggcataaccaaccacccaatcacctatccaagccaaaaactggggtgttatccttgatatcttcctccctctctctctctctcactcctcacatacagccataaatcgaatcaatcctatgtccattaatatccctgcaccccatttccttctcactttcgctaccattacaaccccattccaggtcatcattgtctcttgccaggattattataataacctcctcccagactccagagggacttttccaaaatgtcaatgtgttccaggcatgttctacatgaagcctcactgattcctcactgcattcagaataaatctcagggacctagcctggcccttaatcccatcgttgccctgaagacttcttattaccgtaatactaaaatacttgcaatagccaaaatacactaggctctctgccttgtgaagttttgtctcactagaaaactgttctatcttattccccactcattctcccgtgtctagctagttcctaccagccttcaagcctcttccctgaagccttccctctcattctccactactcactagattagttaaaatctagtgggaaactaggttagtttccccagttctgtattcccacagtactgtgcttccttctgtattgtattctaattacctcttacttatctgtctgccccacacagtgtgtgctggtaaatgtttaacagttgattgggaggaaaggagccctgatttgtaacatttgccaatttccagactgtaaatactcccaccatggcagattttaagctaccaacatgatgccaccgaacatgagatttgggaagagatgtgcaacagcacaccatcatatcactgtatagtatttctacaccaagacacaatagacataacctcaaagccctagaagattacagtaaaaaataattagaaagtgatgagtttggggtatttattacattcatttttaatataatttataagttacataatttgttaataatggctatatttaataactggctccgaaaattcctgaaaatttaacaaacagcttttccaagtgggtgagtgctgactccagcacactgctgccccctctagattgtgagctctccatgagaaccaagacagttatcttagttgcctctgaattcttagcttctgtcacatgacaggtgctcaatgaatgattactgagtaaattaataggtagataagtaaattaggtttaactactgaccactgtagctttcctcactccccttcattaaaatactgatggctttgtccccctcaactttctctccatgacccctccacctcacgttcagagaggagtactttcttaggcagcccagtcccctgcattgatgacacagaatcaggaggatgggagtgagagaaagccagcaacaactagagaagagggaagaaagtgagataggttactgcttactgtgtcagttcttagactctttctattgctgaggaaaatggaggcagtgaatggaaaggaaaggatactaaaaaacatgctagaaaggcaggggatagaagagtctccaagcaggctgattgtgcagcaatgtttgggggaatccaacaaatgaggagctccaagtgatgagaactcacggacacaaagaagggaacaacagacactagggcctacttgaggatggagggtgggtggaggaagaggagcagaaaaaataactattggctacctgggtgatgacaggtactaatctgtacaacaaacctctgtgacacaagtttacctatataacaaaccagcacgtgtacccctgaacctaaaataaaagttaaaaaaaaaaaaaagaaaagaaaaaacaaatgaggagttccagaacatcttgggtgtgcgagaatgtagagggaaggaaagtggagtctgagaaatgctgttaaaggttatgatctgtttcacctctaaaggtctccaagagatgcaaataaaattcagaagtcatgagctgatactggccacatacaagaggcccaagcacattatgttcaagctagagatgagatggaataaagaggcaaaaccactcaatgaaggcaaaacaactgtgagccagggcaaagctgtgctgaatgcattaaaaactctcaacaaagaaagtgtcatttagaaaggaataaccaaaaactaagaatcagacagagaagaaagccctcggtccaacccatcacactctgtctaggaaagtgatttaatcatcagatatcgtcagctggttcagcctcaggtcagatcctcatggtggagtttgaagtctgtaaatactccaatgccataactcagtccctagtttactctgcagccttttgaccagtttggcctcccccgtggttgtccttcagagaggtagaatgtggttgcaggccctcaggaatatcttgccagtaatattttactgcaaatcaataaactgatgacatgttgactattgtattttaggttctcatgaggtcattggcatgactctgcttctccaactctggacagcaatgggaccctatatagataggatttctgagcccctggcactctggtcaaactgcagatctagtaagtatcccaatcctaaagttcaagaccaaaatgatcaaacttagatttctacttctggattaatgaagaacctgactcttgaagatgtccagccagcaggattcaggacttggtggtgcagtcctgctatcacaaagtaccatttacacacaggttaccagagagccccatactcttcatcctctttcagcagtgccacctcagttcatagaattaggctgaatcgctataatagcccacatggacacgtagaacacatgcattagtaaggtacagatcgagttaacatttcctgaaagttgagggtatgttaaagcaccttacctccattttatcttcagaacaaccctaggaagtaggtagcattatctcttaaggtacagacataaagtcttcccaaaagtcccacataactagtaagtgcagaactggcactgaaacccaggtctatctgactccaaggcctgggcttttaataacaatgtccactgactcgggataatgtccatagcccatcaggccaagtgaggcacaacccttcatgtcccactctctgacgttcttccttgtgcaaccaaaccaggccaaatgaaaaaagaccaaatctcctaggacctgtgatatagcactacttcacttctgattatgggaaattgcagtgtgtactggagtcagtgttattaattgtattgaacttggagtttccacactggggccttcacacaagccaatcatgattcaccaaagatgaccagcagatgctgtcattcttgtaacatgctccttcataaacaagctcaagaacaggtatgttactaatcacattcctaaaaccccaagtcacaaactgctttctttaaaactcaaggggaaaactcttaagtgggctgtgtaaaaatgtaaaacattttacacagacagatagaattagacaagaagagagaaagactaaaagaaaacatgctcctcattatgtggcattttggaagccaagcttatgtttggtttgaataggagagctgagcccttgtatgtgtgtggttttgatagtggctatgatatactttcataagtgaaaatgaaaagtccaggaaagttgtgctaagactctgaaaatcctcataaatgataaaaagttagatctctgacctgagaggcattgaacttatttaacagaaaaaaaaatctaccaacacatgttcaagctattttttacatggtttattagtgctctattccgtttaacctagtttgaacattcatccagaaattgaaaaaaaaaaataggtcagtttgatgatggcaaatttcatcaaataaagcacttgctttaggaaaacttacacaaaaattatcttgtccagatctgttttaccagttcaaaacttagcaagcaaaatcctaaaaatccaaatctgggtgcagggatatcaagaggtttctttccctgactttgtttttgcagttgaaaaccttactttgtcaaaaagtatttccaaaatggaaaaatttggtttcaattatcatggttgaaatgcgtgcacatctgcttcaggcagcagtgatgcccaaaactttttacagaattttctatccctgacttctaaggttgggggaggactaagtgacttgccgctgggaacagaaaaaaggctaggttgctcaacacttgctcttccctgggtcttgccagcattcaacctgacattacaaaactcaacatttaaagtgtactggctttctaagtcttgtctcctcagaaaatattctctatctgtcgttcctggatcaagggtaaatagatgagctccttttgctcagaagttccctgaggtccaaaaacagactctccttcataaaaaccagccattaagaaccatcctctgaggacacctcacacaaaatcacagcatagtgcccggtacatggtgcccctctcaagcaggggcatctctgtgcttctgatgaagaaaataatcacaattttaagaaaaatagacaattaacttcccctttttatgatgcttcttccaaagttgtggtgctctgtaactcttgcagatctgccacagtctgggcctgaatgttttttattgtggtaaaatagatgtaacataaaatgtataattttaaccgtttttaagtacagtcatactgttgtacaaccatcaccaccacccatctccagaattatttcatcttcccaaactgaaactctctatccattaaacaataacttccccactcctccctccctccagctcctggtaaccattttactttctgtctctatgaatctgactaaccatttattttgaaattttattttaagctatccacaaggctgatttccagaactgaaataaaatcccaattgcaagggcaactgccatttctgatatctatcttctctacattcacactcacacagaaacaatttatcattgtaatagctaacagccagagaccctttccctttgcaaaacagaagacaaaatcaccttcctctgactgttcaagccacagtgattctcccatggagggaactggggaagacttagcatcataaggtccaggagagacctggaaatctagaaagatacagcaaaggctagtgcaaattcacaagttcttcttaagagattttggcctgaacaaacatgcatccagcccatggttccaaccactgaggcaactagatgccacaggttgtctataaaaagaaagattaaggtagatcttggtgaaacctaaaagaagaaatgccaagccctatggggtaacttactataaggagatagttttagataagaagcaagatgacggcctgataagctccctcatttcctcatggaaatggttctacataatctgctttggatgataaaaaaagagaggtcctaaaatatgccttggttagtaacccagcagcaaagtatagggtacaacatagcaataggtggataccaatgataatagcaactaccatctactgagtactcactctgtgcctaaaaaactttactaggtaccttacacatattgtaccatttaatcttcacaacagctctatgaagtgtaagtactgttattattccctttacacagaagagaaaaattagttctgaaaaaaatgtgacacactcaaggtcacactgtttgtaaagcagattcaccgctaggtctatgttactccaaagtccatgcttttaattaatagcctttcaaggtagaaagtattttcataccctcatggcaaagaaaaaaaaaattgttcattagcaatcccttggttgaaattttgtaatgcttaaaaacagccccgattaagattcagcaggttaagtgtggaatgagcaccagattgaggatccctccagtctctggaggttggacatgtgatcctaggcgagtcactcagcttctctggacctcaatttcccagggaacttgtaaaacaaggctacttccctctgttctccccctacctcaaagcattccttgaagtcagttacccgtgctaagataataaggctgatatccaaagatgaggctattggccaaaggcttcagtctcttctttcaccaactttctttttagttatcagagcctcacacaaaagttattagctaatcagctaataactattcagcacctgctatttgtgtacccatgcagtagtcaatgggggtatttagaagtacaaggcaccagccttgcccttgaggacctgtctccaagtctggggactgctaagatatatgaaataaaagcactgaaagatctggtgggcctattattcagtgtccaactatgagatacaaaccagaggtattagaattccgaagaacatcagccaggactagaaaagctgagtttccaagataaagtagaattttagaataaccttgatagatagataacttttgcaaaattggaagggaaagacatccagcaaaagaaactctgggagctaaggatatgaggctagatggagtaatgtataggatgggtgatcatgaaagagatcaacagaattctcagtaggtatatgagtgagcagtggaaatgggaacaggagttagagttcagaagacttgaacgcgtggcatggtaagctggacttggagcaggaacaaaaggtatgacctgggtgacctggtgaacattggaagctgctcggtttggatttcttgtctaccatctgccttcagcagaggaaaagtacaagaacatgtgcaacctggtgttctaaagccatagacatcagccatcccagctgagaggccccaggacaggggcaaggactcactatatttctgaacacagaactgggaacacagtgcccaaaactgtttgatccgctgctggtagtctcacactgacctctcaaccccagttacaccacaggtcaagcaaataggcatggcccagaatctctaaaccttcatcgcatcaaccccattctctgccacctaccagatcaatgggacactgttttggggaccaaagacactgctcacctctgccccacacttaggaaataggccttcatattctgctgctcagcaggcctcacagagttcaacactaaactcctgttgcaaagagcacccagaaagagaatgcaccagcagcacagtcagtcccaggctcttcctgtgggagtcatcaagaaacacagttcccagggcctctacagacaaaagaatgacacccaatcatcatgctagttctaatagggtctagagatgtttaatggcatcactgtgccccgtgagacacagaagtcacaacaactcatgaaaaggaaagtgttcattgagatactctctagtgttgacttagttgagcctattattgttaaccagatggttactgtctgcatcaaactggcaatctggagcagcaggcttcccctcagtggtgcactgccatggccggacccctccctgcagtcttctctcctcagataaaatggcaagcctcgtactctaccaactgcagaccaaagaatgaagaggttggcactcaagagatattttacttcatagacagaggaatgtcacctctgcactgcgctgagcaccttcacaatgaaagattcagatcttcagataacaatttaaaaatttagatgtgtgtgcctgccaggatctaactgcctcgctagttagatccagctcaacaaaagtacttaaaatcttttctgctggttcctatttcaaaagaaatccctgatggaggaagcacagaccttccagtatcactcataaacttttcaatacaaatatgaaactcagttcagagcaagtatcatctgactgggtttctctccttcatccctgaatgtgtgtgtatacaggcatacacggcgtgcacgcgcgcacacacacagccatcagcatggcatgcttgctgaagattcaagcactcctgcgtgaaaatgcaagtacactatgtcaggtcagccccactatgacatcaaaaaccccccaccaaagaaaaaacaccccgggaaaggagccaggaaagggaaacgcctccttgaaacagcctgagaaaggcaatctgattcagcctgtgctgaaactattcccgaacaccagccaggaagtcccttctttcagggtgctccgctgcctagcaaacccagacctgcctttgcggaagccagatctctggagattcaagccctggaacgggtgatttggaaagcggctttcctgctcttgttctggcgccctttaagatccatcagtggccaggtcttccaactctgcctagccaatgcaaacacaaaagctggtggctgcaccgcaagcacacatacacttacatacacacacaacacagcacacacttatacatacatacctttcaccctccattgtgtgaggcccagccagggtggtagctgctgaactgtgtatgcactcggggatcctagttctgttcttgattctcccagcagaccagtgggaaatctgatcagcaacagtgattcagcatggctgcaagtgaagcctcctcccttctcaatcctccttcctctgacttactcgcagcagcttctaccgcaaaagcagcagcaacagaaaatgtcttacccagagctccctgcagccctttcagctgctaaaagcagcaacccacttgctccccctcccccgcaggcttgctgctccttggtctcctaggaacggcggcagctccagcgacccaggtgcactgccacctttccagcttcctctgcatctgcccaggcatccccagcccaggcgattagcccgcccctggggctcctgcctcctctgtctaggctgcaaagaatc

SEQ ID NO: 1243 - DNA, 172625 bp, Homo sapiens
ctttttggcatttggatggtttggtcaatcttctcttccttattccaaagtttcttcctgtcggtttcagttccagaactaaagtaaacaacaatggaaacaataactgacaccttataagcaataagaaaaaaagagaatatgataaataatcctgagatgctattaaaccacagccaagatcaaagtcagaatctcacatggctctgggtttggcatttaccttcccgggacttctgctatggggcattcgcaagagccactgactcagctttgaataaaagacatccagattaatctgaaggacaaagctggaaaggtcaggggtctaaaaggcccaaatgaggagggtcgttcctttgaaacaaagccaaaaggcaggcaggccatggcttctcgaggtagcagacggctatagcagcatactgttgtcttagaaacagaaagaaaacttaaaggtcctctagtccaagcttgagtgcacagatgtggaaagtggggtccagagatgaaagaacactattcaagatctcacagcttgtttgcagcacagccagggcggcaatttgggtcctctggcttcaagtacagcattgcctcggcatccccagtgctgctggatcctgccctcctgcaccttgggggagctgcaggggaaaatgagtttccccagtgtgaacttccaacagttatctcctttggcagcaacaaagccagattgaagggtttcaaaatgatatcacaagttcatgggaaagatcctgaagcctaataaacacctacgatgttgctagccctgcccaaggctttttagaagacgtcccgttctagcccagcaggagagcgagcatctcagggcagacacgccagcggccaggacaccaggaggaagctatctgtcttcagcttccctccagagttgctgtggagaccattttcctctgacagatctctgaccctgtgtcttccatggaaaataaatggagcatgtcctgaagaggaggacagacattggacataaggaagagcaagtggacgtctgggactgacaagggggccaaccaagaggatgcacgtttggacccagacacagggagaaaagtgtgttagcgtctggcacagaacagggcgaagaagaggcaggggatagcttgaacatggctgtgacggacgtgaccaagcaagtaagcaagacaggagcgacgcctctggctaagacaggaacagagagggagtattttgttgatatctggaagcccacacagcaaagaaggcgtatttggagacatcagtgaccgagataggacgcagcaagctatcgtgcttagaacgtgagtgagacagatcagacacagtgagtgacgggaacatgtcagagacaccagagaccacgcggcaaaagcagagaatctgggaagagggagtgttgggaaataaaaagtgaacaaggaggccattatgtcccctgactccctccagcgccacctgctggaatctcagaggaaaagcccagcgagcaccgggttcctgcactggcggacggaaagcctcaggtgaagagaataccgggtgcagtcgcgcacaagcagcagcttaggacctggccctctttcggaggcatggctgtcttctgggtcattgtcccaggggcctaagtgtcactgggctgagcagccaccaaaggagaagttgctggcgggtgacactgactctcccactggccaccacactccactgcatccctagagagaggagaagattacagaacctcagaattggaaaggatgttgcagatcatctcctgaaagagcccacctgcatggcaggaacactctgtgccatgcagatgagtagctatttggcttctacttaggaatttccattgacaggccagtccatattaatttttggcaataataactattagaaatagcccattaatgttcagccaaaatcggtgtccatatggcttctacctgatggacctattacgcctatcaggccccctcaacattgtgccctctaccgattatatcctccaagttttctctactccaagctacacattccgattttctttaatagttcattatatattatagtttccagattattccccataatgggcactgtcctttgaacacctctcttgaattatggtactaggaaagtgcacaaattttcgcagggagcctgacttacatcatgtgcttttcatcatcaattgggtttatttctattaatgtagtcaaattcagttcatttctaaaaatggtaataagttattggcgtatattgagcttgctgccaactttgatcgtttttgatacaacaactgtcaattcctgaggttctttattacattgctgcctagttgattttattatttatttatttatttatttatttatttatttatttatttatttgagccaaaatataaaccatcacattttactcagttaaactttgttatatcggtttggtatcactttagtcagctgagatcattctaaatcatagcaattttaacattcaagatatgattatttagcacccactcaaactagaccttaagttttttgcaagcacataggaagatcaaataatctacaatggtagatatttcagtttagtgtcatctgccttttagtttttcaggcaaggtaaaaaatgttgagcaagataaaacagagaatcatagttaccccaagacaggcttccttgcagtcaaacatctaatgctcaatgtgcctgagaatggacccgctctggcaggctttgtccaataccttgctaaaatgtctctgtcaaacagaaaatctgtcctagcagataaagaaattatttggcatgaattattatacaacagtgaatcttacttacacaagctatgagtctatggtttctggagattagctttagtgtttcttgaaaaattggggcaatatttactatctccaggcttccacctattccccagtcctagaagaagttcattcggacttgttagcaacaagttttttttaagcccctgagatatgacacatcttggctcagagagagttaaatgctttccatcaatcctggacagcaactttctccctaaaatgttctcttctttccagttggaagtctattcttattatagcagaatatgcaagatttcttccctaaataatgaaatctaactatttctgggttagatctgaacatagctctgaacatagcttttgttcatccttgattcatccttggttatatgttccttcctccagattttccacatgccattttaaagtgtaaactctctagataactcaagatgtgccctcaggcctttacatactcccttacatttttatctgtctgattcattgaatatatctatttagagaaaaaacaatgaatgaaaaagaaggaatgaaggttaaaaaggaaggaaggagagaaggaagaaagggaaggaggaaggaaggaagaaggaaaggaaggaaagaaggaagggaaagagggagagagggaagaaagaaaataagaatttctcatctctcattggccaaatcccctttgtatcatatttgttattattgtcattattagcaacgataaaaacaaccacctattagtgcagcactggtgtgccaggcattgggctgaatgcagtatgtgccttaattcatgtattacacccatttaacaggcaaggaaactgagcttcagggagcataagtaatttgcccaagtatacacagttaataaatgacagggtcagaccttacatttaagtcatttttgacaccagcacctgtgctagtaactgttctactgtattgtcattcatcattttgacaactaccactatggatacagtatttaggtctcgctgtctctagcatttctttgtcccactatggcagactcctgggtgaaatgaatatgtagaggggtgcatgttataaatgttccacctgtgagaaacctgcagtgtgatgtggcatttccatttattgcaacacaatatgactgtgacactaacatgagactctttcctgctaactccatctgaccattaaagaagagtcattgccaagtggaaccccatgttttctgtgacgtagaactagggagactaggtgtaaagggggaaaaaatcctgtgaaggtaggaggaaagtccggaagacaaagagaggggccacatgaataaacataataaagaatgaggggtgaggataaaagacaaggcgaaaagatcagagctaaagaaagccatgtggttgggcatgtggaaggctccagagcaattggagagaggaagaggttctttgagaaatgtttccgaagggctacattggctctctctttctctccctctctatctatctttgacattggcaaactcagcttcaatatattggctctcttgtacaattcttttagagatttaaataaagattgaaaatactctagtattgctatttgatgtctaatgccaggttacatcaatatagctctggccatggagaaaggacaatggcccagcatctaactccatgaaggactcacaacgtctctctctcagcaggacgaatgggaatgtgagaataatgacagagtgatcttatggtcagttggctcatagccgcagttctcattgttatatttacataattgttcacagttagcagtttagtgtcatctgccttttaggccttcatgcatgataaaaaaaaatgtggtacattatactgcaccataagagacctccttcctgtgcaataagatcatcctcagtgcacatggctttaacactcaggaagcccctttcactcccagctagaaggtcaccttactaattcagagaagaaagcagcagagtgtagcaaccagaagacagggacctgggttctaatgcctttggagcctccagttgagtgactggatgactttgtccctttcctgtgcctcacttttcccatttgttaaatgaaggggaggataatctgtaagatcatttgcagctctgacattctgattctatgagtagcagggatggtgggtgacagagacaggccttctgattgggcaccagctgtgtgtgggactgttctccaaagctgtgggtaattgcttcaaatctggcttttaatattctattgttagtatctgatactttatattccatgtggagggaagaggtttcgctggaaacacagggagggtaattttggatttgtattaaagaatctgaaagacctcaatttcggaatctgtgaaattacattgcaaagctgttaaacgtatttgggtaggataggatagggtggggctgagatgccacaacttaaaatgcagcgagatcacaactgtctctcctcaaacatatgtttgatcaaaaacattggcagagccactcaaaatccctgatgcaaaacatcatttaaaaagaatctttctccaatattttaacggatgagtttttaaaatgcagtttcttgttgtaatcattttggtaaaatccctgacaatttacaaagcattgtcatatctttttttcacatttaatcttcaatgcaaatctgtaaggcaagaaggtacagagtcttgtttccatgttagaggaagaggaaagtgtaatgtagaggcatggattgatcgatgggtaatggtggatctagtgctataacttgggtattctgccctccaaatcaagaattctgcccatttggaaacatggaaatcatttatgtggtgggaagttttataacaaagttattagcagttaatgaaacagacttacaattacttgttctgtggaagaaagaataggaggaggaagaaggagaagaggaggaagaagaaaaggaggaggaggaggaggaggagaatcacttgctaagtcatctttctcaaaggtccagaggctatgtgcatgagaactatattgggtacttttataaaatacagattcccaggatccataccagacctttgacagcgagggtaggagggcaggagtgagccagagagagcagcaatctgcattttaaaaaactgctctcagctgattcttacgcacacaggtgtatgagatttccctccagccattctattcataccagagagcgagcttagagatagagacagtagagagagcgagcttagagatagagacagtagagagagcgagcttagagatagagacagtagagagagcgagcttagagataggcagtagagagaaatcacaggcaggtcagaggggccagagatagaagtccctgctcccaaagggaaaggaatggaaacaataaaataaaacatacatttcagcaaagtggacaaggaagtatttattggttgtcatcacattgaagataaacagatgagaaaagacttggtgattatgaaaatgagaaagcaaaaaatgtaaagagatgcacagagcaatgtttttttaggtgcttttcatgtgatgagaaatagaattcttgggtattgttagctgataaaaaccgagttgtctataaaccgtgaggcacatagatttgtaataagttatcagcaagtttgcttattaaaagtccatttcttaaattgtctgtagatacactatcaaccagaattctactaaggctagaagatcaagtgtttcccaaacataggatgtgttctgtgagtgacatctcagagaatgggcacagcattaaataatctgaatgacagcaaggggattcaaattattcattcagtcattctgactcagtgtggtcctgctctggtttaacaagtctctaatacctaacaaacacagtgcaggcgtcaggctcaaagcctttggcaaaaaaacaggataaagctaaattttaataactttgttttactttcattgcatttgtattaaaaatcatcttctctatatagttttgcatttaaggtcacaatacagagtttcctttacaaatatgtttatttagatttaaaacgtatttaaagaaaaatagtaaataaataatagcatggcatgggtagagtggtgatatgataaaaaaaaatcatgaaagtagcatgcaagttacaaaagcccctatcagacagatgagaaaactaaattgcagaaagcatagtgtcttggcaaggacataaagcaatgcatctgcagggcatgacatctaggatctttctttctactgtcttttgaagcttgcagaaagctgagctttcatagtttgggatgttaacattgtggcctctggacaaaatgtattcccaagggccctttaatctcatcaccagtctcagatatgtccatgtttcaatacaccaaagtgcgagatcaaatcaggtgtggctgattctaatccctatgtacttctttccctatttcccaatatgtgcatagaactaagaggtcaaatcaatatcctttcatgacttttttccattgtttaccacagttcctaaatggcaaataaaaggattgaaactctgaatctttgggagtcagactatctacctgctttttctatagtattccaatataaaaggacctaaaatatctaggagaaaataccttaaaagtacgttttaaacacagccaatatttactgaatgtttattatgtgtcaactactgtgctaagaaattcatggattatttcatataaacttcacaataatcctatcacatgggttttattatttgcaggctctggctgagtggaatgaatcctagtaactttccccaggtagagtatctagagagtggtggggtcaggatctgaactcagagcctgattgaaacaacatcactaaatttgcaccttcatggaacaggcattctcaacccctaaacagtgctcttgagaagctgcccataggagtgacagtgagtcaggtacataaagaatacttaagatactgagggataagctgagcttcctaaagaagggcaagtgggtggtaagatagcccagagactgaggagaaagtggggcaggaaagtttagagaactcctattggaactgtgcctagaagaatgagtagtcttgtgccaggctggaaagtgagacagcattcaaggcagcagagatgatccagagacaatataattcgctatttgtttgggaaaagctgaccaatcttgtatgtttattgcacgaagagttaggtcaggggagctgggctgcagcggggagagttgagggaaatgagctggaacaccagattggatcaggccaagaagggtttcatatacccttccctctctgcccactgcaagtcctactgtactgctcaaggttatcctattacaacccaatccagctggcatttgcagtttaaaatcccacatgtctgaatggcctttccatcttcctgagtgataaacacgaagcagcttctccctttatggctatattatatacatagtcccaaaagaaaaccagaggcagagaaaataatttataatttgcaactctgtcaaggaaagagcatcctaaaatcaccaaaatgtgtgaatagcctttcagttcaattctagaactcacccttttggaaagtcatgcaaatgtatatatacatatacatgtatatatataatatataatatacatatacatatatatgtatgtgtgtgtgtatatatatacatatatatatgtatatatatcctgatcagtaaatatatccaatattttttccaaatgcaatctcaggcatcaaattagctgtttaccactaagcatctatggagatatttctcctttggaaatgtctacattttctaccaaccccagattgccaaagattcagtaaaggaaagcagaatggccccctaaaattgacagtatcatttctgacatatgtcttctcattagtaatatttccagaaattctccagcttcaaccaaacaaaatgttacactggctgaaatagagtttgctgtcccctacacttaactgcactgtgggacgatgcttatgattttgtaactcacagaatcacaaaaaaaggggctgagaacgtgttattcaatctactcacctcttccccagaaatgttgactaatgaacattcagttcttccagttactgatattcggtcaatcaacacttttaattgactgatggtcatccaattgtctccttcaactttactaggaactccctagtaaggcaatccattccattttgtgctgaaatacatgttcttataacctcaatcctttgtttcttacctctctccctcacattatgcagaagaagtcgaattcctgtttcctctaacagccctttaaatatataaaaacaataattatgacctaaaacctctttgctctaagctcagcatccccagttccttctactgttatttatatgtcataaattctgtagagaaaatcatggcatttaccctcttctgaacatactccggcttgtcaattcccggtataagatgaagcttttatcatttccatggaccaggtacctgcacattgcaccatggactaaacacacatttacatgggaatatggttttccaatgggtatctcagtgtgctttggaggagatttcttcctgaacagctgctctgactaaattggaaggtctgtgtcctcgccaagtacatgctgtaagagaacaagctcctagagcctgcctagtggaaagggcttatctgcaaggttactgccggtactctaaccacagaagttcaggacccttcctcctagaaaccgtatcagtcgccttctacggcgctatatatttttttttttttggtcttgccttaagaatgtatgaggattaaaaggagccaaatggtgcaggggctgaacctcctggtactgttgaaagacctctcctgctgtccttggcagtggcaaggaagttctctgttgtaaagctcagaggactagtttgaagcagggtttcttaacctcggcactatctggaaatctggggccaggaaattctttgctctggggtgttccatgcattgtcggatgattagcagcgtccctggcctccacccactatataccaatagtattcccacgttgtgacaaccaaaaatgccaccagatattgccaaatgttctctggtaaacaagatcattcctgataaagaactactggtttaaacccacacaatctcagtgatctaagacatgcagctagatctaaacttaaagcattatctaattcaacttcctcattttattggtgttgggagaggtaatgacttcctgatgatcactaagggattagaagacaggcctcctgctctttccaggacaccagcggttgttaaccctgctgcgcactcaagctcctaaaataaatggatttctgcttcccaaccagacccaattaaaatggaatctctacaagcagagctcaggctcaggtattgcttaagaggccccaggtggctgtaatgtgcagccagggttgaaggccagggcaccacatcacactgcctctatctttgacctcaaataaaccacgttgggcatttctggagctgagtgttgtttgggggcttgccctgcagggtggcatgcataatccctttttactgcgagcgctgatctctgagggctggtacacagaacctcgacaccctgacagtgggtgcacctacggagcaaaagggggaaaacaaacacacacggaatgtgctcaacttgtttgacatggctagtatattttatgttgggtcaaagaaatgcctacaggtaatttaaaatccagaaggcatattcaaaataacagccccaactgttcagcacagggtatgatgtacccaggaaacaagtcttgtctcatgttgcttaaacaattgtttataaacagtgtgattaatttatttctggcttttcttctagtagaggagccctgcatcccttgtttcaggagaagtgtttagaacatggagatttctattgactcatttcttaagaaattcttatcaggaagctgagaaaataactggagacctggaggaagatgttttaccaagatatgaatgatgctatgcaaatacttatgataacaatgtagcagtttccattgattgagtgctttctgtgtaataggaactggcatatccctgaacggatgttatcaatttaaccttaacaaaagccccatgaaatgggttctaatattatgtccattttacagatgaagaaaaaagcttggagatgtttggtcaaacacttaaggtcatattgacactaaatggtagatctcagacaggactgaaacccaggtgggccagattccagcacctgcagccatggcactgtgctgggtgggatggccctttgattacataccagtggtcgccttccaccaagccagaagctggaacttttcctgaacagtaagtctcaatggaagggataatgtttcagcctcaacacattagcctagaagtgggcatcctggaaagaagcttaggccacccgattaacacatttctgaaaagcaggtacattttgcaaaaagcactaacttttctaatcctgagtatttgatgagaccattggtgttcttttaaagtttttattcttgctattttcctggtgtgatctcaacaagaacagtgttttctgaaagattacttcacgttgtgatggggaccaaggccggctttgtgggtatgtgaccagtgcatatacaggaatccagacctaggtttaatgctctgctgttgccatcttgaaattcttaataactttattcttgaatttgtgaatattagtagaatgtgtatgtatcaaaaagtgaaataaaagcagttgagttagttttctgcactactctggtaaaaacaaaatacttaagtgtgtatgaactacctaccatgatctgtataattttgataattccacatacaagttaaatgctcttttatttacattcgaagttggcattgcacaatgtaaaagtgaatgataaattgattcatgtatcaacgataaatgaatgataaatttattcatgtatcaatgatgaatgataaattggtgctaataattttaaaaatttcttaactaaaacaaaggtaattagcaagtaaaaaaacaccaagacaagttgggagggagtgaatgaaaaaaaaagaaaggctttaaattttaatacctttaagaacactttttcctgccattcgaacaagttgcttgtatttttattttgcatttggccagcaaattatgtagtctgccctggtaggggttaatggagacaaaggaaggtcatcctcattcatctttgatttacccagattaagtctgttttggctcaaaacaatgaggtaaacgttgaatacaattgtaacctctaaagttcaaggtaaaggccataagatggcttttaaatgtcaaacaactttccgacattagcagaaacctctgaggatccaaagtaagtcaactctaaatcatttcctcatccatgggtaaaaatcttccaattcacagtgtgaaaacctttatttaaaaggggaattctgatgtgctgaagtcaaaatttaacaagtggtttcactgtgaacaaacaactgtttcagctgtggaattaatacatattttttaaagtggtggaagcttattctggcatgcacagtccagatgaacagtgaagtataagaacatgtgtttatttaacaaatatattaattgagcaatttctgcaccatggggaaattttagggaataaaattgacatggtacctgccctcatagactggcagtctggctggacagacagataataaacaagttaacaacaacaaaaaatatatggtaagttatcatagttgttatttataaaggaaataacaaggggctgtaacccggattattttttcttctgctgtgttttgcctctcactcattctctttgcctcttactcattttcactttttttctatgtttacattttctccgctattgatttcatatagaaatctgaatacactaatgtcgtacatggaaatgttaaagatttgtatagcacatccaatagaattggttgattagtttttgagcgttgctgataacaagagttagtgagtctgagagaaagttgtattgcctccttccagagagaaggcacatatagctctggagatgcttggtcaaacaaactttttacaatcatgagaattttctacatttatatctaagccaagagccactcaccacatgtggctaatgaacacttggaatataactagtgtgattaaaaaactgagtttttagttgtgtttcattttggttaaattaaaatttaaatagtcatgtgtggctagtggttaccctattggacaacacagatctagagatctcaagtcaatggacagcctgtttatcacagggattaacagtggatgatggaggatgatagccaagaaccaagttagataggcaataagttctttggaaagtgcttgcaaaagttctcagacttctcaggaattgggtaagtgtcctaggtttgagtaagatctgaacctggaaactggggaagaatctaagcctggtgagagagcagggaaacccatctccaaagctaaagtttgcatacaatctctgctgtgttgcctaatttataaatagtctgttcttaaaattatcactctcatgtggacagagctttgcagttagcaaagcaaattcacatcaattattttgttattttgacaatgaaggagtgaaataggaggatggggattatctaccaaagaagtcaaaactggaatctttagcagattttgtacagggaaattctctgctctaaggttacagtcagcaccgctagtcccttttctgccctcagttatctgaactaataatcatggagacagttaaacagaagagagggtaagccagtagactagagacagagcattttttcatcctcttgtcaagtcctacaatgttccaggcactttactaggctctgaggatacaacaggctgcaagactggcaaggtccttggtatttgtccaatggacaaagaaccccattagcaagtccccaaagaacctcaaatcaaattaatatgacttgttcctaccacctgccaccttgttgtggtcacaagactatgtagtcataccatgtcttccaagtggggagagaggcttaaagcatgactgaactgaagcaggcttccaaaaggaattttctgataattatattttaccagttaagttagataaagttattatcttttaagagattctggcctgggtgcggtggctcaagcctgtaatcccagcaccttgggaggctgaggcgggtgaatcacgaggtcaggagttcgagaccaggctggccaacatggggaaaccctgtctctattaaaaatacaaaaaattagccgggtttggtggctggcgcctgtaaccagctacttgggaggctgaggcaagggaatcgcttgaactcaggaggcggaggttgcagtaagccgaaatcgcgccactgcactccagcctgggtgacagtgtgagactccgcctcaaaaaaaattttataagaacctaataattctaatatgtgtcataacttgaagccctgaatcacaatcaatgctagcacaccttggacaattctgatccacaaaagtctaggaccatggctctaaaccgttaatatgcataacagtcatgttagtaaaaatgtcatttacaagccctgcactgattcaatgagtgggacccaggaatctgtgtttttactaagctgccagatgattctaatgtgagtgatctgcagatcatgctttgatggaaaaacgatcaagaaaaataaaaataaaagttgcaaataagggaatatatttgcactccccaaatttccaacaataatatatacacagagagcgctaaaagaaattgggatatttattaagaaaaacaaaagcctcagaaagaacctatggccaaatatgcctaaagtgctgtcctaacgtaaaagatgtaacctgtttttctctttctcaaggcagaacgagggttagtgagtagaagccacagggatggaaacgtcaactcaatatcaggaaaacctttcaagctctagagctgcccaaactttgagcagactgctcagatgggaagcttctctcattgcaggagttcaagcagagatgggatgcccatcaccagtgatgacaaggaaactgttgatttgttagcaattccctcagctcctgataaaccttgtgtacacctgcagtgatgttcaccgtactgtaatatcttgctagtgtatcccttgcttcagtggttcatgtttatatctgctgcatgctgccttctgcattaaatgctcaatacatagttcccgtgaatcaaacttcagaacctaataaattgagttccagaatctgcaaacctggagttctgatgggcttcctataacctcaaaaggaaaatctgggttttacagccacctcttctactatccacaatgaacctttagcaatttatctgctcttcttcagtaaagttttaaagtttccttcaataaaggtcttatacttttcaaaaaaaaccattttttttaaggaactttagttattgcttctgtggatggtgttttatttttatttttatttttattttgagacagggtctggctctgtcacccaagctggagtggagtgcagtggcacagtagtatttttcttaattcacatactaattggttttttctcatgtgtaggaaagtcactgaggattgagtgttatctcatatcgtccatccttatgaaatatcttattacttttcacagtttacagtggattttcctggaagatgattataatagatcatacagatggttaataaataatggaagctttgctctctttttccagtttttttatatttcttctttctgttctttggattttgtatgtacaatgttgaccacaagagatgataagacatcattgtcttattcctcactttagtgggaatgcagctaatgttttatcattaggttatttcttttcttctctgccactatgtgcactatgggtttcctagagtgggaaaagtgatttctataaaaccaagacagatattggtgggtggggaaaacacagctgcagaacaagattaaggatgagacaaggacaaagaggctggctccaaattcactgagaatctgagtttgcacatttgatgaacctcttagaattccacacactggcattatgcctctttctaatacatgcatgcagacaaattaaaattgccctcaaaatatttatatgaaaataattcatgtttagaagctatatttagaagactatgtaacctatatgtctagacaaatggtgtcatcattcaaccaaatgctgtcttcacttctattttgatcacgggttgcatatttccaaagacacttcttgtccaacagaaaatagtcaaacacaattgcagacatctctgctactgtgtacactagttagtacaattttagcaatcaaaaccctctaagaatgtctttcaaaagcatattttatttcattggctacccatttgcttatttaataataaaatttcatgtaagtaaaagggccataaggataggaccaagcttgggagacctatgattctaaaccattgaggccaggcttggctgtttctaattcaacttggaaaagtaaaattccattttgtcaaaaagactttaaaggaaggaggccccacaatatcagagtgttgtcatgaactgggtcttctcaatgtgaatcttgtagactaagttctctataccttttaggatctcagggaagatttaacaaacaaaacctaattttcaattttgagtattttaatccttcataaatctgaagagaatcaggaacacctttcatcagcaaaaatgatcaatcaattgatcatctactgttatacagatactatgttagagactatacagttcctagagaagaggaagccatagtttctcccctcaaggaatacttgatataacaggaattaaataaggaattgtatactctaaagcagtatgaatgtcatgagaaatagtgctgtaaacaggccactgctatccagcagaaatagagaacaaatgcccaagttgaagaaatgtgaaaaaggtatgttctgaaaaccataggaagaagagtttgatcccaatcctgagatgaacttcttttaaattgattctttgtttgaataatcaacgggtacccaaagatagaagtcaacaggtggttaataagaataggtccatctgatctaaacttacttcctttaaaaaaaatgagtatgaaaatgccttcatttgaagaaggaatgttttccatggtttgtaggcaaactagagaaatatgaacaaaatggtagagttgatagattaaaaaatgactcatcaactttatccaaaaagtcaaggtgatcatggaaagttgtaatcttaactctgactctaagtggctggacaaggctgagttttgaagtcagaaacagttgggtctgaattccagctttgttgtttactacttgtgtgactttgggcatgttacttaccctaacactcaattttctcatctttaaaatgacaatgatcataataccttacttctttgagttataaaaattagatgcaaatgatggacttagggctctcaaatatagtaacaaacattcttttctggaataatgttaggtttcataatcataatcattattattaataaaatggaaggaggtctctagtgacctgtccagtactttttaaatgtttgccttgggtgaggaaaatgaaggtatgcctataaaattgtaaattttatacatgcagctagaaatttatcttacatttttatgatttatattttgcccccatggttgaattttacagttatttttatttagctccatctcttcaataccagctgattggtttctttttaaatccttaagcctgccctctaatatgttagttctccctcagagccacagaaaaagtgtcttgatttagtaacatgatacaagattattccatttatggagatagggatgactcagaaaacttgtggttggagggtgagatagtttggatgttcatccccttcaaatcccatgttgaagtgtaatctccagagttggaggttgggcctagtgtgaggtgtctgggttatgggggtggaggccacatgaatggcttggtgccctccttgcagtaacaagcgaattgtcactctactagttattgtgagatctggttgttaaaaagagtctagcatctccctcctctctttctctctcttgctccccttcttgccttgagacatgtatgaaccccccttcatcttctgccatgagtaaaagcttcctgaggcctcaccagaagctgagccaatgctgatgccatgctcgtacagcctgtagagccattagacaaataaacctcttttccttgtaaattacccagcctcaagtattcatttatagcaacacaaaatgggccaatacagggggtaagtgtatagagctaagaattctgttttggttgcatcacatttcatttaagatttccaagagacacctatatggggttgtcaaggaagcaaattggatcttctctctggatctcagaggagtgttatgccctggagatattgatcaaagagtgaggtgacagcatgaagactgtatttaaagttatagatggtgaatgtataaagtaagagcatagtctgagaagagtatcaagagccaagtcctgaagaactccaacagtttgaggccagagagaggggaagagcctctaaaagagactgggaaaaagttgctggtgagttagcaagaaaaccaggaaagtatggtgttaaggaaaattaaggtaggaagtattttaagaaggaagctaggccaactctaagaggtcaagtaaggataccttttcaaaatttgaaacttctgtaagtcaaaagttaaccaaagttaaaaagcaagcaggagatggggaggtgtatttgccaattctatgacaccagatgaatatacagaatataacaaagaacacccagaaattaataagaaaaatacaacaaagttgtcacaaaaagggccaaacacataaagatgcactttatataagaataaatataaatagtatataactaatttaaaagaggttcaatctgacaaaccgctaagtaatgcaaattaaatgatacagcaattacttttacactaacctaatattttttaattaagaaaatatgaaagattgataatattcaatgttggtgaggagaactcacactcacagatgagaatgcaaattgttacagtgtgttaggatgccaatattatagtaaacataaacattttaaatgagcatacctgtcaatacagcaatttcatttttggtagctatctgaaagaaatactagcacatgcaccaagaaatgtgttcaagggcattacaaacagtacagtttgcaatgacaaataattggaaatacttacatgcccactaacagcaaataattaaataaattttaatatgtatttttagtacagaagattatggaacagctgaaacaagtgagttagagctatattttccccagtgaaaagatcttcaaaatgtattgttaaaggataaaaaaacaagatgtagaaaagtacatataaaatgatcccatttacatagagtgagaaaaagttatatttctatggtttttatgaatgtctgtaaatacattgaaatgatcagcagactaatgttaactattgcctctgggaacaggggtaggattagcaggataaaagctgatactgattttcattgttttggttttatatttcttcaattcatctgaatttgctaatgatctacttgtgggatttttaagaaaaatgcaaaaattgtcttagttgtgttaagttaaaacaattgatcagaagaattaattttagaatttgttaattcatcaagagtttaagttcctattacatatcagacaatatgtagagtatttggtatacggcagtgaataaaataggcagaattcctgtcctttgtaagatttaacctctagcagatgcaggtttcaactattctgtataggctacccttactcttataagattctccactcccacagtaaaacatcacagaccaacttcctgcacttttcatgaactcatgaagaaacttatggaagactgtaatcccagcactttgggaggctgaggtgggtggatcacagggtcaggagatcgagaccatcctggctaacatggtgaaaccctgtctctactaaaaatacaaaaaaattagccaggcatggtggcaggtgcctgtagtcccagctactggggaggatgaggaaagagaatggcgtgaacctgggaggcagagcttgcagtgagcccagatcacaccattgcactccagcctgggcgacagagcgaaactctgtctcaaaaagaaaaaaaaaaaaaagactgaacaaaaagcagcagaaaactctgcagacttaaatgtccctgtctgacaactttgaagagagtagtggttctcctagcacagagtttgagatctgagaatggacagactgcctcctcaagtgggtccctgacccccaagtagcctaactgggaggcacctccaagtgggggcagactgatacctcacacagccagttacctctcagagatgaagcttccagaggaacgatcaggcagcaacatttgctgttcagcaatactcgctattctgcagcctctgctgctgatacccaggctaacaggttctggagtgttaactccagcaaactccaacagaccagcatctgaaggtcctgactgttagaaggaaaactgaaaaacagaaaggacatccacaccaaaaccccatctgtacgtcactatgatcaaagacaaaggtagataaaaccacaaagatggggaaaaaacagagcagaaaagccgaaagttctaaaaatcagagcacctctccccctacaaaggagtgcagctcctcaccagaaatggaacaaaactggatggagaatgactttgacaagttgagagaaggcctcagatgatcaaacttctctgagctaaaggagaagtttaaacccatcgcaaagaagctaaaaaccttgcagaaagattagaccaatggctaactagaataaccagtgtggagtagtccttaaatgacctaatggagctgaaaaccaaggcacgagaactacgtgacaaatgcacaagcctcagtagccgattcgatcaactggaagaaagggtatcagtgattgaagatcaaatgaatgaaatgaagtgagaagagaagtttagagacaaagagtaaaaacaaacaaacaaagcctccaaggaatatgggactatgggaaaagaccaaatctacgtctgattggtgtacctgaaagtgacggggagaatggaaccaagttggaaaacactctgcaggatattatccaggagaacttccccaacctagcaaggcaggccaacatttgaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaagggaagcccatcagactaacaatggatctctccgcagaaactctacaagccagaagagggtgggggccaatattcaacattcttagagaaaagaattttcaacccagaatttcatatccagccaaactaagcttcataagtgaaggagaaataaaatactttacagacaagcaaatgctgagagattttgtcaccaccaggccagccctaaaagagctccttaaggaagcactaaacatggaaaggaacaatcagtaccagccactgcaaaaacatgccaaattgtaaagactatcaaggctaggaagaaactgcatcaactaacgagcaaaataaccagctaacatcataatgacaggatcaaattcacacataacaatattaaccttaaatgtaaatcggctaaatgcgccaattaaaagacacagactggcaaattggataaagagtcaagacccatcagtgtgcggtgttcaggagacccatctcacatgcagagacacacataggctcaaaataaagggatggaggaagatctaccaagcaactggaaaacaaaaaaaaggcagggcttgcaatcctagtctctgataaaacaaactttaaaccaacaaagatcaaaagagacaaagaaggccattaaataatggtaaagggatcaattcaacaaggagagctaactatcctaaatagatatgcacccaatacaggcggacccagattcaaaaagcaagtccttagagacctacaaagagacttagattcccacacaataataatgggagactttaacaccccactgtcaacattagacagatcaatgagacagaaagttaacaaggatatccaagaattaaactcagctctgcatcaagcagacctaatagacgtctacagaactctccaccccaaatcaacagaatatacattcgtctcagcaccacatcacacttattccaaaattgtccacatagttggaagtaaaacactcttcagcaaacgtaaaagaaagaaattataacaaactgtctctcagaccacagtgcaatcaaactagaactcaggattaagaaacccactcaaaactgctcaactgcatggaaacagaacaacctgctcctgaatgactactgggtacataacgaaatgaaggcagaaataaagatattctttgaaaccagtgagaacaaagacatgacataccagaatctctgggacacatttaaagcagtgtgtagagggaaatttatagcactaaatgcccacaagagaaagcaggaaagatctaaaattgacaccctaacatcacaattaaaagaactagagcagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgattaaggggatatcactaccgatcccacagaaatacaaactaccatcagagaatactataaacacctctacgcaaataaactagaaaacctacaagaaatggataaattcctggacacatacaccctcccaagactaaaccaggaagaagttgaatccctggatagaccaataacaggttctgaaattgaggcagtaattaatagcctaccaaccaaaaaaatccaggatcagatggattcacagtcgaattctaccagaggtacaaggaggagctggtaccattccaatatccctgatgaacactgatgcaaaaatcctcaataaaatactggcaaaccaaatccagcagcacatcaaaaagcttatccaccataatcaagtgggcttcatccctgggatgcaaggctggttcaacatatgcaaatcaataaacgtaatccagcatataaacagaaccaaagacaaaaaccacatgattatctcaatagatgcagaaaaggcctttgacaaaattcaacagcccttcatggtaaaaactctcaataagttaggtattgatgggacatatatcaaaataataagagctatttatgacaaacccacagccaatatcacactgaatgggcaaaaactggaagcattccctttgaaaactggcacaagacaggaatgccctctctcaccactcctattcaacatagtgttggaagttctggccagggcaatcaggcaggagaaagaaataaagggtattcaattaggaaaagaggaagtcaaattgtccctgtttgcagatgacatgactgtatatttagaaaaccccatcgtctcagcccaaaatctccttaagctgataggcaacttcagcaaagtctcaggatacaaaatcaatgtgcaaaaatcacaagcattcttatacaccaataacagacaaacagagggccaaatcatgagtgaactcccaatcacaattgcttcaaagagaataaaatacctaggaatccaactcacaagggatgtgaaggacctcttcaaggagaactacaaaccactgctcaacgaaataaaagaggacacaaacaaatggaaggacattccatgctcatggataggaagaatcaatatcgcgaaaatggccatactgcccaaggtaatttataaattcaatgccatccccatcaagctaccaatgactttctccagagaattggaaaaaactactttaaaattcatatggaaccaaaaaagagcccgcattgccaagtcaaccctaagccaaaagaacaaagctggaggcatcatgctacctgacttcaaactatactacaaggctacagtcagcaaaacagcatggtactgggactaaaacagagatatagactaatggaatacaacagagccctcagaaataataccacacatctacaaccatctgatctttgacaaacctgacaaaaacaagaaatgcggaaaggattccctatataataaatggtgctgggaaaactggctagccataggtagaaagctgaaactggatccctttcttacaccttataaaaaattaattcaagatggattaaagacttaaatgtcagacctaaaaccataaaaaccctagaagaaaacctgggcaataccattcgggacataggaatgggcaaggactacatgtctaaaacaccaaaaacaacggcaacagaagctaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaactcaaacaaatttacaagaaaaaaacaaacaaccccatcaacaagtgggtgaaggatatgaacagacacttctcaaaagaagacatttatgcagcaaacaggcacatgaaaaaatgctcatcatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagacagtgtggcgattcctcaaggatctagaactagaaataccatttgacccagccatcctgttactgggtatatacccaaaggactataaatcatgctgctataaagacacatgcacacgtatgtttattgcggcactattcacaatagcaaacacttggaaccaacccaaatgtccatcaatgatagacaggattaagaaaatgtggcacatatgcaccatggaatactatgcagccataaaaaaggatgagttcacgtcctttgtagggacatggatgaagctggaaaccatcattctcagcaaactatcgcaaggagaaaaaaccaaacgccgcatattctctctcataggtgggaattgaacaataagaacatttggacacaggaaggggaacatcacactctggggcctgtcgtggggtggggggaggggggagggataacattaggagatatacctaatgtaaatgacgagttaatgggtgcagcacaccaacatggcacatgtatacatatgtaagaaacctgcacgttgtggacatgtaccctagaacttaaagtataataaaaaaataaataaaataaaatggtaattgtactcataccatataagtttcttcaaaaaaaaaaaagaaatttatggaagaaaatatggagtgtacatccatatgccatctctaaattgtctctttgctttacaatgatcctgcagattaccagacgcagcaggattttaacaatacatcttatttagtaaaataggctttcttgggctgccctggaaactcccaaactctctatgaaaaaaaccatcaactgctaaacaactgacttagcaaatgtattaccagagcatacgctgtttgtaagttgtcaacagcctgtacttaggcaactgctagattaaatagctaaaaactatttggcacccacacagaagttcttgtacacacactttatggttgaattctttctatgacactcctgaaggcataataattaagagagaatgtcggtttctaggagtatcctttggggtctttccaccagctgaaaccacaacaccatgctaggctttagctacaaatctgcctacacttgtagcaaaaaatggaattcatgctctgagcagcctctgaggcacaggatttatattttatagcaattcttatttttcttttcttcttttcttacacatgcaaatgaaaatatcccccaattttcagccgccagaacagctgaatactaatcatcatcagaaaaattaaatgcttgtttcaaagaaggaactactccttagaaattcctgcgcatctcagggcaaagaaaaaaatgtcactggcaatcctgttttgctacaggatgaatgtatttatcacacatagctttgcatagctgagaacaattctagcccagggtgaccagaaaagtctcagggtttggaaagaggtaccataactagacactgaacatttaactccaaagtcacttccacctccatccacttatgtgaccttggggaaaaaaaatcgctggacctgtcggtattctcttatatttcatttccttccttgtactgttctatctgcctgaaatggcttccctgccttctcctccatgtctcaaattcttaggaaatactgttctgtgttctgtaaagccttccctgagcttcttaagccaaatcagcttcctttcctttctaccccaattctagattgcccatacatccattatatcacatggtattactgttgtatatttattatggtatttattttagtttatcatgttatttatggccatattaggttctcaggcactacgttattactattggtcctaatattaaataaaacttctagtaccattgtgagtgcttactgtatgtcatgccctatatgaatatattatctctactcatcagaaaacacacatgagatgagaattaacattctcatctgttttaaaggtgaggaaagtaaaaccaagagagagtatgcagatggctagtaggagcaccgagaatcaagacaaaacctattttactttaaaatccatgcttttaaccactactctaaagtaacacctttaaataataatagataacatttactaaatacttgttaagtgtcaggctctgtaccgtgcactccacatatactagctaatttgattctcataaaaactctgtgatgtagatatagtgattattatcttaagtttttaaaaaatgaaattgaggttaataatgtttaaacgacctgcccaaggtcacagaactatggggacttgattagaattcaagtcaatctccctccagagcctgagttcttaaccattgctgtattccatgaccagatagtagaatcttttataatctttgcaaactctatgcaggtttcagggataacccctttggaaacagaaaactggagcattaccccttctgagtaatacaaatcaaccaaatcaatgaactcccttagtatactcaccttagtacatgtgtggatccattaatggttgtggttgaacaagggacagtctggcccagaatggaaggtcttcggtagcgctcatcatcacagcagaggatgatgaggaaggcacgtctaaaagacttattcaagaaggcgtagagaaaagggttcaacccggaattgatatagccgagccagaggaaagcagtccacacctgcccagggacagtgtagtctatgaaaggatccacaatattggtgacaaagaatggtgcccagcagaggcagaagcaacccatgatgatgcacagggtcttggctgctttggtctctgtcctcatgcgatgagtgctatgctggtctgccgactgaggcctgctctcggaggaggctcctgcccgttgtaacatctggatctgatgggcatgctccttagctgtgacatagatgcggtaataggccagcaccatgaggagaaatgggatgtagaaggccaccacagagcaggtgatggcgtagggcttgttgaccatgaagacacagtacgtagagttagagttctggttgaacttcctcttttctatctgagagttggagggagagaggaaatgaggaaaggaggtaaaaaggaaagaaaaagtgaaaaagaagtgggaaaaatggggaagagtgtgagaaaagaaaaagggaaaaggaagaaagtggaggattggaagataaaaagaaggggaagagaacaaggaaagaaaatgggagaataaaagagtaaaggggaaaggaaagaaaagaaagtttatcagcaaagctttggttttcttataagcctacaatacaaagaaccttgatgacagaaaaggaacatgatcatatcccagggcccagagaacttatctgtacaagaggaactgaaggctccaggacagaagagaaataaaatagagacagaatcatttattacatttacccaaccagaagtgaaattctgcctctgttctcccttccctgtctgcttgcacataacagatcagtctcttaacagaatgtctgcagatcagtaacattagagtcacctgcagtacatattataagtgcagattcctgcccactccctgctgccacccctccactctcatccctgaaagatctactaattctaaatctctgggcaatgaagctcagatatatgcattttaagcaagttttttccaataactctaaagctcattaatatttgagaaccattgctctatactgtgctaaacttagctctttgggggatgccatggggcacttttctagagtcatttctctacgtattgagttccctgatgaaggtttgtctcatttagataacacagagtaacacagagtaacagcctgtgttatagtgtaacagcttgtgttttagtgtaacagccaagaggggccttagggcttgggggaaagaaagggtagatattttaatggaagaaaagaatataaagattgggtagggcaaggtcatgagggactttggaacccaaccagagttagaacctagacaacactcaatgcttcaacttactctcctcccagtctctcctgaacccactccatttaggtgttcaccctaatcactccattgaaaatgctctggtcaaggctatcaatgacctctgtgttgccattcctccttttaaatgagccatctacacctttgacatagctgaaccttccatccttcttcttttttcgaatattttattgaaccaaaatacgtataaagtacataaagtgtatatacagatgaatcaattattacatagtaaatatgcctgtgtaattattattcaaatcaaactatagaatattatcaacaacccagcagcctcccaaatgccttctcctagtcattaatatgcccaaacatagccactcatctacatcatcataatgtaattttatttgttttccaactaagtatcaatataataataaaacacacaatctgtatcttctttaatattgtatcactcacattattgcatgtacaggcagtttattctttttcattgtagtataatattgcattataggaataaactacaatattacatattccaatattgacagacatttgagtcatttttgggtttgtgctattttgcataaaactgttatgaatattcttgtggaagtttgtgtgtgtgtgtgtgtgtgtgtgtgtgtgtgtgtgtgtattttcatctctcttaggtatatacccaggactgaaattgctgtatcatagcttgggtatatacagccaaacagttcccaaagggactgtatcaatttatatttccaccacgagagcaggagagttccagttactccacatgctcgccaacatttggaatttattgtcagtatgtagtggtatctcattgtggatttgttgatgatgttggtaaagtttatttgattacataagtaaaatactccatgtgtttttgactctttccattggtttagattaggatttgtcttatgttttgttactgaaaagtgtcctgggcatccatatccacataattatagtacattgacatcactccttttggaaagcatgtgagactgagtttctgcatctgtttcctgattagcactctggttccttcaatgggacgagagcattgccttcagaatggtaaaatattgcctagatcttgtcagtcccaattcttgcagctgtatcttcagtttcaatctgagtaagtcacctcaaactctcagtgtgccctggtttctgcatctttgttccctgtttactatgtcctggctatttcattgtaattttgaattaaatccaataaacttgaatcaaatctaagtttattacaacccttcagtttcttattgcagttttactgtgcatctcctgagaactaataatgttaatcactgttttgccctttcgatatcctgtcttttgaattgattattcaggtattttcccattttaaaaattaagttgtaactctctttcttattgatttttaatataatagttcttttatattctagatgtcttttgtcagatttatgtgttgcacatatatcactctgtggcatggcttttcactctagtatcttgtgatagaaagaagctctgaaagaacctatacttttggttagtacttgtatcttgtttatgaaatctttgtttactcctaagtataaagatactggccgggcgcggtgacttacatctgtaatcccagcaccttgtgaggccgaggtaggcaaatcacttgaggccaggagtttaagaccagcctggccaacacggcaaaacactgtctctataaaaaaatacaaaaattagccaggcgtggtggcaggcacctgaattctagctcctagggtggctgaggcactagaatcgcttgaacccgggaggcagaggttgcagtgagctaagatcacgccactgcactccagcctgggtgacagagtgagactcagtctcaaagatattgtcaagagatgtaaagacattcttttacatgatcagttagcatatctttattgtgttaatttttatgtcttttttttttacagggtcatgctctgtcacccaggctggagtgcagttgtgctcactacaacctctgactcccaggctctagcaattctcccacctcagcctccctagtagctgggactacaggtgtgagccaccacccctagttaatttttaaatattttttgtaaagacagggtttcattgtgtggctcagactggtctcaaactctaggctcaagctatcagcccatctcagcttcccaaagtgctgggattacaggcctgagccactgtgcctgaccagtttttacatttaatgcttctacccaccagaaattagtttttctgtatggtatgatgtacaagatatggatattgaattgacccctgcagcatgtattgaaaggattatcttttcctagttgcactgcagtgtaaacttggtcataaatcaggggactgtatatgcatatggctccacgtttggatttcctatttgttctcttgagttgtctctctctgcatgtactgctttaacttctataacttcatacatcttagacatctagttataaaagtctttgaattgtggtttcttttcttgaagactcttggataatgttttatctcagtatttccatataaaatttaaattaatatctcaatttctataaaaatcttctaggattttgattggaatgagagtaaaatgattaagggaaactgacatctttacaatgttaagtctttgaattaattaacatggtaattccttccctttgtctttttaagtatatttcaataatactttttaattttataattttctttgtgtcttgcacatcttttgttagatttgtttctaagtattttatgcttttactctgttgtaaatggtaccatgttaaaatcctgattcctaattgttgctaatatgtagaacttggtgaggatttttattgtaagctggctatgtattcagcaactttgctaagttagatatcaactaaaattcatctttacattcttttgaattttctccaggaaatactcatatgatctgcaaataatggcagttacatttttttctctttccaatcctaatatcactttctcttgctttattgagcttgatagggcctcccatctaattttgaataaaaatgagagtagttgacaccttgtttcactcccagttttaggggatgagccttcaataatttactaagtatgatatttgctataaattgtatgtcaatgccctctacttggttaaggaaactacattctattcttggtttgatgagatttttaaaaaatcgtgaatgggtattgaattttgtcaaagcatttttggcagtaacaaaatgaacatgtgggttttctcccctttttttattgatgcaatgaattacattgattgcattacaattcctggaatgtcttatttgtactggaccctgtgacacactagtatttttcttaaggattgaaggacatttccaccaactataaacactgcctgctgacaggtcttagtcatcaaccttctctagaaatagctcttgactgaagagaactgcttaacccaatgtcacttacccttcttgggatcaatctgcatccagtgtgaatatacacatgcatgaagatatgaagaatagacacctatatgatatactcacaaacatgctattttattcctgtacatattcagtatcttgttttatagactattataaggttatcatgtatcatcctcttgaattgatatttttatcattatgaaatatttctacctcaagaaatattattttccttaaattttattctatcactaataatagtagagtaacaccaactttccttgacttatcacttgcatagtgtatgtatttctatttttttattttcaatttttctgccactttatatttaatggtcctctcttacaagcagcatatatttgtattttgttttgatgcagtctgacaactttgtcttttagcatctattctttaaataatttaatatttactaaaattgcaaattgatttacatttgtctataatcttactgttatctattaatcttttctgtttcttggttccttgtttccatatttattgcttattttcagaataatacctgtttgtattaacacattacctctctccctattagcttattggatatatattcttttattatctttattttaggggctacaactcattacagtctttttcatacatttgccatttccttggcaatgcaaagatcccaaacagcccatgccccacgcctgccttttatgctattgttttcatgcattttaatcctacatatatttgaaaacccacaagacattaatattattgttattttaatagtcaacgttctcttacactatccacatatttatcatttccagtgctctgcactctgtcctgcattatggtgtttcaatctgggattattttctttttgactgaaaaattcccataaaagtcacaatacaaaaacctgatgtggaaaaattcccttcgtttttgtttgcctgaaaacgtcttaatatcatcttaatgtttaaagcatattttcattgggtatagaattctaagttgtagattttcaacatgtcattccattgtcttctcacttctttcattttattgcatggtcagctgtaagtcttattttccctgttaagtttaatttgtcatttttctctaattacttttgagatttatcaacttgtctttgattttcagcaattttttaaatgaattttctagatatagttttcttctttatttaacctgctggggttttgtagagtttcttgaatctctgactgatggcttttatctttttggaaaattcttaggcactatttctacaaatattacatctgccccattctctctctctgaattcaaatagaatactgattacatggatgttagaacttttttgtattatatatatatgtaacatatatatatatacacatatacatatatgtatggacacacacacatatattctgatatgatacatatatatacatatatatcagaatggtctgtaataaaattttatccatttatctctatgtgcttcaatcaatattttattacaaggttatggtataacatcctcttgaattgatattgttatcattatgaaaaaatgatattacctaaattccagtttactacaggtgttctcagatatgtcaaatctactattaaatttatcattatacttatttatttcagtgtatttattagttgcagtatttccattcaattcccccctctttttttttttttttttttttttttgagactaggtcttgctgtgtcacccaggctggagtgcaatggcacaatctcggctcactgcaacctccacctcatgggttcaagcgattcttctgcctcggtctcctgagtagctgggattaaaggcacattccaccatgcctggctaatttttgtattattagtagagatggggttttaccatattggccaggctggtcttgaactcctgacctcatgatctgcccgccttggcctcccaaagtgctgggattacaggcgtgagccaccgcacctggccaaaaattccctttttttttttgtagatgctccttatctaattactccattatctagattgcctatgagactgtttctcttgtctttctgtgttcatggtttttggccatttagtcttgcttcctacagggtctggtgacttaattaaaggacacacattgtgtataaaaaagtacagttgctctggatggtagtagcctattccagaaataatttaattttcttctggcaagcagatagaatatgaaaagaacacctcaatcatgtttaggttatgtttaatgcattactttcaatggcaaaaaccacaattacttttacacagaccttatatgactcagtaaaggccccaaaggaaatagtagaggtcttctttttctttttgagagtgtagctactaagtcttatttgtcttggttactttccaatctttcaaagaatattttacttaatcttcatattttgtatttaattcagtatgttttatttagctttgatagtcatgcttatgacagttcccgccttatctagaacccaattctctctccttccttataatatgttttaaggcatatttgcttccaagacaattttctctttctttgttttcttcctcactggctgttccttccaactgtcctttactgcccttcgttccttagacctcttctattctgtatctacctgcattcctcaggtgatttcatctagtcatatggatttaaatggcatctaatctttgagaatggtccacttttttttttctttctgatcgggacctcctaggaactgcagaatttgatatcaagctccttactggacatctccaattgcatatctaataggtatctcaaataagtaaaaaagccaagtgtttgactctccacaccctataaacttacacacagtattctcatctcgattgatggttactcactctaatcttctagttgctctgtccaaaattttgggtcatgtttggcttaggttttcctttcacattcctcttctaatttttcaaaaaaaaaaaaaaatcctgttggttaaatcctcaaaatagatccagattctaaattacaatctcgattgttatcactgaggttggagtaccattgtctctcacctgtcagattacttcaatagactcccttacagtctgctttttaacagaaaaaccagaaagattctttaacaatataattcaggtcatgttactcatttgctcaatactctgcaatggcttcccattttcctcatagtaaaagtcaatggtcttaaaataacctgaaaagtcctacacgatctttctcctatatatttttttttacttcctctcctacatttccctccctcatttactctgcaacagccaccctaaccttgatatgttaggaatattctaccatagcactttgcacttgctatttttctggcctggtatattctccaagatatccacaagtacaactccccaacctccttaaagttgtaactgaaacatcaccttctcaataaagcctagtttaacaccctatttaatattacaatctgctatccggttcacctgctttttcatagtacttaccatctcctaacatcctagatatctgcttatttttaatctcctctacttattttcatctcatcacttattgtctgcctctctttgttagaatataaactttacaaggatgtgggtcattgtctatactgttcaataatgtaccctaagcgcctgaattagattctcaaatatggttggggctcgataaataattaattatagagcaaaagaatatgtaaaatctgacaatttctcaccacctcaaattgctatcatcctagtccaagttagcgttagcatcatcacttgccaggataattgtaattccttcccaaaagttttcactattttctgccattccacagtcattctctatagagtagccagaatgattcttttaaaacatagggcaaataatgtcattcctctcacccaaaccctcaaaagcttcttctatcactctgagtagccacagtctgactccaggctacctctctgacctctacttttcttaccaatttcctccttgctcactgctgtctgtaatcttctaggccattccttgaactacccaagcatgctcccactccagggcctttatgattattgcaattttgttccaaaacactttttttcttagtgcttacatgacttacttttcctcttcctgcaggactctgctccagcaatattttattaaggaaggtgaatgtcatgtgtaaatcactcactttttacttgtttttgtgtgtgtttttttaaataaaatgtaacacctgaaatatatcgtactttctcctcactagattttaaatgccatatgaactgaaattttttttaccattaatttctcaattgcctatggaacatagtgggcattcaattatttcttgaatgaataaataaataaatagtgcagccattacgagcttagactttgaagtcgtataattccctttataaaatgaatattaaacatagtaatattgtgttggttagatgatattgaaacatgtgaagaatttagtatattgtctataaatatttaataaatggtagtgatgatggaaagagaaagcagggtctaggtttgggaacataaatgagaaaattattatgtgaaccctttgaatttttaggtggtttctttcccattatgttaacaaccctgcattgggttggtgtggttaccaatttgtaaaatttggggatggattaggacatttctagcaagcttagctttaaaagcacagctgattccattgagcaaaggaagaaagtccctggagtaggtttctgccttgggcatctgtacttgcatgtatgtgtaggtttatatgtgtgggtatatagctggtcatcattaggcatagattccatatttgtgagttaatctactcattagaatttatttgtaacctcctaaatcccccaaatcaatacttgagttgctttcacagtgtttttatggtcatttgtagacatgcatgtgcacaaagcagtggaagcattgtttcctgataggtgtgtttccagctgaagtcaaacaaggcaatgctctatcatcttgtttcacttcaacaagtgtcctttttgctatttgccggcacatattttgcattgtgtgctttttgatggtgatttcatggtttaaaatggaccctaagtgtactgctgaagtgctgtctggtgtttgtaattgcaagaaggctgtgatgtgctttacagagaaaatacatgttttagataagcttcattcaggcatgagttatagtgtcttgtccatgactgcaatgctaacgagtcaacatataaattaaataggtgtttttaagcacaaacacacatcaaacaaggttatgcattgattggctgatgaaaatgttgtgaccagagactcacaggaacctaatcctgtgttttccctggaagcaaagattcagtatttaccaattcagtgtttgcaatgactttatagaatttaattgccgccaacaacatgaccatgtggattgtgctagcttctctctaggcaggttcagtgtgcaaatgagtggacagatatgaatattagccatgttaacaataaacagatgctccatttcccatttaggtgaattagggtccattttaaaccgtgattaaaattaaataggcaatccctttggctcattctaagtgaacaaaaactttctgggttgttttctttagaaattctactcaggaggtagaagtgctgatccctcatcagaagttcccaatgcacagaagcatacacttccaaagatcttctccattagggaataagtttagcatataaattaagagcacagactctggaatccaaagcccgggctcagatacagtccccactacttcctaccaatgactttagtgaataatctccctgatcctctgttcgctgatctataaaatgaggataatgataggatctacttcataatgttgttgtgaagcctaagtgaggttcccaggaataatgattaacagggggcttcatacatacatagtaagtgttcaacattcactggccattattattcttggagtaataataatggttgaaaatttggatttcatttcctccaggaatggtgaaactgacagtttaaaataaattggataggattcaaaaaatgtccatgcagttacacttctaattcactcttctgcctccggcatttctttcagaatcctaaggaatacttgttctgacataccgcatgaaaatcctggcccaggccttggtttagactcctttccttgaaaaagaacaaggcaggactaagggctaagaatgcggtgaaaagaggaaagggcagctccctgtcttgagggtcctgttgctcttaatctctcctctccactccacttcccacatctcgatgtatccggggaccacttctacagcaagtgcctgacaacttccttatggaatatatatccctgctaaagaatccagatcatagattttgatcttcattgtaagtttagtatgtcaaagctggaggactcttaaaggttagtatctagacagaatgagatggttaattttatgtgttaacttgaccaggcatggggtacctacacatttagtcaagcattattctgggtgtgtcttcgaggaaatttttggatgagattaacatttgaatcagtagactgcctttcccaatgcaggtgaacctcatgcaatccattgaaggcttgaataggagggaactcatgctgccttactgccttcaagctgtgatatcagtttttcctgcctttggactcaaactaaaacattgactctcctgggctctagtgtgccggcatttggacaggaactacactattggctctcctgggagtctagcttgctgactgtagatcttgttactggtaaacatccataatcacatgaaccaattccttacagtatccctttctctctctctacacaaacacacacacccattagttatgtttatctggagaaccaatacacagggatcggaataatgcctggcatatgttgcatgccctcctagatccctggtagaccttcttctccattgagaaccaatggatcttctcatcacagtgcttcaggaaatgagacagttcagagctgggctcagggcttagttctctcaacttctagcctggagctgtcttcattccccagcagcctctacccacatgacatattttcttcagctccatgtcagctgatacagtttggctgtgtccccacccaaatctcatcttgaactgtagctcctcccataattctcacttgttataggagggacctggtgggagataactgaattatgggggtggtttcccccatacttttctcgtggtagtgaatatgtctcatgagatctgatggttttataaaggggaaacccccttcgcttggctcccattctctcttgcctgcagccacgtaagatgtgccttttgcctcctgccatgattgtgaggcctccccaggcatgtggaactgtgagtccattaagcctccttttctttataaattacccaatctggggtttgtctttatcagcagtgtaaaaatggactagtacatcagccttatagactctccacataaaatggaataaagaccttttggggcaaatgacatgcctcaggcatgtctaagcaaagtctaagctttgaatatttgttcgcttatctacaagctgtgtgacattgggcatgttacttaaccttaacctacataagcttgtgagcctgggttttctcatctgagaaatgggggaaataactatactttccccataatgaggttttcaagattatatataaagtatttagcatactctctggcatacaggcatgttaaagaaaaaaattattcatgacatttgttaaagcagtaaagcagactttattcaggactatcaacataggttatagggactactgtgatggggttttgtagtagaagagagagattgaaatgcaacaagggaaagtggaaatttatagccaaacagcatggtgagtgggggttagtggatggaaaattaccaatagaaaacatcaggagtaagagaggattctggctaaacaaacctagcagggctcttgctgaagacaggccaaggtgatcatacatcacctgggagatggtggagggtgaagaacctaatcaaatatcaagggtgggggattctggctataccaacttagcaagattcttgctaaaattgggtgatgcaaaaacagacatagaagtccaaaagtcaagacctagatgggacaaggattcagaaaagtctaactaaagttgggttaaggagaggagttttgtcagtaagcattcaaaagtgttagctttaaaaaaaaaaattatcacccagaccactatcagattcttagaatactcaatctaatattatttattcatttaggaaccccatgcaaagttgatcagacagtaaaccagtgaggtctgtgtggatactcaccaaatcaattatgccaatgttattccagccttgcattatagggagaaaagaaataaacgtggggatgacccagcagcctcccagcattaatgcgatgcgcagaggggtcatcttgttcctatagaccaaaggctggcagcagatggcgtaatacctggagagagaatagagggcagagcataggcatgggcaaggaggaatgggagggagagaaaagagaatatatgagagagaaaaggggaggaagaggggatggagcaagggatagagaacagcaaacattgaggagaagagtcggaggggaagcagagaataaaaataaggaaataaaagaaagaatacagggtaaaaagaggagagcaagtggcagaggaagggaaaaagaaggaagagagagaaaagaacagaggaaaggaaaagtgattatataatacaacatgatatactggcctgtgagtttctgttaatataaatattaatatatactttggatcacatctgagaatcattgcctgcagttggccccacagtcctctccatctcccaatatctggaggagctccacacacaccagaaggtcttttctatttctggcactgttccaacactatcccgatgcctgtgcattgaggagcctctgcccagccctctgggcctcagtatccaggcaactgtaatctatttgattacaacttgaggtgacccaggcatagctctacatctgggctctaaccactgtgtctcagatttgtccccttacccttgatcacctgcctacatggaagtggagctctaagtccgtgtttttttttttgaattgtggttcaaggattcccctccatccccccatccctgccatgctgaatcaaactcacctgaggaagcctttttaaaatgcagatcccaaggatctcctgaatcagagcctgttggtgaacaacctggagcttgcatgttgacaagtgtgagttattactaagtgtgagttattgttaaggatactcagtttcctccttccaaacacgtacacttcttggcatccttacggctggataggaccaagggactagtcctgaccaatgaatcatgaacagaattgacatgcatcacttctgggacaaaccatttaactgtttctgggatactaagaatgtaaaattttgaatatttcctgctccatcatttcctgtctactggatgagaccaccccacttccatttattagagtctgacctctctcatgggacacagtgctcactatcttttgattccatgttctgcctatgatactaactttcttcctgcctccagaaagaggtacaatctgcccattcaacagtctggcctctaacttctagaccgttcctgcatgttactctggccttggagatcacctcttccatgcccaggcatggcatggaatttcacaacaggcagaatgctacagtagatctatcattcatttctctttgggagagtacaaaatagaaatgcaaaaagagcctggaggctgtctattctttaaggttttataccatttaatgatgaaccaccctcatacacccctcattttatgcagttcactttgttaatttttcccacctcttcttttcttttcttaattcaaagcctaactaacaaaacaatggctatattctttgaagaggtggtagtaggatgggttgagagagagggtggaatgaggagagccccgtgttggagcacgaggagcaggtgcctcaggagcagggagaggagaaatacccgctttcctacaaggcactgaggagcagctgacgacattgtgccaaaagctccttgtagctggcaagcttggtggggtgtcctgatctgggccagagtgcaagaaacaacaaatcaaagaatgggagactgtcttgctccgaaaaaccattgtctccattataattctgacatggctgcaaaatcaaactaaagataactcagtcattgaaagaatcatgattagctggattccctccacactgttggcttacaagaaagacaaattatatctgagtagcaaatttttctgaatggtgatattcataatcatcagaggtttattattaacatagaattaatgatgaatttgaagtggatgaaatatactctttttttttcaaattttgtttccttcttgatttcctgttagggggcaagtttctttccatttagcatccttcttcctttctcttgttaatagcacttcaaatccttcgggagttatctctttgctgttgctatagtgctgttgggaaaacaaatgatggggctttgacttttctagcctaggggtgacccgatcagactttctcctaggactcaatgtcctgcagagggatgcaaggtgggcaagtcagcagagggctttttatctcagcagcagccccctggtagggctggggattcattcctgctccttggatcttttgcagcatgctcttacccatcaagtcctcactccttagctctctctttaaataaaccacctcatatatttccaataaattctctttttgcttaagctggtgtcatgggttgaattgtgtccttcctcttccaaaagatatgttgaattcccaactctcagtaaccttggaatgtgaccttatttagacataggattttaaaagaggcaatcaaattaaaatgaggtcttcagggtgatcctgaatccaatgtgactgatgtctttatgaaaagaaaaattttgacacagaaactgatatgcacagtacgaaggtggccatgagaagatggaagattggagtgatgcgtccataagccaaggaacacttaaagttgccagcaaccagcagaagccaggaagaggcaagaaagaatccttcccctacaagttccagagggataatcgccctattgatacctttatttcagacttctagcctttagagcagtgagacaacaagtgtgtattgttctaagccatccagtgtgtggtacctgttatgacagctttagcaaactaatacagttggctaataacaatctcttgcttgcaagaaaagtataccacttcacacagagcagtaaaactggcttgaatgccagatatatctttcatagtatacttaagtaagaatatcttttgtttcattcaatatactttcagatcatagctcaagttttggcatcctttcttctattatcccaaaaaggcaatagagggataaatgaagaatgaattctgccctatctttgttgtgtaatcaatataatttttgaggtttagaatgaggtgccgagatgttgccaagtaaagagcagatttcagaaattttggttggatctctaacgtcacaaaaatccaaaagttcaaaaacacaaggccaaattaagtatcctataggacactgttcaccacaaccaaggtatggaacctacctaagcatttattagtggataaatgagtatagaaaatgtggtatatatatacatgatgggatattattccatcataaaaaaaataaaatcctgtcatttccagcagcatggatggaactggaggacattatgttaagtgaataagccaggcacagaaggacaaatattgcatgttgtccctcatgtgagggagctaagaaaattgatctcatggaggtaaagcataaaatgatggttaccacaggctgggaggggtagtatgtagggggagtatgaagaggggtcagcgaatgcatacaaaaatacaattagatagtgggaataagatctagtgtttgggcagcacaagtgggtaacttgttaacaatcacttattgtatctttcaaaatagctagaataatagatttggaatgctctcaacacaaagaaatgataaatgtttgaggtgatggatatcccaactaccctgatttgatcactacacattgtatgcttgtatcaaaatatcacatgtaccccataagtatgtacaactattatgtacccataaaatttaaaatattttacataaataaataatatcttgcaggacaaaaagtacgtttcagaaagcaggatgtcttacctgagaagattctttgatttccataaatggatgtggatgtttagagggttatgttgggaaaataatagaatttacaagagggctttagaatgtatggttatattggtgctcataacatttttatgaaagcctttctttctaaatctagcttgcccagggctattgccagtttcccttgacataatgatcatcccatgaacaataatattgccctacattctgttgtccaaatgttctatgctttaatttgccttaccctagatttctaggagctgctgctatatagaattaaatagtggtaacaggtttccttttaaaattcaacttaaaggaggatactgtgaatgtagtacacattttaccaatcccttacacattttttaatttgaaacagaatcctgttctgttgcccgggctgaggtgcttatgtgatcttggctcactgcaacctccgcctcccaggctcaattgattcagctgcctagcttcctgagtagctgggaatacaggcgtgcaccaccacacccagctaatttttatatttttagcagggacagggtttcgctatgttggctaggcttgtctcaaattcctggcctcaagtgattcacccgccttagtctcccaaagtgctgtcattacaaacatgagccaccacacctggcccccttacacattttacatatacagtcagttccctggaaaatgcttgccagaagtaaagtgcttgggcaataagcccaactcgaagggtgctaaggtggaatacatccaaacatgcccaaacacagatgtagaaatttgctcttgcaggatctagggtggttaggcaagggtgggaagaatcctttatctccttttttaaaattatcaataagtaaagggggaaaaaggattttattttacttaaatttaaattaggttaggtagattgttagtgacaggtaaggatatgaataagaaaaatactgaattatgtctaggtatatgttttacttgcattttgacctctgcagcttcttcaatgtggtcctctgtcttacagtaaacataatttgatttttgagtgggattgagtatagaacataaggttcttatttggagctcgaattctagcatctacttaactttatgtgctgaagattcacaccaagacctggcacctttgaggcagcagccctaaataagtcacctcatatccttccaatgtctttctgatctttgctttcgagcaaaaaatctagaaaagtaaacatcctctgaaggctggactcaagaatgcaaattaagtaggtgaaaaaaaaatcactgaataaagggattaataaaaattgagttctagtgttaaccgatggtgcttccttaaaattttaatatttgtctgtagataagactagatagaaatctgataacttgacttttatatattgcagttgattttcagttcctatatttggattataatgtccccgttaataacaaaaaggaaactgacctatcatgaactattcctgcaacacataaacaccaccactagacagaattagctaattaaatttgcaagttctttggagggaggtaaggcaaaatgcactggctggtttgataataatagctagtatttatttactgaccaagggctctgctcatttgatctcatttaatccgcacaactattagattggtgcaaaataatcgtggtttttgccatcaagaataatggcaaaaaccacgattattttgcaccaacctaacacttttgagacaggaactgtaaatatatccatttcacagatgaggaaagggaagcacaggagtgttcgaaatttgcccagtctcacaggtggtaagaactgagctggcatctagcccaggcagactcactcaagagccaggacataaacctcctatcatttcactcagctgcctctcccattgaaaagccactttggaaacaatcaaaacatgaacatactgaatctcagaacttgaaggatgctaagaatcatgaaatcctcaagtcctctgatatggtttggctgtgtacccacccaaatctcatcttggattgtggctcccacaattcccgtgtgttgtgggagggaccaagtgggaggtgattgaatcacgggagtgcgtctttcccatgttgttctcatgatggtgactgggtctcacaagatctgatggttttataaaggggaatttccctgcacaatctctcttctctagtctgctgccatgtgagacatggctttcgccttctgccatgattgtgaggcttccccatccacattgaactgtgagtccattgaatctctttcttttgtaaattgcccagtcttgggtatgtctttatcagcagcatgaaaatggactaatacagtaaattggtaccaggagtggggtgctgatgaaaagataaccgaaaatgtggaagtgactttggaactgagtaacaggcagaggttggaatagtatggaggactcagaagaagacaggaagatgtgagaaagtttggaactttcttaagacttgttgaatggctttggccaaaatgctgataatgatatacacagtaaaatccaggctgaggtggtctcagatagagatgagaaacttgctgggaactggagcaaaggtggctcttgttatgatttagcaaagagattggtggcattttacccctgccttagagatttgtggaactttcaactggagagagatgatttcgggtatctgatggaagaaatttccaccaggaagaaatttccaccatcaggaagaaatgttaagcagcaaagcattcaagaggtgactttggtgctgttaaaagcatttagttttataaggaaagcagagcataaaagtttggaaaatttgcagcctgacaataaaatagaaaagaaaatcccattttctgaggagaaattcaagctggctgcagaaacttccataagtaacaagaagctgaatgttaatccccaagacaatggagaaaatgtctccaggccatgttagaggtctacgtggcagctccttctatcacaggcctggaagcctaggagaaaaaatggttttgtgagccagacccagggtccctgtactatgtgcatcctagggaattggtgccgtgtgtcccagctactccaggcatggctgaaaggagccaacatagagctcaggccatagcttcagagggtgcttccatgtggtgttaagcctgcgagtacacagaagtcaagaattaaggtttgggaacctccacctagattacagaggatgtatggaaatgcctggatgcccaggcagaagtttgctgcaaaggcagggccctcatggagaacctctgctagagcactgcagatgggaaaagtggggttggagcccctgtgcagagtccctactggggcaccaactagtagagctgcgagaagagggccagcatccccagaccccagaaccagagatccaccaacagcttgcactgtgcaccttgaaaagctgcagacactcaatgccagcctgtgaaagcagatgggagggaatctgtacttagcaaagccacagcagtggagcttcccaagaccatgggaacctacctcttgcaccagcatgacctggatgtgagacatggattcaaaggagatcattttggagctttaagattttagtgccccactgtatttcagacttgcatggggcctgtagcccctttgttttgctcaatttcttccatttggaatggccatatttacccaatgcctataccctcattttatctagaaactaattaacttgcttttgattttacaggctcataggcagaagggacttgccttgtctcagatgagatgttggactgtggacttttgatttaataccaaaaggagttaagacttttgagggactgttgggaaggtattattggttttaaaatgtgaggacgtgagatttgggagaagccagaggtggaaggatatggtttggctgtgtccccacccaaacctcgtattgcggctcccacagttcccatgtgttgtgggagaaacccggttggaggtggtttaatcatggggtgggtgttccccatgctattctcatgatggtgaatgggtctcaaaagatctgatggttttataaaggggagtttccctgtacaagctctcttctcttgtctgccaccatgtgagatgtgcctttccccttctgccatgattgtgagtcctccctagtcacgtagaattgtgagtccattaaacctctttcttttgcaaattgccaagtcttcagtatgtatttaccagcagtgtgaaaatgggctaatacatcccctctaaaatgaagtgtgtatccaaacccacttaatttttctagggatttggaattcaccaggtcctactgcagtacattctaaacttaagggcatcctaaagttaagaaagtttcctctaaaaatcaattttcggtaacttgtagtttttccctctggcttaatttaaatttctatctaattctttttctgcatagtggttctagtgatatctgaagagagcttttacatccctctgaagtcttattttctgcaggtaaaaaattccctgttgctctcaaccaggggtgactttgctcaccaggggacatttgacaatgtctggagactttgttgttgttgtcacaattgggaaggaaatgctactggcatccagtgggtagaggtcaggaatgctgctcaacgttctacagtgccccaataacaatactggtctatgtcagtagtgctgagattgaggacccctggtttagatgagaggattttcaccaatagcaggagtggagctccttgtcctctgtatgtgctataacatgtcgttatctcttaagagtggggtgccacaaggacagcactatgttctggtgcatcctatatggaccaaaaaccactgcattgccttccactttgctcaccataacttaatatagcttaggggatacccagaagcacaggacacctgtgcccctaaaaaagaaaatgatctaggacaagaggtgggaaaaccgtcccccaactgatgtataagttccatgaggacagcaatgtttgccttgttctgctttgtgtccatgatggctagtacaatgccagatatattgtggatactgacaaactggatttttaaaatgtaataaactctcaatcactaccaagtacaataaattccattaaaatatgttaccaggttttggagatgtgaacaggcatatctagcagagggatggggaaaggctttcttcaatagcggttttttaagtcaaatgttagagactggatcaggatggtggaggagaaagtgtaatctaggtgctgtagacagcatggccaaggcctgaagagagaaattatatatatgaaatacatacccataaatgtatattcctatatctatatagccctataaacataagagtaaagttaatgaaattgtagggtgttcacaaggaagtagacaaaaataagcctaaaaaggctgactggggcacgtctcagagcagtggttctcaaattgtatcatctgtcagaatcacttaaaggatttgttgaaacacagattgctggtaggtctggagtgaggcccaataatttgcatttttgatatgttcccaggtgatgctgttgctagtggattggagaacacactttgagaaccattgtcttagaggttttgaatgttaggctaggaggagttaccaaaagatttttaagctggaaaacgtccatcgtaatcaatattgctgtgtgcttttctaaagaagctgaattaaaacgaagtcaagagaaagagttgttgattcatatgctaggtagacagtgtttaacaggaaaagtaattgtctcatctcaggaatacatgaatcagcaaaatttgttctccagccttccattgggtatctcccattcttccttaaccagaaaacttttacaaagtagttaaatgaatgttcaaatgatgagtgaggttccagatggccaggattaactaaaatgaagcaaggatatttacaaagtaatttcttatgcaaaacatttcaaaagtattgctcataaaactccattaaaatctgcttttgtagacccagccaccagcttctcccactgcagccatgtgcaaatgtgtgatcaaattgcttttaaatgtctctggggacacaatttactttgacaactcttagtaggcagccatgtattttaagctccatgctaatcccttccgtgctccttctgcaattaaggaaaattctacttcctcacttcctgccctcccaaccacagaaaaggcacaagaagcaatgataataagttggaattctagactgtcagaattggaggagatagtagcagtcaactttacgtcttcaccattgggtaccaactttccctgccttaactccttagtagctctgtggtcttagaatcagttactaacctcaagaagatccagtttcttcatctttaaagttagaataattatgtcaacctccaattatgcctctccttcactgtgagaattgatgaaataatatgtttaaaacataggaagttcttggcacataaatatctgtttaatacatattattataaacagactcaaatatattttggaattatgagctctacattatttaacaaataataaaaagccacttggttcaacatctttccctaacagttgattctaagaaatataaaggtgaatgaattggtctctaaaggcaaatgaaagcattaagaccatatttgttatgtgcaatggaggtggttacatgtaagatctagtaatcatacattgtcgcttaagctgctgagttttgatgtagatgttacatgccaatagataacaacagggtaaacaggtcatgtatagcttggcaaaaccttccaactgggttccctggccacctcttaataggtgcatttgggctggtaacaggtatgtaccttcctgggatgaagctcccagagtgaggggcaggctgccatctttgctgttttgcacttttcactcttgatacctccatgtagtgggagatccaaggtgactagcaactggagcaggcccccagcatactgcagtagccatatgttaaagtagccagacttaagtgggtacctgttcccatatctcctcaccaggcaggtcctccaggcctgggcctccagccatcccctgccagaggtattgagccagtagcaactcaggacctcccgggacagagactccaggggcaactgaaagcctctctgccactgcttctgcagtggaactgcccttgctacccttggactaatgaaggagtaaagaccctaagtgccttctctacacctccaacaagctgcacttgacccaaggagaggaggccagaccatctctcatgggtcccacctactccttctgcttgcaccagacaggtaacccctaacttgggccccagcacatacccttcagtctgggctgactgcactgagcaattcctgacctcaatctctctggggtggagcctccaagagataagcaaaagacccttgtccacaaccactactaaggtcccttcctctgctgcctccaagtggaggaaggaatatgaatactgagattgccccagagctacagtcagcagcccaggagttccaagccatgatctgcagccagcatgcaagtgggagaggaacccacaccttcagagcatttagagggaacacagctgcaactgtgaggaaacaggggagccacacaactgagcaagagtctaccaattgaccatatgtctaagtgccacccacaggaccacacctcgaagcttaagcatcaaaaatacctcatttatatacccacctctgaaaccaaagacaagaagtcagcttcaaataaagactgtacacaatgccttggccctgtgaaagcaggcaggaaaggagtctattgactgtattcaatctacactgcagttaaaggaatacccacatacagagatgagaaacaaccaatgcaaaaactctggtaattcaaatgaccagagcattgttatgtttccaaatgactgcaccagttctccaacgagagttcttaaccaggctgagctggctgaaatgacagaaatataattcagaatatgaataggaatgaagagtatcaagattcagcaaaatggcaaaacccaatccaaggaaaccaagacacacaataaaatgatacagaagctgaaggatgaaatagccagtataaaaaaagaacataatggatctgacagagctgactaacacaacacaagaatttctcaatgcattcagaaatttaacagcagaataaatcaagctgaggaaactttctcagaacttgaagattgtctctctaaaataagacagttagacaaaaataaagacaaaataattaaaaggaataaggaaaacctctgagaagtataggattatgaaaagaggccaaatctacaaatcactggcatccctgaaagggatggggagaaagcaaacaacttggaaaacatatttcagaaaatgatttatggaaactcccccaaccttgctagaggccaacagtcaaattcaggaaatatagagaactcctgcaagattctacacaagaagaccatccccaagacacataatcatcagatattttaagataaaaatgaaagaaagaatgttaaacacagctagagagagagagaggaggtcacctacaaagggaacaccattagtctgaaagcagacttctcacctgaaaccctacagaccagaaagaatcgtagtcctataatcaacattcttaaagaaatatcttcaaccaagaatttcatatccagccaaactaagcttcctaagtgaaggagaaataagattcttttcagataagcaaatattgagggagtttgttaccaccagacctgctttacaagagatcttgaaaggagcactaaatatagaaaggaaagactgctaccagattatacaaaaacacacttaaatacacagaccaatgatatataaagcaactacacaaacaagccagcataataaccagctaacaacacaatgacagaatcaaatccacacatatcaacattaaccatgaatgtaaatggattaaatgcctcacttaaaagtcacagagtggcaagctggattaaaaaaaaaaagtgtgacccaatggtatgctgtcttaaagacactcatctcacacgtaatgatacccatagacttaaaataaaggaatggaggaaagtctaccaagcaaatggaaaacagaaaaaaacagggattgcaatcctaatttcaggcaaaatagacttcaaactaacaaagatcaaaaagcacaaagaagggcattacataattgcaaagagttcaattcaacaagacctagctatcctaaatatatatgcactcaacacagaagcacccagattcataaagcaagttcttagagacctacaaagagacaacaatgcccacacaataatagtggaaggcttcagcacttcattgacagcactagacagatcactgaggcagaaaattaacaaagatactcaggacctgaactcaacattgaccaaatggacctgatagacttctacagaactctccaccccaaaacaacagaatatacattcttctcatcaccacatggcacatactcttaaatcaatcacgtaattggacataaaacaatcctcaacaaatgcaaaagaactaaaatcatatcaaacacactttcagaccacgatgcaataaaaacagaagtcaaggctaagaaaattactcaaagtcatgcaattacatggaaattaaaaaatatgctcctgaatgatgtgtgggtaagtaataagattaaggcagaaatcaagaagttctttgaaactaatgagaagaaagatataacataccaggatctatggaacacagcaaaggcagtattgagaggaaattcatagcactaaatgctcacatcaaaaagttataaagatctcaaatgaacaacctgacatcacaactgaaagaattagagaagcaagaaaaaaatcaaccccaaaaatagcagaggacaagaaataaccaaaatcagaactgaattgaaggaaatcaagacacaaaaaaacattcaaaagatcaatgaacccagaagttaggtttttgaaaacatgaagaagatagataggatactagctaaagtaataaagaagaaaagagagagatctgaataaacacaattagaaatgacaaagaggatgctaccactgatcccacagaaacaaaactaatcagaaactactataaagacctctatgcacactaactagaaaacctagaagagatggataaattcccggacacatacaccctcccaacactgaaccaggaagaaactgattccctgaacagaccaatgattagctctgaaattaaatcagtaatagacagcctaccaaccaagaaaagcccacacctgatggattcacagcctaattccaccagatgtacaaagaatacctggtaccattcctactgaaactattccaaaaaattgaggaggagagactcctccccaacccatcgtatgagaccagcatcgtcttgataccaacacctggcagagaaacaacaacaagaagtcaggccagtatccttacatgaatatcaatgcaaaaatccctaacaaattacttgcaaactgaatccagcagcacatcatatagctaatccaccacaatcaagtaagcttcagcctcaggattcaaggttggttcaacatacacaaaccaacaaatgtgattcatcacataaacagaactaaagacaaaaaccacatgataatctcaatagaagcagaaaaaggctttcaataaaattcaatagctctttatgttaaaaattctcaaaaaaaactaggtattgagggaacatatctcaaaataataagagccatctatgacaaactcgcagccaacatcataatgaaatggcaaaagctggaagcattcccctttacaaatggcacaagacaagaatgccctccctcttctaatagtattggaagtcctagccagagcaatcaggcaagagaaagaaataaggagcacccaaataggaagaaaggaagttcaactatgcttttttttgaagataacatgattctatatctagaaaaccccatagtattgccccaaaagctccttcagctgataaacaacttcagcaaagtttcaggatacaaaatcaatgtacaaaaatcactagcattcctatatacctacgacagccaagctaagagccaaatcaggaaggcaatcccattcacaactgccgcaaaaagaataaaatgccaggaatccacctaaccagggaggcgaaagagctctacaatgagaattacaaaacactgatcaaagaaatcagagatgacacaaagaaatggaaaaacattgcatgttcatagctgggaagaatgaatattgttaaaatggatgtactgtccaaagtaatttgcagattcaatgctatttctatcaaactaccaaaaacattctttgcagaagtagaagaaaaactattttaaaattaatatggaaccaaaaaaaagcccaaataacgaagtcaatcctaagcaaaaagaacaaagctggaggcgtcacctcacctgacttcaacctatactacagggctacagtaaccaaaacagcatggtactggtatgaaaacagaaacatagaccagtggagcagaatagagggtcagagataagaccacacacctacagctatctaatctttgacaaagctgacaaaaacaggcaattgggaaaagattccctattcaataaatggtgctgggtaactggctagccatatgcagatgattgaagctggacccctttcttacaccatatacaaaagccaactgaagatggattaaagacttaaatgtaaaacccaaaactataaaaactctggaagagaaactaggtaataccatcctggacataggaacaggcaaagatttcattacgaagacaccaaaagcaatcacaacaaaagcaaaaattaacaagtgggatctaaacttaagaacctctacacagcaaaagaaactatcaacagagcaaacagaccctacagaataggagaaagtatcttcaaactatgcatctgacaaaggtctaatatccagcatttataaggaacttaaacaaatttacaataaaaaagtcaaacaaccccattaaaaaatggtcaaaggacatgaacagacacttttcaaaagaggacatatatgcagccaacaagcatataaaaaagagctcaatatcactgatcgttaaagaaatgcaaatcaaaaccacaatgggataccatctcataccagtcacaatggctattattgaaaagtcaaaaaatgacacatgctggcgaagttgaggaaaaaagggaacatttatacactgttggagggaatgtaaattagttcaaccattgtggaaacactatggcgattcctcaaagagctaaaagcagaactatcattcaacccagcaatcccattactcggtatatactcagaggagtataaatcgttctaccataaagacacatgcacccaaatgttttttgcagcacccttcacaatggtgaagacatagaatcaacctaaatgcccatgaatgaccgattagataacaaaaatgtggtacatatacactatggaatactatgcagccatgaaaaataacaaaatcatgtcttttgcaggaacatggatggagctataggccattatcctcaggaaactaatgcagaaggagaaaaccaaatactgcatgttctcgtttataaatgggagctaaatgacgagaactcatgaacacaaaaaagggaacaaaagacattgcgtctacttaagagtggaggctgggaggagggagaggagtagaaaatcatattaggtactgggcttattaatacttgggtgatgaaataatgtatacaacgaacccctgtgacacagttcaactatataacaaatcttcaaatatacacccaaacctaaaataaaattttaggttttattttatgtgtgtgtatatatatatatatatatatatatatatatatatatatatatatataatcttatatataatttttataaaataaaaattttagaaaagatatttataaaaaataggtgtgatttggcatccagctgatcatgggagataagtaaaagatgacttcaaaaagttgtgtttcgatgtctgaaagataactaatagattcaccttcaatatacaatgtggaagaggatatagtattagtttacaataaaaatgtctacttgagcacactgaggtttgagaaaacagaaagatgtttaaggcaagatgctgagcagacagagatagaaccccagagcccagtgtgtgaaaggggtgagggagagacaagagcagaggtgcaagtgaagccatgggataaatgaggtttccaaaggaaagaggggacatactcagggctggaaggctaaggatctaaccttcaagggcactcagctatgagtcagaaagaacaagatgactatcagtgtctgggaaggccctcgctacagccactaggaatttgcatttagagaggaaaacaataatggaatagtccttgtggctaacattaattgaacacttaccaagtaccatgcactggtctatgcattattcagtttattaactgaacaataaacactcagttatttattcctcacaagtcctaaaagagaagggaagggattttctattaataacacaatttttacagataagacaaagtccagaaaacctttgtcacttctccaagatcacacacttgacaaccagtcaagctgtgactgaatctaagcagcctagcacctcaggtctcattcttaaccactttctatattaagagttctgaggacagagaaaccaaccccagcgtcatacaaacaaccacaagtcacatctcagcattcagtgctcagccaaacatgcatggaacagctattatgttccagaaagaaaaacacacgaatagataagataaggcctactctcaagaattttatattctggagcaaggcagacaaatcaaacaattattgagacgcacataataagaaacttctattaaccacgatgctttgattcaatactccatgggagctcagaggaagaaatgacaaatttttatgaatgaagcccaacagtcattggagaaggcgacacatgttatctgagtattgaagaaaggtggatgtttgccagaaaaataaaagaaacccaaggcacaggtagcaacatgcagttatgaggaaacatatattcagggaatgataacagatcactcatgggtaggagttgaggtaggaaaatcagactgagaacacattggaaaagcagtgaaagctgagctaagaatttagcttttagttaacaagggctttcctatgggttttcacatgcgttttcaggagcagccactccccaggcctcaccaacttccctatcccctactgatacccacagcccctgcagatcccggcatcagcatcacttgctcaggagcctaccctgctttggagattgcaacttagcagactccaatagctttttttttttccttctccttatagtattcaatggtcaccaattttactgtaattatctgtttactgtctgtattcccaactagacaaaaagttccatgattcagagtttttctgatcattcaccactgtatttacaatgtccagaacaactcatagtaattagtaagcactccataaatgtttgatgaaatgaatataaaaataacagttcaaaccctctggcatgaaattcaactcaacaaatattatgtacaaagcctgaacctgccctaaaagagtatgtgagaaggagaaacttttaatatactttccttgtgaaatgcatttcaatcctattgggaaaacaaatgtaattgtgtgacacagttcacaatgacagacacttttcatttatacattacaaaatcgaattatactccagggagatcattaagaaaatgcagatacatttatctccagcacaagattaaacatgcaaccttgaagtaagaattgtatgttttacaagtaaacctgtttaaaagaggatcggagactaagaaactgttggagaattttgccgataaaacacatcaaatttttgagctgtgcagaggaagggtgacaattcagctgggtgtatccaaaaaagaatcttgcagtactatagagaatactatcttcaaggaagtgaaattgactttttttttaaaaagggaattacatttaatgctaagtaaaggacaaagtacagcatgttcagagaaaggggataaaaatggttaaaagtctgaaaagtatggcttatgaggccagcagaaggatctagaaatatttggcctaatatagggaagacttggggatgatatacctctgttttgttgtggaggctccataaagatacctgtagggtctggccagcctaaggggaactggtatctcctcttcttgtctgcctaacacccatctttccagtgagaactgctatttcttcacaccatatgtttttggtaaagctgggagtcatggtgcctgacctctgcccagtaaccaggatgtgtcatctccacaccacagtgactggttaagtgaagagtgtttgacacaagcaaagccaacggaaattcttccatgagaaacagcacttaggtttctcttcctatggactcatgtgttaaggatggtttaagatttgttgactgtgactatttttctttcctggtggaagaacccagcctaagaaaaaaatctaacaagaaaccagagctgatggacagcatagggacaaagagggacagatagaaagagaggaatagacatagggaaacagagagggaagtaaacagggagaacaagaaggcaagatggagacaaagaggagagggaaacagagttagagaggggcaaagttagactaaatgacattgttcaaatccttgtagagagccatgtctgaagccagacttttcagttatttgaacgatcaatttattatctgccgcatgctgctgaaagaaaccttgctaatagatcatccaataagcaagttggtaaaaacattacattcaggcaactcactggcatatatcataaactcaaaatatattcaaataagtctgcttattacatatgaaatcactggcatttacaggcagttgctatttacagtggttacctcaggttatgcagctgtggaagtggatattgaaagaattggggacattatgttctacttgtgaactgatggcattttctacaatgctcaggtattattaatattgtgacttaaaaaatctgtgaggattagaaaagggactgttagaaaaaaatcaaatacaagcttgtgaacagggaggaggttaaccaagaccaatgtaggagtgatgcaccccgtaagagatggtgagggctcccttagagggagatgtgagggtgtttgatgagaaagcagagagaacacactggtcaggaagatttccatgctccctggcttgttctgacctcagagggaactcccagcactgaagcagaatgttctcagagaactgaggaatgtgccattctagcaacattttcagttaaaaggctattgtggatggacttgcatttgagaaggttacgttctagcaaagggaaaattgaagtttaaaatgtgtattacagaaattagtaaaactgaaggcccccaaccccaatttaactgaccatccactctggccagcactacaccgtatgccctacccctcaaataaccacctgttaacgatttggtgaaaattcattcatgatctttctttttcattctcaatctctctctctttctttctctctctctctctttctctctttctctctctctccacctctctttctctctctctccacctctctttctctctctctccacacacactcatgtaaacccagatacatgcatctctatatttattttacaaaaatggaactatgctaaacattagagtctgccagttgctttttttcccccaacataatacaccagtgatatatttctaggacaacacacgtcattatttctcatggttttcaatggctgccttatatttcacttttaaaactagtactctatcatgactacttggttagcttttattcaccacagtactttagatcttaaaaaaatcaactgtactctaaagcttttaaagcagtttttgatctcctatgacccatactatatggtgcatttattttaattatgctttggaaattatttttaaggaggcaataaattcttattaacagaattcaattctgaaagcaccaggaagcacagtgagctgagaatgggagttgggaaaatgcattttgtagtactaaaggagtcctacattttgctttgatccaggagtctgccatctgagaagagttacaaattaaagtgagccctcttgctcaaaggaactaccccttatgattgatcccagaagacttgtagcagctctagagagaaggacatggcatactgccgggaataacatggctaacaaggacatcacacctcattgagacattcactctgtgctttggcccagcccagctgaaccaaactgttaggacgggaaggacacagcaaaaacagagctagatgataaataaaaccatcctcttccaggctaaaacattgccctgtaatgttcaggatggaccctccagcactatgagggaacgctcttgggacagggaaagctggagacaagctggaggcaagatccccaagctccccaaggaaaataaaacaaaagaaaccccatctgatatcttacttatggtattggagtttttgacatacactgtcagagaatgaaatggaattattggcatgactctcacaaagagaacgtgctgaccactccatttgttcaatcgtgtttgtcaaatacctaaataagtatttatgcaatgactgtttaattgtcaacctccccataacaatgcaagttctatgagggcagggatcttgcccttgttcgtagccttgggcttcctcccattggaatagaaagacatttaagaagaaagtatagacttgattttaactataattacactgagttctacaaaggagaaaaatggttttgatggagtcagcgaagacttctgcaaagaagagaagatttagctaaaatctgaaagacatgcaggagaggaggggcagaggaagttttcaggcagagggaaaagccaaggcctcaggtggctgagcagagagccctggagaactagaaagaaggccaaagcaactcgggcctggaggtgaggttaggaagggggtgaagggaagctggggacatggacaggaaacagagggtgaaaaaccttgtatgagtctggtcttgatcttcaatgcaatgaatagccactgaagggttttaagcaaaggagcaacagtattagagcagcattttaaaaggatggcttttgatcttgtgagcgacaagtggatggggagggaataaaacatatttggagggaataattaggaaagtgttgagtgatttcttcaagaaatgatattactttggatgaatgatagagagaaatagactaggatctctttaggaaagaaaatgagcaggacttgtcattatttaaatgtaggaggcaaggaaagactgctatcagaataactacctggtttctagatgatgcaagctgttggagcagctattcactgaggaggtgcaagtttgatgagaaagatcatgagttgtatggctagttacaagaaactgacatgaacaacaacatccactaacatggaatattgtgacaagctgggccaaagtgatgccttaaatggattatccaatttatacctaactgtagtcatataaaataggtgctatctccctaagttttagagacaagaaaggcttagactcagaaaggcttaatcacttattcccattcccagaactaaacattttaaaagctgggatttgaacccaaatctcttcaattctaaagcagatggttcttaatgaccaattcatcctgtttcatgacaactcatacctactcaggaaaagtttcctgatttgaaaagtacgtaggcataaatctgaagccaaacctgtcaaggaaacctctagaccttctctcagggctgcccacagcaaactctccacaatggacagttgattctacactttctcccattttttttcctggctgactggctctttttcttactcctgcttttacacaggccttgaggttacctcagctgcccctatcacccctgcctggtcttctccaaattcctgtagtactttcagtctcactactcattttaacaatgatcatatgcaggttacccagcaggatttccatagattttctacttccttacattgtatttcctataatacaaactttcattcagtgtatcctgactgtctttaaaagtctttcatgtactaaagtcagattgttgtaaacaagctaataaacacaaatttccaactatgccatgccatgggtctggttgcttgccatgagttcaattttaccagagtcattatctctagctatagagtggagtctcattatacatgcatttaacttaagcatattcaactatatgttcttggcagaggaaaagagaaagcaatttaaatacagcaggccattatgactaccattccaatcaatgcacatatgtcccatgaaataggagatgaacctgctgtcccctcagctggtttcagtctctaagtacctcccccagtgtgattaattctctgggaagactatgatgttagtgtttaaaagtgtgtatgttagatataccacaatctctagtttcagtcaactacttttcctagtcctcaatttaaaaaaaacagtgattgtcggtgaaaccccgtctctactaaaaatacaaaaaattagctgggcctggtggcgggcgcttgtagtcccagctactcaggaggctgaggcaggagaatggcgagaacccgggaggtggagcttgcagtgagccgagattgcggcactgcacttcagcctgggtgacagagcaagacttggtctcaaaaaataaaaataaaataaaataaaataaaataaaataaaataaaataaataaataaaaataaatgaaaataaaaataaaaaacagtgattgtctgagcacgatggctcacatctgtagtcccagcactctgggaggctgaaggctgaggataacttgagcacagtagctcgagaccagcctgggtaacatagtgagacttgtccctataaaaaataaataagaataaataaaactaaattttaaaaaagtgatctatcccaagactggaggaaaacttgggtttgttgggttgctcaagacacagtaagaaatcattgtccctggcaattctgattacatgtgatttgcaccccacatttttctgagagctaacccctaagatactactacattgataacagcatgtttgtgtagtcatctgactttagattgcattctacctttatgatgaaatgtaaattagcaggaattggaaaatgaatagtgatggtacaagtgataaatacataaatctgcaacaaatgaggcaaagatgaaaatcattaggtcccctgaagtcaaatatgaagaaagaaaataaaattatgccacaagaatgaaatgctagatctgggtccaaaaatcataaaattattgggaagtttactgtaactttctggaaaagagtctccacaattatatgcacatacataaatatgtatatcaaattattacagaaacatattttcaagaaaaggttatgttcaaacatagggcattttcattctgaaccacccctgctgccctctgggaagatgtactcattcttgatgcttagcttcttcagaattttgttcatgccatcagtataaaatttacagctctatagtaaacttgattgctgacatctattgctatttagattgcaatctccttgcagacaagttataggtcttactaatctgtgcatctacagtgcctcagagagggcctgactaaaaagggggcctctgcaaaggctggagaatgactgtataactgaattatcaaatttacctctctgagattcatttcttctaatgaataagaaaaggcagacactgcccaatatccatcaagtcatgtctccagcatggagctccgctatgcacattgttctgtccttacctatccagagaaatgcagcacaggtgaaaaatcgatgccgttgtgagcaggacgtccagagatgtccgaacaagacaaaacacctccccataaatccagatgtcttgaaccagctcaatggcaccaaagggcatcaccagcaccgaaaccagcagatccgcaaaagcaagagatacaatgaaataatttgtttttattttcctgtgagtgaaaaagtgtaagagaggaggcagggggagggatgaagggaaaaaggggagggagaagagatcaagagaaaaaacagggaaaagggaaacaaagaaagaagaaaagaagggagggggaaagaggaaagaaaaagtcacatgcttagtgtattccgtgagattcaatttccccttctgtaacatggctgagaagacccagcgtggtccagcctctcctgacttctccagacctaccttataccaaaacctcttttttcctcccccttctggccaccctgccctaatctgagtttccctgcacatataggtcccttttgagggccaatgcagatgttctttcttccaacggttgcctggttaatcccacccacccgtcagtccttggtcgggcattctcaggaaactctcccaaggtatgccctgtgactgtagtcacagtccaccattttacactagcagactggctactgtgtactcacatttataacactggtcagaattgcgcttttgcactttatttgcatcatcattagatgtgtggatgtcttacttagagaggaactgcttcgttataccctcttatggcccagaggctctcatcccaggctgtacactagaatcacctgatgcattttaataagtattgatgctgaggtctcaccccagatcagttagttcaggcaccctggggagttaacgcctctcccctcaaagattaccagatacaatacaggatgcctgattagatttgaactttagcaataaatcactttttaaatataactatgtccaaaatactacatgagacatactaataccacacgatgatagtttttcaaagtgcttcaggtggttctaattgcagccagggttgagactgatgaagtagaagtgcaaaaaacacaggtttaatttctagatctgtcccttgtcagccacatcttccctaaaccattaataaaatggggaggttagattatatgtgctctcaacaattgtatatatagtgatcacaactataaacacatttgacaaagaaaaaaatgacaggatggaaatacactgaaatgtttacactggttgtattagagttgtaggattaattgcaatccctttttctccccttttatttttaaaatgttgttcccatgaatgttttctttcttaattacaaattctaatagaaatgttcacacccaactctctagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtaacttcaccatcagctgatgacacatatatttatcatgcgtttaatgtacaccaaaatctgaaccggtcgcttgacattttatcctggttagctcctacataagaggagtatgaggcttagagagctgaattaacaggttattttccatccaagcacttgtggctttccttcagggcatttagttcaactagcattcagacatatgtagttgatgcctgttttgtgcacctactcaactagattgcaaaagctgagtgaatgaatgatagtaactttgcaactgcaggagcagcccaatttggtccaactttgtgtataaaatggtgagttgtgttttagttgccatggacccccaggttgcaagttaaactgaccaggcccagatgaaccaagcatgcaaccacagggtggaacctaagtgcttggaccaaggcatggggaccaaataaagaagtggacgtctcatggcatgatccacgatccaatcatatagagccctagcatcaccttgtggcataatccagtcagatcatacctcttggcattaacttatcacaagatccaatcagatcacaccttattaccctctacctataaaacctgccacagcccccagctcagggggacagatttgagctttgcctcctgcttccttgccgatcaacttacaatgaagcctttttttttttcctcaaaagccagggccatagtattggcttctataaacatcagcaaggagcccactgcttgctcagtagcaacttgaactggttgttactgagcaagttactttgcattcatacagttacttggcctgaatgcaaagccatcttgttacagtgtcccattccagcccatgcagaagcttctgcttacaggtaggttctcccagagagaaaagattgtggtgtgatggttgttcttacatcagttcacctggacaaattgaattcagattctgtgaagtctgttggagagatagtagccaataaataagctcagtggctcctttcaccaccctgatcatttcttttagtgcccacaatatgtcattgttttcccagttcaaatttgtgttcttgtcaagttcagcatctgatttagtctacaaatgttgccttccccatgtaaactcagcattttgttttattaacttgaaaatgaagatcccttttcaatgaaagcatgatatctgcagattaatattcagaagctatagggattttaaaaacttttatagtataataaaatgttctttttaatgaagtttcaaagaatcttaaaactcttagaccagcggtgtccaatcttttggcttccctggtccacattggaagaagaattgtcgtgggtcacacataacatacactaacactaacaatggctgatgagctaaaaaacaaattgcaaaaaaatctcataatgtgttaagaaagtttataaattgggttgggctgcattaaaagctgtcctgggctgcctgtgccccgacaggccatgggttagacaagtttgtcctagacccaaaccccacatttgaatatgggaaaaccagggcccagaaaagaagagctgacttgtcagagcgtgctagtggctggtctgggagaggctgcttgtcctgtgagcccaccactgagaacacacagttccaaaaatcaagaattctctgtctttcctgagctcttttgactgaaaattaaggtgcatgccctctccagatggaagcagcctgcaaagtcatggctttggccttgtccagaacttctgttaagctggcacagaagacaaggggccaaagggaatgaggaaccagtctggcagcagttggagaatgagaaagtccctccattcagctgagaagtatttttataggcagattgatagattgtttatgactgaagttcagatgaaaagaaattccagatatgcttatttaaatcacccttctacacttaagttctaactatcaacagtacaaatatcagatagggaagatttaattcaatgaggaaaactgtacacttagaaaaaagaccttaataggctgatgtggccaccaaaaattcatttgatcttaggtcatgttagttgagttaaagcactaacaaaggaggtgatggtggttctcttccctgtccttcttagagactaacggcccccctgaaactcatctcttccacccccagggcctctgtatttgaggtgccttcttcctggaatgattcttcagtgacagacttcttgtcattcaggcctcagattaaatttaacccccagttagtgtaccacagccaacaaacatttttcattttctttacagcatttactgttatctgaaatgacttctgttattgttttctgtgccccaattccacagattgacttttgttatctttttcactacaatctccagtgtctggcacaatatctagtctagagtatgtattaatgtacatgaaatgctatgtattaatattacatatgtagatgatgcattacatagtaagtgctcaattacttgctgattcagtgaaagagagatatattgtgctcataatggttatatttattattcaatgtctttgaagcctggttgaaagtatagagatttcacctagagaaaagaaggcccagagatgaaatgcaaaagctacttgcagctatctgagcgctgtcatttgaaataagagtagattcacatattcattcatttaacaatttctgagcacctactctgtgttaggcattgttgtatgtcctagggaaacagcaataagcaaaacagagagaaaaacagacaataaacagatgcatgagacagtatgtaaggtgtcagctgatagtacagtccatggcaaaaaaaaatatctaggagggtaaggaggactggatggcctgtggcggattgcagactggctatttaataaaggatgtcagggaaggttcaatgataaggttatcacaggttgtgaggctaactaagaccagtgggtgaactttaagcagtggttcccagccttacctgcatatttaagttacctgaggagccttaaaaaatgctgattctgggaatccaccctcagaggtgctgatttaattggtctgagttgcagcttggatagagaaatttttaaaatctcccaagtgactctgatgtgtaatgaattagagtcactgacagggaggcaagatttagtaccagataataagagccttctaacaattaaagatgatctgcaatagcttcccggtgttgttttgtgttccctggcacagaaagtgtttaagaataccagaatggcaatgagatactaatttgcactcattaggatggcaattataaaaaataaaacaacgaataaaaaataacaagtgttggtgtgaatgtggggaaatggaaacacttgtgcattgctggcgggaatgtaaaatgctacagccactgtgaaaaacaagtttgatggtttctctaaaggttaaatatagaatgcctatgtgatcccccaattcaatcccaggggtacacccgaaagaattgaaagcagggatacaaacagacacttgtataccaacagtctatagcagcattattcacaagagcccaaaggtgaacacagcccaagtttccattaatagataagtgaataaatagaatgtggtatatacatactacaaaattttatttctctataaaaaggaataaagtttgttgttgttgttgttgttgttgtttttgagatggagttttgctcttgttgcccaggctggagtgcaatggcgcgatcttggctcactgcaacctctgcctcccgggttcaagttattcttctgcctcgggcttccaagtagctgggattacaggaatatgccaccatgcctggctaattttgtatttttagtagagacggggtttctccatgttggtcaggctggtctcgaacttctgacctcaggtgatccgcccgcctcggcctcccaaagtgctgggattacaggcatgagccaccgcgcccggccaggaatgaagttttgatacatgctaccacatggatgaaccttaaaaataaatgaaacaaataaataagtgaaataaatcacacacaaaaggagaagtattgtgattccacttacatgaggattctagactcagaaaattcatagggaaattaaatagaaaagtagttatcagggactgggagcacaggtgaatgcggagttattatttaagaattatagagtgtttggaatgatgaaaaaattctggaagtggatagttgtaatggttgcacaccactgtgaatgttctttttttagctttttattttaggtccagaggtacatgtgcaggtttgttatacagggggtttggtgtacagattatttcatcatccatataataagcattgtttgataggtagtttcttgatcctcaccctcctcccaccttccaccctcacgtaggtcccagtgtctgttgttcccttctttgtgtctgtaatgtactcagtgttcagcccccacttgtaagtaagaacatgctgaatttgattttctgttcctctgttagttttcttaggataatggcctccagctccatcgatgttgctgcaaaggacatgacctcattctcttttggggcttaatatcactaaattatatgcttaaaatgcttattttatatattaataataaattttattatttatattttagcattatataaaaaaagaattcctggatgaccacatatcaaggtactgtacagggctcctatattgggggcaggctggcctggctgttttaggtcgcttttttgtctatggactgtgatttaaacatatccttataacatgaattctccatcaacaccaccaccaccataagaataatctttcttatactgtctttactcttgtaaaagaagaaaacagattcagagcgtctgtgatgaacatctctggctccagagaaggtacattttgaaccaagtgggaatgtcagggttagagagcaccaagttcaatgtaatggttcatttgtggcatgccaattaggagttagaaatagcttaactttaaactaggagtgacgagcaaaatttaagcatagaagaagctttttaaattaggcagaactgtccattgaactaaaagtaagtccagtaatgacaattaaaataaattccaaaccacttctgcaaaattcatgttaggtccttgggttgcctctgacaccctcaagcaatcctgtcaaccacaactggacagctttcatctggctgaagagctgtccactccactaaattggttcgttgacagctattcttatgagaaattttactttctcttcttttttgctttctccgtgatcttttgatccattaataaactccacaaacttgtgggctggttttgccattttctctgctcttcatgaaagaaaatataaagacacaaattctgggtaaatttccacataggttagtatatgtgaaaatggactgtgaatgataaagtatgataaataagtgattattgttattaataatgatagagacaatagcaaaggaaatcttaggttatactttgtcacacacacacacacacacacacactctctctctctctctcatactttctggagagtcaagaacattttttgttgttatttatttatttatttttgagacagagtcttgccctgtcccccaagctggagtgcagtggcacaatctcagctcactgcaacctctgcctcctgggttcaagtgattctcctgcctcagcctcccaagtagctgggattacaggcacctgccaccacacccagctaatttttgtatttttagtagggacagggtttcgccatgtgggtcaggctggtcttaaactcctgacctcaggtgatctgcccgcctcggcctcccaacttgctgggattacaggcatgagccaccacgcccagactttattgttattttttgtgggcttttgcactggttttgttcataaacagctgtatgacttcaaaaaattcacttgacttttctgagcctcagtttcttcatggatcaattgagaaagttagattaaatttcttattcatcaaatatgtattgagtgccaactatataccaaggactgtgctgagtactagattcaatagtaaagaaaatggacaaatttcctgacctcatggggttcatagtatggatggaaacagacataagcaaatgcacaattaaataaataaatacagtttgtgatcagttcttcccagttccatttcccaaatgttaatatttatattaatccactgaggatcttgataaaacgcagattctgattttttttaggctgaggcagggtctgggattctgcagttctcacagacccctaggcattgctgatgctgctggttcctgagtcacaggtggagtagcaaagtataaaaggtgtaaacatgacattatgatagaaaacacgctggcttagagagaagtgtgaggtggttgggaaacactggaggtgacagtcaactgagttctgatgtatgcagagaatttggaagtcagaggaaccaggataagtgcattgcattcaaagggaagagcaactgcaaaagccctgagacagaaaagatttttcatgttcactatcacaggggaaatgagcaagggactgagcatctgagatgagctcagacaagtagtcggaagccagaccctgagggcttttttgtgctctagggagaagtttatgttctattggaagatcaatgagaagacacagaagtgatgtaagcagagtaatgacatgggggcaggggtgataatatgccaggggtttctgcaggagtccaggtaaaagaagatggtagttaaaagtagcatggtggctggggagatggagagaagtgggtggaataaaggttttttggggagtaaagagatagataacaaaaatagattccatgagtgagtgggaagaagcacaaataaacgccatattttagaattgcatatctgaataaatgttggtacaatttaatgagatgggtgaaacacattaagtgtgagatacctataggacattcgagtgaagacgtcaagtaggcaattggatgtatgtgtgtctggagctcagagggatgactgggcaggagatacatgcttggaattgccagcacttctatgggatttagagaactgaggaaggatgtgatcacccaagaagagggtcagggtcttgatgaacagcagtactgagatgtgcagtagagaaggtagaaccagcagaggagactgtgaaagactatccaggatgttctggggacatcagatgagagcggtattttggaagccaagaggaacatttcaagtgaatatatgtatgtataatacatatatataatatattatataatatatatattaggaatatataaatatatatattcttgatacttccctggaactacttcaagatcactcctaagaatgacaggaagcaaggaggcagggaaactagagtactttttctctttatatttttatgtatcgaactttgcaataaaattatgttagaccagagggctccaccattgcaccaatgatctccgcagtaagtgtctcctctcccacctgttaggagtgtcatgtacacaagaaatattcttgaaaatatacacagcacatccacaaaagatcccatactccctatctaagtatttttttcacccttcctgcccagccctgcacagtcttttgcaaaggaattacatttaaattaaagaaaataatgtttcattttcttaccaatcaacagttaggagaagagtacaagggcattctgacttacaagagagcctgtctaaaattgaattatttttttctagtgagaattttattaaccttaaatataaggtccctgttggtttctatactgataagagaatgaatattaaccaagagggccttaacgttccactcagcttgattaaactttagacagccttcttcctgactccaggctctgaactcccttttcttagagcatttactttagaaaatttgtaattgcaaattctttctctaacactttgagatgtaaatgaaagatactcaccagttttacaagctaggactgccattctcaagaacttttcctttccctttgaaaggaaatcatcaagaaatatagtgctcctatctctcagtctgtaggatcgaacagcctaacttaggtggacaccttgctccaagttgtaaaaccgtcccttgtcgtgaagatatgagaaagtttacttatcctttgggtaaggctaattaggtagcacattaggtaatcccttccccccactctatttcttaaaaaccctcctgtcctttgttgtagtgaagttgaagtcagattgcattctggtctctctccctattgccatagccttggaaaagaaaaaagtcatctttacctgcttaacttcatccagtgcaatttttgttttgacagtatacatcatttattacaagtacagatgttcctagacttatgatggggttacctcccagtaaacccattgtaagttgaacacattgtaaatggaaaatgcatttaatgcacctaacctatagaacattgtaacagcctagcctaccttaaatgtgctcagaaagcttacatgggcctagagttgggcaaagtcatctggcagcagactactctgtagagcgtaggttgtttaccttcgtgatcacctgactgattgagagttggagctcactgctgctgccaggctaggtaagatggtatcatacagcatattgctatcctgggaaaagatcaaaattcaatattggaaatacagtttccactgaatgcatattgcttttacaccatggtaaagtaaaaaattcttaagtcaaaccatcatgtcggggaccatctgtaattgtatgtgtgtggcttcttcattacctttattactggccatgaacaaaatctgagtttaacatataggagcgataaactcagataataatcacattgctaatatgacttatgtaaattgatttttcaaatacttctttatttaaaatagaaataacagaatccatgagtatgttgtttttccttataacaaataacctgagcaatactatgtaattgttttaaagtatatatcatttcctttaaatatatgcactctttccccctaggtttcttgagagactaaacatacaaatggacaatggccagaccatgtgtaacaataaaactccgatggacaatctctggcagccagcccagaacgatcaggacttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctcttgctttatcatgctctgaataaattgcttgtttgttctcatctgtgtggtcttcatttgtttccatattctaggtgtgttctagatgttacacttatttgaaatcctatattttgacttaagtggaaatcctttctgaggaagaaaatatttcttatgatttggcttatattactttgggttcttgtactaagttctcaggtctcccagttaacgttttttcttttcttttttcttttttacggaaagctttttttttaaaaaaaaaaaaaaaaaaaagaggaggattaaataagatagtttgcatagccttattccataatatgaagcatcagagcagtggtgcttcaaaatcaccagcaaacactaggatcatctggagggctgggttaaaacacagactgctgaacccacccacactttctaacttagtgcatcttgggtgaagaccaaaattttacatttttagcaagttcccaggtaatgctgatgtcgatgctggtcttgggaccatactttgaggaccactgacctagaaccttacaagggatgcccttaatcttaacctccattctgcctttgcaaattattttcttctgcttctcactttgaaatgtcttccttggaagtgggttgattttgacattgatgtactgaacacctaccatatggcaaacaatgcacctggaagatttttcatgttggcgaattcaatcttcataattatcattatcatgtgatgtaatatcatgatgcccccttttcagaagaggctggagctcagcatggttaagagacgtaatattttgtaactattaagtggtgaagctgggatttaaacccacatatttttattgcaagtccagtatttctcctactaaattttaaacatgcttacttagaagtgaatatatttcctttaaaaaaacacatgctaaaattttgctttttgtctagaaacttaagactcaaaatactgatgatgacagcttaatatgtgttgtaaaatgtgctggctatagaaaatggtaggagaaaaaaggaataaaccttgtaggatggaaattatatataatggagtttttatgtaattctaaaataattttatttgattttttttgaaaaccctatagacaaggacacgagggcagggaggtggttggtgcacagctggtgaaggttaggtagttttgaactgcaaacatgcagagtaaaattcttgaggcaaaatcttaatagacttttcaagaacctcaaatatcacacatactgggcatgaaacaaacttcaaagcccaaagaggatctctctgtacagagtataatggagttaaaagctgtaaggaatacaaaggatttcaggatgaaagacactgttttctgaggccatgcctgaatgtaaagccaaggcaggatagataggcaaggtgagatctacatctggagagatacccactgctgcacagcatgttaatcattaaggattcaattcttcttggaaatgaaatgccaaataatagtgctagtcaattagacctcagaggtggtctctctttaagaaaacccattttccaaaagtggaactgagtcaacagctacagagatagatttcttttctttacaagatcattttttctttatatgtgcacagtctagcgtctctggtttgtgttgaaaacattttttttttttttacacacacttgttaaggaatacactcaccaggcacagaaatgtcttcctttggggtaaaacacatgacatgttttcaatattcggctgatcatttcctcaaaattattcctgtgattatgagaaattcagcacagggaaaaaatgtggaccacatatgccctctccactttggtaaatcatttaccctaagcataagcactcaaggaaaagtggactttcccatactctgatagtaacctgctctccattcctttgcaacagatggcctctgtcactaggcccaattgccagtggatacagctctccatattttgccaggatcttggtttgctgttgccaagtactatggtttctcttcttacttctgcctctgataatgcaaaaaatcctttgcccaaaggagagatgaaacagctcaattttatgctgttgcaggagtagtcaaacaatggccattgggccgaatccagcctgctgtctgtttttgtaaataaagtcctagtggaacacagccacactcaatcatttatgtagttcctctagctgagtttacactacaaaagtagagctgagtaattacgagagagatttcatggcccgaagagaaactttactccctttatgaccctttatgaaaaagtgtcatgacccctgctcttttgtaaccagagatgtttggtctaaagaagaacatggcattaagacacaaagacctataagagcctaaaaggagcctatttactgggagtcattcattcctctggattctttcactaagtggaaagcaacacccttccggttgaccacgccagaaactgagcatcttgctcatttttttcttctcctttacctaggtcattatctactctgaggatctcttaaatcccttcacttctctccaatctgctgtcaataccctaggagagggcttcctttcatcttctcctagactatcacaaccacttttatcccactaactactttgtctttgtcttcaaattcttagtatatgagacagcttaaatttaacatgttcaaaattgaactcctgatttccctaacctcaaacctgcttcccatatgaatacatagcaaatctatttctccagttgctcaggttaaaaatttggaagccacttttaccaggtctctacctcttctacctccagtacatcagcaaatcctgatagctctaacttcataacgtttcctgatcccaaccctttaccagccattcaatgtcataccattctagttcctactacatcatgcttcacttggtgactgcaaagtcctctcaactggcatccctgcttccatcatttctcacatacaatccactcttcacccactagacagaatgagctttgaaaaatattgagattggaacatatcacttccatactcactgcccttaagatggcttgtcatctcactaggagtaaacccagaaccctcaccatgacctatgtaaatttacaaagctggccactggctgcttccatcatctcaactctcaccactctctctttcccaggctgctcccgctaaggagacttcctgacttccacactgttcccagatggtgccaatcatgcatccacctccaccatccacctctcacctgatgctaccaccatctggatctctccattcaagtgaccagagaagctcacccttcacttcattcaggtgtctgctcagattcatctctgcagagaggacttatttaaaaaagaacctcccctcactctctattctcttgacttgcattattgattttcacagctgttaccttttacgctcccacacacactagaataacttgaatgtaaaatcactgaaagcaagaacttgggctgttatattcactgaagtattttccagcacctttttggtactgttttacagtacctagcacatagtagtgctgtgaaagtacagttggttctctgtatctgtgggttccacatccgtagattcaaccaactgtgaatcataaatattctttaaaaaatagtgcctgtattgagcatgtacagactttttcttgtcattattacgtaaacaatagatataacaactatttgcatagtatttaccattgcattaggtattgttaagtaaccttgttgaagtatatgagaggatatgcttaagttaaatgcaaatactacatcattctatatcaggtacttgaacatccttagactttggtaccccaaagaggtcctgggacaaatcccctatggataccaagggacaaatgtatctgtggaatgaatgactgactgaatgaatgaatgaatgagctacttcttaattagttattctgccttggcaattactctttcccaacactctcaacactgaagtcaagatatgttcttcccccaaaagaaattagctaatttctccctcttgttcaaaatcttataatgtcttcccattgcaattttgatacaatagcacatcttgacctggtttaaactggtccctacttacctctctagctttatttctgacactgttccataaccaacactaaatgaagtgcccaaattctcactcagtgagatgaggcacgcttgttaaactccttcctctccttcccattctttacctggcaagctctcgcatgtccttcagcactcagcttaaacatcttattgtctgggaagccatcctgacctcaatattgtccctgtcgtatatgcttccattgtaccctataattatatatcatagcttttatcaccctatatttaattgttatttaaagatctgtgcctcccaaccacactaacttactgattttggtatcaacagtgcctagtataacaaatatatgttagacaagtaaactgatatacaaggtagcccttgcttgaaagaagtttaaagtagtgatcaacacaaagggatttcccccttcattcagctcaatagttctgttaatcctgtctctaaaccactcccccagacaagtgcatttgggccaccaatcctcgctttgaattacaagttatagctgttaacatcacatacaaaccactaaagagttaacaagtttctccagagaatatcagaagcctttcccacattgtactctttaggctaataatacttttaagtctattttctagtcatgtcctgggcaccgaagttgttataaagattaataaatttggcccgatgtggtggctcacgcctgtaatcccagcactttgggaggccgaggtgggtggatcataaggtcaggagttcgagaccagcctggccagtatggtgaaaccctgtctctgctaaaaatacaaaaattagccaggcatggtggcaggcacctataataccagctactcgggaggttgaggcaggagaatcacttgaacccaggaggcagaggttgcagtaagccaatatcacaccactgcactccagcctgggcaacagagtgagactccatctaaaaaaaaaaaaaaaaaagattaataaatctaaatctaaaacacttacaatgttgtttggcatgtagtgtctgttatcttaatcctagctattaatattcatcttttctgttcatttcaaatagacacaaatgacattaacactggtcctggtcttctagctcacaatgtagcaagaaactaagcctgatcaatgactgatcattatgagagcatgttgtaatttcaacagctgggggctgttgaaacgacaactataaatagcggccagagaaaagagataatgagtaagaatacactggagtttttccagacacaactggtagaaaacacaatttaatatagcagagaagaaataaaggtgctgaaactcataggagtggagatggggtttagaaggtggtaaacgaatgtgaggggcaagaatttgggaggatttgaggctggcataatcataagagaagcagggagtatccagtatcttgatgggcataaggattttgaaaagaaaggctctgcattctattccacaaccaacatgtatacactcacacctacacgccctgccatgcacccaacatataagagaagatgagggagtgaaggtgatgggagaggcaggtggagaataatggtggggttgcccaaagatagacagactgaagttcagattctctacctggattagaccctctatccactacttctcctcctgcacctggttactagtcatctctagagccaaagacagaatcatgtaaaggaggctcatttggaaaagctggctgtggcattccaacctggcaaatctaagaactgtattgcagtacttgtcaatgcatatccagatgatgcttgtgacaaatgttaaaaaagccttaaaaacattcatgctccaaaaattccaaaagaaataaatccttatagctgttcataaagatttctgtacattattactcacaaccatgttgttcataactggagaacatgaaacatctaaatgtctatatttgggtattggttacataaacaatttattaatacacagccattgaaattcaggtttaaaatatttaatgacaagggacatttctcctaaataccatccaaagttaaaagcaggtataaaacagtaaagcacaagctcaacctttgtaaaaatatgtatttatatatgggtccagatactatagtgaaagattaatttgtgaccttttttaaaaaattacaaaaatactagaagaaatgagtggttaccttcttcctccatctcaagaaaataactaagatttgtataactacaagctttgaagactccagtgtcaagcttgacagggaagcaacagagcctcttgccttcaagggatctgtggacgtggtggtgaccaggacaaagtgaaaagcaaaaggtccagcttaacggagaaagaggaagaggtccacaaaatgtctgagattgaatttaccattgagacccagcttgaggagctcacagaaaagttaactaatttagagattaaaagaaatttggcatttcgtacatctgaatgttgtagagtaacactgaaatgcaaatctggtatatgtatgtgatacacatacacatacatgcttacatatacaaacatatatatgtacaggtaaatgatacatacatggtacctaatatttatacgtatgacatacctgtatttattacatatgactccatatattaatattatctatatccaaaatggttatctctaggtgatattaatctaaaaaaatttgaattatttcttcatttttttttttactttttcccagtatttcccatcaaatgtgtattacattgctaatccacaaaaaattgtgttttttttcaaaatgcattgcctatgtctggttttgctcataacagtgccttaataattatatgaaatccgcacgtattgttcctctcaccagttattaaacttactaattggcgtacttcattttaagaagtttttaattgcaaatgtagctataaactgtggtgtggtgcttaatagatgaaattttcttagtttttgcccatccacctgaagctgctacaaagaaagaataacttcaataattttttttaaacaaagttctctccccttctgtggatgttttggagcttacaactttgtcctgaatctaaccacttctcatcagtggtgccactaatattagtgcaagccactattatctctaacttacttcttacaagtttatttcttgcaataaaatcttgtcttcaatttcctgcccttatagtctatgtgctacacaaaatctagagttatacctctgaaatcaaaggcagacaatgtatgttttccactcaaaattattcaatggcttcccagctcatgcagaatatcccaagtttctaccgagacttggtagaatataccaggatataaggaacctggtaccagctgcccctttgatctcgatttccaccagttcttctcctccctctgctccaggcacaaacacctcctctgtatttctccaatatgtcaagtgcgctctgacctgtgcgcctgttgtgttttcttcctagaatattcacttccaaatatccactaggttccctttttgtcttcacttaggtctctgctcaaaggtgtccccatcaaagagcattttcctgactattctaatgaatgtagcatactttgtcattctcagattcactatgctgctgtatttttcctgatggtatgtatctaacatattgtatatttctttgttttctagtgtctattaactgtctcccaccaatagataagtgccacgaaagcagaggctttgtcagttttcttggcccataataggtacttaacagatacaagttaagcactgaatggtgccactgaagactatgttggaaatacggttgtatcacctactactacaacatgtgattatttatccactttatccaaagtcctgccttcagatacttcaatcttctactgcaaatgaaatactctatcttttcctcaagacgttatatatgttacatccaatagagaccataagtctgtcctctccagttccattatttgtttgttttgttttcagaactcagttgaattgtttctattttaaagtttagggtttttggccacactaatccccattttttgttcttacataagcattgcaattttcattttttacactgattatttctagtttagattaccttatccctttagagaatttttttaaagtatacatagggtctgataattaattaacctataaatcaatcaactaacgaaccaatcaatatttattacttatttaccatgcttggccatggagctatagttgacagggagacagataaggtccctgtcctcatagagcaagtggtaatgaattacatattgtagaatcactcttctttttacaaattgtccatgagcttaactaaagacacacacatttataagtagccaggaaattgtaacttcaaacaataagatacaatttccaccagtcagactcaaaaaacaccaaattgccaatcttttgaattgacaagggtgtgctgaaagcatactctcaggactggttatgggaggacacattagtaaagctttttggatgctaatttggcagtatgttcgaaatttttgaatgcacatttttaacatatctattctagggaaatgccccaacacttgcttaggtgtccagagatgcatgtagaaggttgtgtgttgctatagttttttgtaaaactgaacacttggaaatggtacaaaacttcacaaatctattagtgattaattacatcatggcacactgatacccttaaaaaatactatgcaggtgttaaaaagaatgagaagggatccatatacatataataaaaagtatacagccatgcataaacaatgaaaccagggaagtagttgtagggtcaagacagacagaagagttttttttttttatcagaaggagatctgattttcatcaggaatatatctgatcagcagagagttcagtcatatttgtaatattttatatcttaagctgggtcatggacacacaggtgttcttttatgttttttctcagtaccttttgttatatctaaaatagagccattaacacaggaacagaaaaccaaatacggcatgttctcacttataagtgggaactgaacaatgagaacacatggagacagggagaggagcaacacagactggagcctgtttgggggacggggagaaggggagtatcaggaaaaatagccaatgcatgtgaggcttaatgcctatgtgatgagttgataggtgcagcaaaccaccatggcacatgtttacctatgtaacaaatctgcatgtcctgtgcatgtatcctggaacttaaaataattttttaaatgactttttaaattaaaaaaatcttattttaaatacattttattattttattgtatgtatattatatttatcttatttattattttattgtacagaagttgtgctatacttacaataaaataatataatgtatccaaaacatgagtagattaaaaaattatacatcaatatacattatatgatatcataggagtttgaataaaataaaaactgagaagaagagggagacagaaatgcatatgtatgcatacatatacacatatttaatataagtagatccagaggtcatggccataagaatgcacacccaattgttaatcataaatattttgggcagggtattgaagatgatgggagacttcttcattcagaatattactagaactttaaactacatgaatttgtatgcttatgggttacttgtttaactgaagaataaggaaagacttttccctcacctgtgaatcccatcttttgcactctggccaacacctaagtcttctcactttgcactagaaggataatgtactgctcttgccaaataggtcatacacaagagtattaatttctccaagcagctgggtgtgagcccagctccaagcagaaaacaaacaaactctctgactcaaaaagaggcttggccaaggaatgtcaggttagatataggcatatgtttgtccatttgttcattcaaccattccttcaccaacttaatcatatctagatgcactcaacagagtatttgatagtccactctatttcaggcactgagaagaggaagcaggcagtcccttccctcagggagctcagaggctactgaaggagacagacatgaatccaataactgcatatacataaaattacagctatggtggatattataaagggaggtacacaaggtaacattgaccctgatgggagaacagaaaacactttcttgaggagatgataattgagctgcaacttaaagaggaatagaagttgacagaaaaaaggcagaaaacactggggactgaggctggaaagtgcagccgtgagagctacataacttcgtccagcaactgaaaggagacaaagatcactggagtgcagagaatgaggggatgcctcatgtcagatgcggccagcaagggtcacacatcaggagggggttggaagttgtactaagtatttatgtattatcattaattcggtgattgttttaagaaggttggcactgggggtgacatgattagatttgcattttgacctatctggtgtataaaagagaagggacaagagtattttttgtgttgtttatgtgtgtgtgggtttttgtttttgtttttgttttattttgtttagggtggtcttagtaatttaaaaatattttccttgtatcgataccagtcaacctatctagaacctagttattggtggaagtggcaccatctcctaggggatgtttgagatatctttgggatactgggttgtagttatgattggggagcacaacacaaatctagaggaaggacaggtttcacattacaacatgagggacaatccctcataagaaaattatcattctacaggccacattctccatgattctagaacatcctaccagccacttgtgtaagtgaaaaatttgtttgtaattatctaatctagaacataactccttttacttataaataaaaagaatcttgcatggtaatttccatacactgaataaagggaagggtatgctttcatttggttcagaacaaatattcaccctgtcacctacatacaacatgtctgcgttagactttgttggtagttgtcgtgtccatggtggtgacttaatgtacaaatgcacatatctgactgctttattatgttctgttgtagatgagcctagcatttatacaatgaaatgtatgttattttaccaaaattactctccttttattgcttctttgtatttcagttaagacattatattgataattgttcattgtgtatagatacgttagattactcgtggatttcatttcagtattgtaaaggggtattacaagctatttgtttttaaaaagagagtagcagttgatctggggtgattgagaattactggcctagaaaaatatgactttcaagagctaggctgtttcgatagacaagacacacttcaggtgtcttgtctaaatgaatgcactggagtgttcctgatttatcagtactggatgcatgcagttaaagaagctcagagaatgtcaaaggttggagagagcagcacaggggcagaggtggcacactagttccctatcaagaaaattagaaagatctgctccagcttcaagcttttctcaaagtcctgaaggatttttaacacatcttccataaaaagctgtaatttattatctcatgaatatctaatttgacaatatttgcaaatcaagtttgtggaattttggtgtgttcatttgagtgtgtgttttgttctttctcaaaataattcttaaggtagaaatgtttctatgtgctagaaatgctgagataaaaaaattaattttgtggttagcttgaaaataaatggtgggctctaatatgcaacgtaatgtaatataatataataagggtatccccttagggttgactgtggcagctttccaagattttaggccttgtcagtttctctgctttgataataatggaataaagaacagttattctcattatctgagtgctactatatgccagaaagagtcatatctgttttttatgcattggctgatttttatcgtcacaacagcctatggttatagatattatgactatatccaatttacagatgaagcaactgaggctcagagacttgaactgatgtgcccaaggtcacatggctggtagatagtccagaacaggatatcttaatccctatgatagacaaatgtaataatattttaatttaatcaccagtggcataattatgaagataatctaacagtaaaatacataatatggaatacagatgaatagaaatgtttgcctcttaaaaaaagtctgataactcctttgagaaccaagcctgctctccttcaatgagcttgtgctctgtacttcctcagttactcactccaatgttcagtccatgagttcgtcattaccaatagttgtaactcccaacaatttcagtttaaaatatctcattcttaaaccatcatttcctgtctctagaacccttttctttagtactcttgactccagtaattctttgaccatctcaggatattcaacctattgattctaacatgttttcactgtccctcaccctcctcatgtcagaacatgacaggccacaggcaggctatggattctaaaagatatcgtgaatgctaaaagtgctggaagattaaggataccctgagaattgtcatggataatgataatccagtgatactaaaacatatctagacaattaaccagaataatgaaggtttagaattattccctgtggcacaggtagagcagctgaggaaatggagatctcattcgagagaccaaacagctcagaggttctggagcagctaattccaatctctgaacactgtcatgcagttctaaagagtgtggctggatcctagtcagggaagatactggaaggtagagttcagctcaaactaagagaaaatgaaaggtacttttcttctcatactacaactacaattcaattgtatagctgaaatgctgtattgagaaggtttctgagaatgggttctcagtcaccattgtctcagtcagattgggttagattatactctgggaacaaagaactcttaatcctcagtaatgtaaaacagcaaaggtttatttttcactcactgtacatgtctgtgtgcattgtcaggaggctctgctcatctcattccctctgtgatccagaaagatggagtggtcaccatctcaaatgttcccattttacatgctagagggaaatagaacgtggggggttaaagtgtgtgtgtcacaaactgataatgaaatgttccagcctggaagtgacttatattatatctactcaaaaactcattggccagaactagtcagaaagactcacccaactataaggaggatggggagtgcaaatctacaatgaacaacataatgagcaccagaagcagtggcatgagcagtggttgacctcctgggtctagacaaggcattctagcatttgtcttgctactcctcatccctgccctaatcaccagagctgccctgcaaagccttacaatgtagtgagctccctaacaccagagtgttgcaagcaaaagttaaaggagtgcaggttaatgacaccatagaggctattcctttatctagtagactaatggtctacctggatctacacgagtctcttaccactctgaaataaacagaactaggaattatggaatactttgctaagtgtaccagatatttggagaaaaattaccagttctcaggccagctaaacaaccaagcaatggggtgaattttgctcatttaaaacggagagaaacataggctgaccattatagtcccatcattgctccttttcccgcaggagggcaaagcacattaactctctccccagcaagagacaatgatcagaagaatcaacataaagtgagggaaaggatttttattgaaaaagctgctatagcaaagtttgtggtgctaaatatttctttataaaaaccagcacttgactatcagcctccctattcagctacagacaggacagcaaatggttgggtgagaaaatgcactgctattcacccaagactgttaggctaatcagcaatggaaaaaacatctgaaaacacctgataaaagggcaaatatgctgtaaggctctcgcgcgctctctctctctctctctcactcacacacacacgtgacagattttaaaaatcaacatctgaatgcagccttcagttgtcaaaagctttctttatgattcctatttaatccacaaaattcagggaggttagaattactattataaatgatattttcagataaataaattcagattcaaaaagattaatttgattcactttgtgtccaagtgggtctacatctgtagtacacaggaaagcaccttgaatggatgtgtgacaaaaactgacttcttaatctttcaaagctgacctcatcacaccaccactacttgctggggctggtgacagaacgtcgggcttgagggaccacagttcctgtaatatacggtgcttcttacatgctcagggaaatcatttatcattgacattctacagtaagtgaaatttccacccaccacagaattcattttatttttcatattgtcaaatgacataaaataattttctctggtttctgctgctaaaatgtccttatagtggagcttataataacccaagaggaagcaagcatgataggataactaatgagttttccacataagagtcaacctctaaacacactagaaaatcagccaaaccagctggagataaaatggctgaatggctgattgaatcatgtattcctcactggtccagttgagaagggcttctgggtacatctcctttttactttctgcctgcctttacctcttttctccccaagttaaaatcattagaggctcttctcaacctccaattttgaggctagtgtaatccttaatagaaggagaggtaagcatcccctgatcaattacaagaggtctatacctcaacacggccttcctgtgacgccagttaccctgtccaaacactgaagttgcacattggctcagaaactggattcctttctttttctgttccttatttctttctgctcaccccctcccttctccctttctttctttttaattaaatgagtaaaacatgaacacattcttattgttaacaaaattggattaggaataattactgtctggcatggccatgtgttgacagagatctggaaccattatgaactgctgtgggagcatcaccacattgacagaattttggtactacctagtaaagtagagatgtatacacctgctacccactcctaggcacagaacctaaagaaactcacacatgtacccaagatgacattattatttatggactcattttctataattgcaaaacactggaaattatctaaatattcattaatagaataatcaaaaaataaactatagtcataaaattgactgctacataggagtaaaaaagtttaaataaactaaacatatcaatattgatacatttcgcacatataatgagtttctgaaaagcaagcattctccttgaaaaccggcccaagacaaggatgccttgtctcaccactcccatgcaacataatattggaagtcctagccagagcaatcaggcaagacaaagaaataaagaacatccaaataggaagagagaaagtcaaactatctctatttgtagacaacatgattctatatctagaaaaccccacagtctcagcccaacagctccttcagctgatcaacaacttcagcaaagtttcaggatacaaaatcaatgtaaaaaatcgcgccactgcactccagcctgggcgacagagcgagactccgtctcaaaaaaaaaaaaaaaaaaaaaaacaaaatcaatgtaaaaaatcattaacattcctatataccaacaacagccacgccgagagccaaatcagaaaggctatttcattcacaattgccacaaaaagaataaaataccaggaatattacttaccatggaagtgaaagatctctgcaatgagaattacaaaacacttctcaaagaaatcagagaaggcgtaacaaatgaaaaaacatcccatgtgcgtggatagaaaaaaatcaatataaaaatggctatactgtccaaagcagtttacagattcaatgctctttctatcaaactcccaatgatattcttcacagaactagaaaaaaactattttaaaatttatatggaaccaataaagagctctaatagccaaggcaatcctaagcaaaaaacaacgaagctgaaggcatcatgttacctgacttcaaactccactacagggctacagtaaccaaaacagcatgatactggtacaaaaacaggcacctagaccaatggaatagaatagagagccctgaaataaggctgcacatctgtgaccatctgatctttgacaaagctgacaaaaataagcaatggggaaaagactccctattcaataaagggtgctgggatcactagctagccatatgcagaagattgaagctggactgctttcttgtaccacatacaaaaatcagctcaagatggattagaggcttaaatgtaaaacccaaaactataacaaacatggaagacaagctaggcaataccatcctggacaaaggaatgggcaaagatttcatgacaaagaccaaaagcaaacacaacaaaagcaaaaattgacaactgggatctaattaaacttaagagcttctgcacaacaatgacaaaaaactatcaacagagtaaacagacaacctacagaatgggagaaaataatttgcaaactatgtatctgacagaggtccaatatccaacatttaaaaggaacttaaatttacaagagaaaaacaaccctattaaaaagtgggcaaaggacagggccatccattttccaaaaaaagacatacatgttgccaacatgcatatggaaaagaagctcaatatcactgaccattagggaaatgcaaattaaaaccacaatgatatactatctcacatcagtcacaatggctattagtaaaaaatcaaaaaataacagaggctggtgaggttgcagagaaaggggaacacttgtgcactgttggtgggagtgtaaattagttcaaccattgtggaaagcagtatagtgattccgcaaagagctaaaagcagaactaccattcgacccagcaatcccattactgagtatatgcccaggcgaatataaatcattctaccataaagacacatgcacacgaatgttcattgcagcaccattcataatagcaaagacatggaatcaacctaaatgcccatcaatgacagactggataaagaaaatgtggtacatatacaccatagaatactatgcagcctatataaataataagatcacgtcttttgcaggaaaatggatggagctggaggctattatactcagcaaactaacccagcaacagaaaaccaaatactgcctgttcttacttacaagtgagagctaaatgatgagaacttatgaacacaaagaaggaaacaaaagacactggggtctacttgagggtggagggtgagaggagggaggagagcagaaaagataactattgggtgctgggtttaatttctgggtgatgaaataatctgtacaacaaactcccatgacatgagtttacctatgtaacaaaccttcacatgtacccctgaacctaaaataaaagttaaaaaaagtaaatacgtaaaataaaaaggcaagttgtcaaatgatatatgaagtatgttatttatataaaatatgaaatataaaatatactaaatatcattttgtaatacatgcttaatgtactaaaaagtattaagcaaatgcaacagaatgataagactacaaattctgggagacaattacctctgtgaggcgaagtgaggggatgcacacaaggaggggtaaactgtatttgtcgtgctttgtttcctaaactggatgatgcagatttgttctgttgtgcagtgttattttcttagtctgaactattttgcaataaattataaacactctaggaaaaaaaattcaaatatttcagtaaacttaaacctcattttgaccaccacccagcacctagtcctaggcatcctgaagagttatctactgttagttattagttcttttccactcaatataaatagcattgtttgaacaaaggtatctctttcctttttatataaacgataatctaacatgcatactttcaatgaacatcatgtcttaaccatataaatgcacttccctcttcaacaataacgaattttcctggaacttaagcattttctttttgaggcagacggtataatcgctaaaagcacagtctttagagacaaactgcctgaattcttcaaatcctggagtcaatacaatatttacccagggcaagttattttctgtgcttcgggtgtcttatctataaaactgataatcacaatacctacgtcttaggattgtttgaggattccatgagtaaagtcatgtaaaacactcagagaagtggctggaacatagtaaggccttgataaatattatttgtagctacagtctttgctataacatattggaaagggcccttacaatggtgtccttacaccaagtccaacttatggctactctagaaaaatcaggatgttcttttgcccacttctcctaattatgctgagctttggaaatcagtcatccttcagaaactctatagaacctgtagcaatgcccagtcttttgatttctgcacactaagttctatttgtccaaattccaggcattgttttcttataggagaatttcttcaagtcactcatagctgtcagtttctgccaatttaatttggcaattaaggaactgtacataagtgtttatatgtcaccgttctttctttaagttgagcctgggggcacagccaatgtttcttttttcacattcatgctaataatacgttggttgagttgcacatagcatatgtaaatttttggcaatttatttttctcatagttctcagagtttgcttcaaatttatcacatcatctacgttatacttgcagttagtctacttctcacctaatatcaaattttggatttgcgtaattccctacgttaagagagattaaaaacaaaaattttagagtcagccagacctgagttcaaatcctagctctgccatgggttaggcatgtggcccaagtaaacatattagttttctatagatagataacaatttactgcaaagttagcagtttaatataacacccattcattatctcacagtctgggcatggtgactggattctctgctcaactctaaaattaagatgtaggtagggatcactgctgatctcatctggagctcaggattcccttttcagctcacatgattgtgggcataattcactgtcttgcagttgtaggactaaagaccccattctcttgctgctgtcagctgaggtaacttgcagctccagcagcagcccacattccttgacacatggtctcctccatcttcaaagccagcaagagatttttcccacatatcaaatcactctcaaattcacatcgctgatttctgcatctctttcctctggactcagatttaaagggctcatctgattgggtctggcctacctggataattttcctattttaaggtcagctgattttggaaccttaatattacaagccaaattcctttacatcagtacctaggtgagtgttttattgaataccaaggagaaggagtatgtatgtactccagggagcaggatatcttgggggacagcttacatttttgccactcacaacaagacatattggctttgcaatcctcagctataaaatgggaacaatggtgctcactgcagagaaaaagtcaattagatacagtgaaacaaaaaaagcttccaagtactgattatgctcaggattaggctgcctgttttcattacttcattgtcccagtaatctttttcccccagttttactgagatacaactgatatgcaaaatctctacataattaatgtatacttggtgagtttgaacatgtttacactcatgtcgccatcactataatccaggaaataaatgtatccatcatgccaaaattccccctttttactctaatgagagctatcctattaaccaatgagtaagtgcactgtatcttattgttaactgcaggcactattttgtacagacctctagaacttactcatcttgtataactaacattatatctattgaataacaactcccttggtaaccatcattttattatctacttctatacctttgactgttttagatgcctcatttaaaacgaaacatacaatatttgtctttccgtgaccgacttatgtcgcttaacataatgtcttccaggtttatacatgttgccacaaatgttaggtttttcttctttttcaaggctaaataatattcaactttatgtgtttaacacattttctttgcctattcattcatctgttgatagacatttgggttattttggctactctgaatattgttgccatgaacatgggagtgcggatatctctttgagaccctgatttcaattctttgggttatatagccagaattgagattgctagatcatgtggtaattctatttttgattttttgaggaccctccatactgttttccatggcagcagtaccgttttacattttaaagggttcctgtttctccacaacctcaccaacatttgctgtctttttttttttaataatagccatcctatcaggtgtgaggtgatatctcaatgtttttgatttgcattgccctgatgattagtgatagtaagcatctcttttgtttgtcatttgtatgttttctttggagaagtgtctattcagatcttttctccatttttaaatcaggttatttgatttttttgctattgagttgtaggagttctttatatgttttggaaattaatgcattatcagaaatatggctagcaactattttctctcatttcataggtcgccttttcactctgatgtttcctttgctgttcagaagtgttttcgtttaatgtagctctacttataatttttgcttctgttgccagtttttgggtgccatatccaagaaattattactgagatcaatgacaagaagcttttcccctctgttttcttccaggcattttatggatttagatcttatgttcaaatctgtaattcattttcagttaatttttgtgtatgatgaatgacacaattttattactttggatgtggatatacagttttccccccaaaaaattattgaagagactgtccttcccttattatgtattatcagcatccttattgaagattaattgaccgtatatgtgtgggtttacttatgagcctactattctgttccattgatctatatgtctatttttatgccagtctcaaactgtgtaaattactgtagctttgtaatatattctcaaatcagaaattttggtagctccagctttgttcttactattcaaaattgtcttgactatttaaggtcttttgcagttgcatgaaaatttaagaattgttttatttataattataaaaatgtttttaagatttagctagggattacattgaatctgtaagttactgtgggtagtgtagacattttcacatagaatgtatttttgggaaaagcacacaaaatccacatttttatctaatttctttcatcagtattttataattttaagcattcaaatgagtctttcacctccttagttaggtttattcctaggtattttattctttttgatcctattgtaaatgagactgttttcttgacttttttttggatagtacattgttaaagaatagatatgcaactcactttcgtgtgttggttttgtattcttcagctatactttgtagcctgaattagtttattagttctaaccttttttatatttttagagtctttagggttttatacatataagatcatgtcattccagagtctttttttataatttcaaatttgatttaagatgcaaggggtacatgtgtgggtttgttacgtgggtatattgtgtgatgctgaggtttggggtaggattgatctcattaccctgatattgagcatattacccaatagttagtttttcaaccttgtcctccttcatccccccttcatccctccctcctctagtggtccccagtgtctattgccatcttcatgtccacaagtacccagtgtttaactgccacttagatgtgagaacatgcagttttctgttcctctgttaatttgctttggattatggcctctagcccagcagcccttttaaaatgagcccaatacagagtctcctttggtgactgatgctgattaggtctccaataattattctttatataaaagaatggtgcaattgtgaatgggagttcactcatgatttggctctctgtctgttgttggtgtataagaatacttgtgatttttgtacgttgattttgtatcctgagactttgctgaagttgcttatcagcttaaggagattttgggctgagacaacggggttttatagatatacaatcatgtcgtctgcaaacagggacaatttgacttcctcttttcctaattgaataccctttatttccttctcctgcctaattgccctggccagaacttccaacactatgttgaatagcagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctgttgagataatcatgtggtttttgtctttggttctgtttatatgctggattacatttattgatttgcatatattgaaccagccttgcatcccagggatgaagcccacttgggggaggggggagggatagcattgggagatatacctaatgctagatgatgagttagtgggtgcagcgcactagcatggcacatgtatacatatgtaactaacctgcacattgtgcacatgtaccctaaaacttaaagtataataataataataataaataaagttaatttgatattttgcagaaaaaaaaagaatgatgcaaaggctaataatactcatattttacagatgaagaaactgggacttaaagataatatctaaaagcagttatcatagttacagcctctggcaaatagaaaacactcattaatactaattgccatcatcatcatcatcatcatcatcatcatcatcatcattattatcatcattttatattaaaaagaagaaacacaaaagtgtccagtagcacctaccacacacccactcctaatctgggccatgtaaaaactgtggagatgatgagtcctttgcaaggcatttccggggagctcctgttccctgggaagctgcctggtcatttttcggctgcttttttaataccccaaggagggctgtggttgaagctctagtcctggaactgacaacaccagaatccagaatctcccagtttcttaataccaacttgatggtggaatttgcattgtctagtgcaaaatgcagcccttttaacatttacatttgatctttatcttctggttatacagattacttcatctaattttacctgttatttgttttaaagcttttcaccccatcttacccaacttttagtggagaaaggtaatactcaaaagctctctcaattcttataacagcatataaaacatttcatgctcattaaactaacacccttcattctctcattcttttcaaatgtcaatccttaagtgacataaataaggttagcaaaaccttctaagagattttagactttatctagtacaaacaccttattttactatggagaaactggagctttcccccaaaaaaggattttcttaaggtaatcagctggtggcagagccaggactagacagatggacatcaggagtccagtcacccagtgccacacaccttccaattacatgactccacttggtgcctagtttatgacctccaaagctctgcttagtgactactttcattttctctgtgtatttatatataaaaaaactcaaaggagaaattacaaagtaaaaatagctcattataacttaacagtacccctaagcaatcagacattctgtaacaattcaatggccaggctgtcctattaggtactgcagacactgataactaccttcccaatagccattctctcctacttcctaggtgacagaccccagttttgtttgggggcaccaatatgcccaactccatcaagctactctctttttcaacctccctggctgccaggagcaacaagatatagtttgggccaaggagttacaggcagaagctgagtaagcatttggggaagacttgtttttctgagtaaatgaataaagattgctggcatcacatcttcccttttcttctctttgaaccaaaattgatatctagagcaacagtagccacctggaagccatacacagagacaacaaaatggaaggctagaggtacgggtcattgatatcactggctggctgcaccagacctgaactattaattactgagtatcttttcagtaaaagaaacaataactcagaaagcaacatggtatagaacctaaaagcactgcctgggagtgacagacttgggtgtgagtcctggctagctgcctgaccttgaaaaagttacctaacttcactgaatgccagttttcccaattcacaggattgatttaaacattaaataaaagaatgcatataaaatgcttaaaatggcacattgcaagccctcagtatatggtagcctggttcaatgtaggaatctctctctgcaattatctgattattatccattgtttatccagggaatgtatgcagaattgatctcattggtcagcaaacaacatgtattacactcacaactttatatgtagattggtcatggaaggcacaaattaccaaaataaaactaatgaatattcatcaaagattgccttagaatcctagaacgctaaagctagaaagatagcttaaccttcatccaataaatatttgctgagtgccaaatatatgttcagaaccatgctagtcactgttgatatatgaatatatcattgaagtaagattcctgttctcacgggatttatcttatagtgggggcatttcctaatgtatatctaatatgaccatctcaatcacagctgaagaaactgaagcccagagatgttaaatgacttgcaggcatacctaggtcacacagcagttaatggcagatgttggagtaaaattcaagcctcttgactcctattgggttggtcttttgtctatatcctgaaattcctgatttacatttttgtataccgtcagaaagtattccttgctgtccaccaggatgactgagatagaaaatctgatccctgagtttccttcatttcctaccactctctcatttccctatgctccacgaagtatagtcttggtgtgatttcctcaaacatgtcaaacttgctccttttacaagactcttacttctggttggccttcatccctagttttatttgtatggcattcattcaccatttcagcctcagcttgagggccatttgttttgactgtcccttaaaatgtatcattatcattctctacctcactcaccatttctttcagctcatatatataaccagctgaaattaacttactaactttttttccacatgtttgttgttgggctgcatgagggcagacaccttatctgccttgctcactgctgcattccagaggccagaacaatgcctgcaaccagagctggtacccaataactacttgtcaaaagaacattgggtgatgctgttagctctagaattctaggctcctgagacaatctttgtctgataaatatttgtgagctatacttggcaatctatgttgaacaaatgaatgaataaatcctggagccattttgtatttagctttataagatactagatcctgaaaagatcctgaagcaaagttactcgaaccctttaatgtaaaacaggagtatattagtccattttcacacaaggcacttcttacatggcggcaggagacagagagagagcgaaggggaaactgccacttttaaaccatcagatcttgtgagaattccctcactatcacaagaacagcataggggaaaccacttccaggatcgcatcacctcccatcaggtccctccctcgacatgtgggggttacaattagagatgagatttgggtggggatagagccaaaccatatcaaggaggaaagtgaagttgagtacttgccttgagatctaattgactgaattaactgatgtgtagacagggcgaagttgggggtaaaatctatccatggctacctctctaaaaatctagaataatagtgaatgagatagcaactgatgatttgactatgagatggtccaacttctctcacccactcctttactctctgctgccctaatcctcttaaacctcataggatgcatgcctgaaattccatcacagattttctttttcttttatctggggctgcactctgatggccctgggcagcacagtgtttctgaaacacttgcatgtggatgcctctaggtgaggcagacactctccagctcccctgaacccccactgctccctattgtctcacctctggctgctttagaaacttatcgtacctgctggacctctggaaccacgtttgttttagggctaaagtgcaatttcttcagctgctatcaatagattacatttgaccatgagtaaatgacccagggctaattttgttgcatggaggacaatatcttgaagatatttatagtcgcatagggtatcagaggtaaaagaaatttagacatagtcttttctcacctttttcacttgagaatgaagaaacaggcttaggaaaggtagatgacttgcttaaggtcacacagcaagttagtggcagatctggtactgaaatttagacttggtgaccaaagtggtctggcacagagcaaggatgctttgaagtacttgggcggagggttgggggggtggtgaaagaaagctgggatggctggtggtggaatttagaacatcttcaagattctgcctgggctgagcccacctttctcaggcttttcctcccagtagaactctggaaggtaggatacttgctcctcccatgtaatgatacacttgtgccttcatcctccttcactaatttgtgtctgtatcttttctgtcactttatataactaattactgtttactctttccaagcagggtgtgtggggatccaaactgtgggagagaatggtgttactttggggaagcctttgcagaaacaagacagtctggaagaaagggaaactccagctgcagaattttcttctcttttcttgctgtggccccatcctcccacctggctctaggggaaagtcctatttaaaagtgagagttagtaacttagcatctttcagcagatatcacagttgcctctggcacagcctcttgcaccctcgtacttcctctcctggctgtgcctgcctcagcatggggataactgactgccctcagttttcctcaccctgctactagatttgtagctggatttggggacctctgaaggaattttaaccacatagggaagcggtatgatcaagtggaagaaatgaaaacaccaaggctcgtaagattgagatctaatcctgctctgccaccaaccagctgagtctcccctgctgaaccatcagtcagctctgtggttgcaagaccgatagacttttctcagcactggtctcatttaatctctgcaacacttgcattgttgaccaacctctttaacaatttttaaaacaatttctaattctgaaatgttccaaaaagtacagaaaatattacataatgttgagcaaacaaaccgtacaatcagacctgagcaatgattatgagaaaaagctcaggtggccaaaggttaaattctgggagggtcttagacttggggaatggagaagaaccagggggaagaaaaagcctttactgctttgctccctctccccagaagttatcactacactaaaagtcagtgtatatcattcacagtaggttttaattcttttttttttttttttttttttttgagatggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagggttttaattcttttattataaatgtataataaatatacaaatatgtgtaatatatataaataatacacaaatattatggtcaaaatatactattttaaatgtttttatgttttctgtatgtttacgtttatgtgaatgatggtatccttttgaaagctgcttttttattcaatgccattcttttgagattgtctatagtatatgtatacactgagtccatcttaatcgatactccactatatgaataacccacaatctatttttttctcctataagagatagataatttgcttctactattttgctaccacaagcaatctgcaataaacatacctgtgcacaagttcgagtttttctaggtcaaaaatctagaagggggcttgctaagttattaggtatgtattcattttaaggttcttcagaatagttataccaaaattctgctaaatacttagatgaaaattctgccgaattgctcttcaaaataattataccattgaactctcccttgaataagagtttctgtttcctgacattctgccagcccttgttgtctttgatttataaagttttgccaatatgatgagtatcaaatggcatctcattgtgctagcatttccctattttcttgtgagatcacatagcttttcatttattgtattgaccactcagttttcttcctctaggaattgtcttgtttctcattttctggttgggttgtttggtgttttctcttagtgttttgtaagaaattttatatcttggcttgtaatactttatctgttacatggtttacaaataatttctgtagttggcttttttcactttgttttgggcatattttgccatacagaagatttaattttattttcccccagctttatggagatatactttacaaaaatatataatatatatgtatttatggcatacaatatgtgatattttaatatacatacacatttttaaaaaattaaatcaatctaattaatatgccacctcacaaacatcatctttttggtgttgggaacatatgagatctactctttcagcaatttttaagtatacaatccactattattaatcgtagtcaccatgctgtctagtagaactccagaagtatttatttatcctgtctaacaaactttgtaccctttgcccaacatctctcctttccccagcactccctaatccttggcaaccaccatttcactctctgcttctatgagtttaactttcagaagctttaattttaatatagtcaaagaaaacaatatttcattgttggattacaatttttgtgttttgttgaagatgttctgcctaccataatgccatacgagaaacttctaacacccctgtaattgaaaatggtattcttcctccctcaacccaggattttagttctaccttgtttttattattctaaatgactggtattattattttcttttttcttttcttttttttttttttttttttttttttttgagacagagttttgctcttgttgcccaggctggagtgcaatggcgtgatcttggctcaccacaacctccacctcccggtttcaaggattccctgcctcagcctcccatatagctgggattataggcatgcgccaccatgcttggctaattttggatttttaatagagacggggttggtattatttttattttatttttacagaacagcagagcaaatactttctcagcgctacccacatgttcattaaatttttggggtatatcacttcttgaattatatttctactttctggtttaatttcctttttcctaaactccatccttcatacttaagtgagagactctatgtaaatgctcttagtcttgtttaaaaacgtatttgtttcaacattgatgttgaaatatttttctttatagatgatacgtagtgtacaaatattttctcccattctcccaaaaggttatctgtttattctgtgtatagtttttttttttcctgtgaagaaactcaagtttaattacataccacttgtcaatttttgcttttgttgcatttgcttttggggtctttgtcatgaaatctttgcctgttcctatgtccaggacgtattgcctggcttggcttccagggtttttacagttttgggttttacatttaagtctttaatccatattgagttgatttttgtatatggtgtaaggaaggggtccagcttcaatcttctgcgtatggctagccagttattccagcaccatttgttgaatggggagtcttttacccattgcttgtttttgtcagctttgtcaaatatcatatggtcatagatgtgcagccttatttctgggctctctattatgttccattggtccatgtgcatgtttttgtatcagtactattttgttttggttactgtagccttgtagcatagtttgaagtgagtaacattacgcctccatctttgttctttttgctaagaatttccttggctattagggctcttttttggttccatatgaattttaaaataggtttttttaatacttctataaagaattgtcattagtaatttgacagaaataacattgaatctgtaaatggctttgggcagtatagtcattttagtgatactgattcttcctatccatgagcatgagatgtttttccatttgtttgtgtcatctctgatttctttcagaagtgttttgtaattcttattgcagagatctttcacctccatggttatgtgtatttctaggtattttattctttttgtggcagttgtaaatgggattgcctttatcgcctcattaaaaagtgggcaaagaatgtgaacagacactttacaaaaggagacaaacatgctgccaacaagcatatgaacaatactcagtatcactgataattagagaaatgcaaatcaaaaccacaataagatatcatctcacaccagtcacaatagctattactaaaaagtaaaaaataacagatgctgcaaggttgcagagaaaagggaacacttatacactgctggagggagtgtaaattagttttgccattgtggaaagcagtatggtgattcttcaaagagctaaaagcagaactaccatttgacccagcaatcccattactgcagcactattcacaatagcagaagacatggaaacaactgaaatgtcatcaatggcagattagataaagaaaatgtggtacagatactccatggaatactgtgcagccacgtaaaagaatgagatcgtgtcttctgtgggaacatggataaagctggaggccattatccttagtaaactaacataggaacaaaaaatcaaataacatgttctcactgacaagtgggagctaaatgataactacttatgaatacaaagaaggaaacaacaaacactggaatctacttgagggtggagggtgagaggagggagaggacaagaaaagattactattgggtactgggcttaattactaggtgatgaaataatctgtacaacaaactcccatgccccatatgtttacctatgtaacaaaacttcacatgtacccctgaacctaaaataagagttaaaaaaagaaatttttttttactgagaatagatgcctaaactaataattatatcctctcagctctctaaggataaaagccccatgtcttctagtctgtactgttgctgaaaatttgctgttgctctgcaaataagcagactcttccctctaataatattttgtcttctatgtctttgatatcatgcagcttcaccaatatttttatatatgaatttactttcattttttctacttaggactcattgttattattatatattaatattcatgtacttcatttattctgaaaaaattccagccatcattttttgaatattgcctttccccaattcatcctatttgatttttgtgtctcatacgaaatataaactaatttattttcctctgtgccctatgtcctttaaaatttcagatattatttatctctgtactaccactttgctaatttcctcacttcagtcttttagttcattaattctgccttcaactattgtttacgtaatgttttattttcctttgacaattttaaattttgattactatgtttttctctttagaagctgtatttggctacattggtttattcttcatcataatgtctcatggctgtcttatggtttcaatttattctattgtttattaattttaaacaattatgttgtaatctctcaaactggtatgcaatctgaagtacttatagttaaaatttttctgcttttgggtcctctgattctgactcaaagcagcttttactcccatatagttttccatttttggttgtgagttcctctttcatgggacttttcctgtgagaattctggacaactttggttcagtgtgtgtcccttcagaggagtatcaagttttcttccggcaggagacctgccagggcaaatttcatgatattttcttggcttgtgagttctcagatcaatgacagtagtataaatttgaaccacacatattcattacaaaatggaacttttcatcatttgttctcaaagctactctttctctgattttgttccagtcagctaaccaagaaggaaacacagcatcatcattaatgtctcatattttcttactccctaatccaaatatgtgactcctgtggcttctatctcattactttttctgaaatgcctcaatttctctccacctttaatgtaattaacttaattctttgatctcatacctgaaataaaccttctaattactgcttctgccacaagacttaaccttccctgattcattacaccacagctgaattgatattttaaaaattcaaatctaatcctgtcattctatggcttaaaaattattactgcacctccatcactttcaaaataaaaataaaaccttgaattctaagatgaaattcaagtttattggcaatctgagctctgtttttggcttttatctcttgcaaatttctcttgaatgcctttatacaaatgaccaatgcttcaaccatactaaattttcaatgtgttcaaattcccagaatatttttatatgctagagaaatcaatgtgttgatccataaaatccagatgaaagcttctcagcatgaattattgtcacatcttttctgatgacaaaaattgttattctttattatacgtcattatactaagcatatttactatgcttcgtagtgaaagtatattaaattgtagtcagcaacaatattcttctttttaggaattgcattcatttgtttatatttcagtagcagtataacatatattcctaataatatgacagtgtatgcgtttaaacatattgtcaatgacaaatataataatagaattctcacagacaggtaaatgcttgtcttaagtgagttcttaaaggcgaactgagttgttagataatacggttagaaattataagaataaaaagttgagatcaataagttcttttctggctcataattttacaattctgggtttcgtgtgtgtgtgtgtgtgtgtgtgtgtgtaaagttacctaattgacattacagtaagtgtaattcattgggaaaagcaataaaataataaaatattatagctgaaagtgaccttaaagataatttagttcaatagtttctgaaatatgttactagccagaacattgcttccaaagaaaaattttgaaatccaacatgtgagacaggtacatgtgggcctcccctgacttcatttagagactttaatactgcagccctatgcacaagtaatccttccttctcctatctacccgcaacaccgaggttacacagaactaagtttaaaaatcactgatctaccgcaacccagtcactgttcaaatgaaaaactggaagcccagagacccaatgatgtattcaaggtcaattagccatggacaaggctggctttaaccctaatcttgtaagtctccatgaagttctatggctatgactcttattttttacaataagttcaacccaatctcagaaagccaatagaatttctcatttctcatatcccataaatagattaatgttttaatgtaacaagttttcccatgtatttactccctagaagctttgacataagaaatagttgctcattgcagaaaatttcaaaaataaagaaaaacaaacacataaaagatagaaatcttcagaaatctctgctggaagaaataaccattgttatacttttttctctgaaaacagtttttttttttttaaccaaatgggattatacaaggtgtatcagtgagcatttctaactgcaaatagcaaaatcctctttagctaatacagacagaaaagacatgtattaaaggatattaggcagttctagaatctctagcaagatcagagagtcagtgttgaagtcaatccaaccagaaaataatactcaaacattacaggacttctccagagaaaattctagcaccaccacgaccaatggacacagatgccccagctcacactctagaatgtggtgtaggcccaagatccaacaccagcccaaagtgagattctccactgcctcccaaaaattacaaaagaaattttcccatgtcatctgcttcatcccattttcctctcttcttgacgagactgatagcacccaggacacaggacacatctacccaccaggagcaaatcatgccccaaacatgagaagggtgtgcaaagatcccacaatgcaatgacataacatttgtaacaggaaaagtcttcatatatttgtgttcttttaatttatatattatattaattattggcctgacaagattgatacattgaccattatatgcaaatcatcttgccgtaagcaatttgtattgattccaaatataatgaataattcaatttatcctttcctttttcttgtcctccaaaaaagtattttaaaaatcttttccaatttaaatgatataaattataaaaatgatgcaacccatttataaggacaaaaatccataaaattttgggccgcatgaggagttagtgtagtgacacacttatttactccaatgactaataattattgcaacatcatgtttttatctctccaacttagttaaaagtatcgtacagatgatcagttgcttcagacaccaatcagcatcccacggacttccgatcaaagactgtggctgcaaatcaattgcagcatatggcgtttgtgcttctattacccagagcagtagctgaggacatagtaattaagcaaatgctaatgagaagtctaaaatattcacaaatgtatgaatgtatggattatagttatttggcaccaattttaagtaacaagcacaatctgtgtcaaaatgcacttgtgaaagtcttagtatgtgccgataatatcttactactagtctctgaatgtgtccaggaaatctatttttacaaatttaaatgttgcaattatcactacctcactaataaataatcctgattcatcttccagaagcaaacctcaaatttggttactctccaacttcaactctggataggctctcattgtttattctttaaagttcacagttcttacccaagcattcaaagctctctattaactcacctcaagcaactttttcatgtattatccccccattcccgttgtctctagctcagcgtttcccaatgctggcattttgggggctggggctggctttttttggagagctgatcagtgcatattagaatgtttcacagcatcctgacctctaaccattaaatgtcagaagcatcaccacccccttctgctgcgacaaccaaaaacatctctagacattgccaaatgtcccctggtggtggagggaggggggtgggaggtgccccagttgagaagtactgctctagcaaaactgaattactcattcttcctacacaaactctgatttttcctgcctccatgtccatctttcattcattctgcatatattttactgaacattgactctatgaaaagcactctaccaggtgctaaaagttcagtagtgaacaagatggctatggccctgactttgtgtagctaatagccttatgaaataagccagatcaagtgtaataagccaagaaggcagagagttgagtaagcagcccctgaagaggtagagtgaaaagtgctgagagcagaagcctccactcacctgagtaggacatcctttccagaactcagtgtatacaaattctacccaccccctgaagcccagctcagatgctggctttattcagccttctctgatagcttcatatagaagtaatctcctatcctctgcatagccagagcagacattctctatggtacttggcaccctgctctgtattggttattattcatggccccattattgcatacatctctgactacatgaacctcttatgtataggatgcatgtcatattcatttctgatttatccacaagaaactcagttctttacacaaaaagaaaagctaaattcacatctactacaggctccaaccagggtcttttccaaagggcagtgagggtaatgtgtttaaaatgccatacatcaccttagaacccaagttgaaacagtttctcatcactcttgggattaagaacaaagccttgaatgtagctaccaaagtccctaatgcctgtctcattcttcttcttactccttacctcttaccactgtgccctttactgtctgtgttccagccatattcactccttttcaattgcttcaaggtgccatgatctctcctaaagcagggcctttgcactgctcttttcactgcctagaatgctccccaaccactgtctagcctctgcatcgcacctttcaactgtcactttcctacatagccttatctgaccctccagccaacatgtggttttttggaaacatgttaaagaatcaatttcttttcctgcataagttatttagcctatattatatccttgcctctatgattgataaaggcttatcgccttcactatatcaccagatcagtgagaacaagtacctcctacactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacttaagtagccatcagtgaactctgagggaagattctgggattaagaggaaagagtaggaccataaaaagggtatgtgcacaggagagtcagaagaaatgaggaggagctgagggaaggacagactgatttgggggaggttggtggtaaagaaatgagacagaaaagtgatgctcagaaggccagtagttgaggccaggcacagtggctcatgcctgtaatcacagtacttcaggaggctgaggcaggcagatcacctgaggtcaggagtttgagaccagccttgtcaacatggtcaaaccccatctctactaaaaatacaaaaattagccaggtgtgatggcacacgcctgagtcccaggtactaaggagtctaaggtactaaggcaagagaaacacttgaacccgggagatggaggttgcagtgagccaagatcttaccactgcactccagcctgggtgacagagtgagactctgtctaaaaaaaaaataaaaaaagccagtagttgagatcagaaaaagtaaaatcagtgaaggttagtggtcagtaagaaagaccttcaagccatgaagtctagcactttaaaaagtgtcttggaacacagtaggtactaaataaatatttattgagtaaattctgaccaaataatcttctacttaaagtaaatctactttttagtattgtgtcagacttatttgtaattgcctgactactagccttccttccgctaacaaaattcatgttgaaagaatggctggtgagctatctggagttgtaagacacagactttaaaataactagttaacatgttcaagaaaatagacgataagatggacagaatttcacaagtagattttaaaatattttaaaatcaatgtaaattctagaattttaaaatacaattattgaaattaagtaagttaattgattaatgtaacagcaggatatgaattacaggacatagataaagagaacattaaaaaacaggaagatagtcaagtagaaaaacacactgactagataatagagataaaaaagaatggaatacaacaaaaggaaagtatagccgatagatgagatacattgaaatggtgcaaggtatatgcaattggtagtccacaagatgcagagaaggaaagggcaaaagcagagtttgaagaaatttctgaaattgctgaaacacatcaaatcacaaatcaagaaatattatgaccgcaaccaagatcaatacaaagtaaaagtaagcctaggcacaaaataaaaagaaaaatctgcttaaaactccaatgtaaatagaaaattttaaaagcagcttgggaggtggggaggaaatagacacatttcttcaaagaaaagacatctgacttttcagcagtaagtatggaagtcaaacacaatggaatgaacaattcacaatactgaaagaaaacaatactgtcaacctggacattttatatccattgaaattatccttcaaaagtgaaaaaaaatgaaaacactttaaggcaaataaaaacagaatttgtcatcatatctagtactggtaaattttaagagttctctttacgaagaaaaatgatcccagagaaaaacatgggaatgcaaacagaaatgaaaaacaatggaaagggaaaatatataagtaaattcaaattatttattactatacaaacaatatattatgttttttgcagtttaaaacatacctagatttaatatgcaaaacatctaagaaaggaaggagataaatggagtcagagtgtttccttagcattgtctgagaaatggtaaaagtaaaaagttatattaagctaataacataagcatattttaatctctataataaccattaaggaatatacttctaacaaatcaataaaggagaaaaagcaataataaaagacaaattggaatgtacttctaacaaatcaataaaggagaaaaagcaataataaaagacaaatttttagtccaaaatatggtgggaaggcttataaaataattataaaaaaggacaactagaaaataaaaattaccatactagacatacattcaaatatatttgaatgtaaatattttaaataaactcatgaaaaagaaagcattgttaactgggttccaaaagtgtgtgctgctttaataaagttagtttaaatataaggacaaataaaatatgaatatatcttcatatatatacatatataacatatatacatatataaacacatatatattatattatatattttaatatatgtatattatttatatatatatatttttttttcacacatgactgggggcctaatcagcaccagtcactaaaggaagctcttaactaggcttatttcaacaggactgatagggatgacatattcctatatgtagaaaaccctaaatactccagaaaaaaaatgttggagctaagaaaggaattcaggatacaaagtaaagtttcaaaatacaagatcaacacacaaaaagcagttgcagttttatacactagtaagaaactatccagaaaaaacaaattaagaaaacaatcccatttacaataatttcaaaagaataaaatatttagaaataaatttaaccagtgaggcaaaagatccgtacgctgacaacaaaaaccagtaatggaagaaattcgagaaggagaaatggaaaagatctttgactttagttctggcaataattttttttaggtatgacaccaaaagcagaggcgacaaaagcaaaaatgaacaagtggcattgtatgaaactaaaaagctcctccatagcaaaataaatagccaaataaatgaaaatgcaacccacagaataagagaaaatacatgcaaaccacatatttgataaacggttaatattcaaaatatatgaggaactcccacaactcaatagcaaaaaaaaaaaaaaaaaaaaaaaaaaacaaataatgcaattaaacattggctaaaggatttaaagagacatttttccaaagaagacataagaatggccaagaagcatatgaaaaggtgttcagcatcagtaatcatcaggaacatgcaaatcaaaaccacaatgagataacacctcacatcacagaattgctattattaaaaaaaataaagataagtattagcaagaatatggagaaaaggaacccctactacactggtgatggaactgtaaattggcacaagcattatggaagacagtgtagaggttcctcgaaatagtaaaaatataactaccatatgagacagcaatcctacttctgtgtatttatccaaggaattgaaatcagagtctcgaagaaatacctgcactgtcatgttcaccgcagcatttttcataatagccaagatggaaaaagctgcctaaatgtctattaatggatggataaataaagaaaatgtgataaatatatgcagtggaataacatttagcctttaaaaagagggccaggtgtggtggctcactcctgtaatcccagcactttgggaggctgagaggggtggatatcttgagctcaggagttagagaccagcctgggcaacacagtgaaaccttctctttgctaaaaacacaaaaattagctgggcacagtggcatgcatctgtagtcccagctacctgggaggctgaggtgggaggatcattggagcttggaaggcggaggttgcagtgaactaaggtggtgcggccacactccggcctgggagacacagcaagaccctatctcaataaataaataaataggaattctaccatttgtgacaagataggtggactcacaggatgttatgctaagtgaaataagccagacacagaaatacaaacactgtgtgatctcacttctatatgggatctaaatcaatcaaactcagatgtagaaagataatttttcagaagctgggggttggaaagatgaggagataatagtcaaatggtgcaaagtttcaattatacaaggtaagtaagttctggaaatctacacacagcatagtgcctacagctagaaatactccattatatacttaaaatttgctaagagagtagctcttatgttaagtgttcttaccacaaaataataataataataaatcgggttggggaaaagtttgggaggtaaaggtcgtgtctatggccttgagtgtggtgatggtttcacgggtgtatacttactcccacactcatcaagttatggaccataaacatatacagctttttacatgtcaatgatacctcaataaagtagtttaaaaaataactggggaattttttaatatttggaaattatgcaatatccttctaaataaaccatgggtcacagaagaaatcaaaatgggaattttaaaatgtttcaaactaggtgataattaaattatgatgtgttaatatttatgggatgcagataaggcaaggcttagtgggaaatttataaccttaaatgtatacgttataagaaaaattgttaagaatataattttttcaaaacagcttaaattacataaataatcaactaagaagctagaaattgaaaagcaaattaatcccaaaaaatagaatgaaggaaatagaaaaggctaagcagatgttaattaaattaaaaccaacaacacagaaaataagcaatgccaatacttgattccttgaaaagagtaattcaattgaccctagacaggcttattaaaaaatgtttaaagagagaaataaggcacaagttatcagtatctggaatgacaaatggcacataccagagattctacaaacatcacaaaagtaataaacatgtaagcaactgaatatccataaatttaaaatttagatgaaatggagaaattcccagaaaatcataatttaccaaatgtactcaataagaaaaacaaaatctgtaagtaaaagcctttctacaaaatcttcaggcccagataacttactggtgaattcttccaaacacttaagaaataaataacaccaacttacacaaaaacttttaaagaaaaaagggcagaatgaccttgataccaaaatccaaaagggcattacaagaaggataaatatatgcatatttatctcataaatattgatctaaaaattgtaagcaaaacatgaacaaattgaataaaaccgcatctaaagcaacaaataatagttatttcatcattgtgaggttagtttaacaaatataaatcaatgcaattctccatgttaataaaggagaatattcataccaccacctcaaaaaaagcatttgaaaaaatgttataattacgatttacaaagaaaaaactcagcaaactaaggatagagggaaatttttgtaatcccaaagaacaccttataaagatattttacacaaaatactatacttaatagggaaatgctaaaagctttttcataatatcaaaaatgggcaaagatgtccactttcactacttctattcaacagtgtgctggaggtcctagccagtatgatgaggtaagaaaacaaagtacaaagtttgaaatgaaagaagcaaaactgccattatttacaaaacgcatggctctatacatgaaaaatttcaaataatctgaaaacaaagtgttagcattaataaactaatttagaaaatatactagatacaaggttaatttccaaattaattttattttgacataacatcaacaaataattagtaagttaaattgaaagtgatgccatttatagacatacagtaacacatgaaatgtcctaaactacaggaaataagatagggtgatattggtataagagttgactaacaaaccaaagggacaaataggatttggaaatagccccacccgtaatcatcacggacttaagatacagagtgcagtggagaaaaaagacttttcaatgaatggccctaggtcaatctgatatctatatatatatttaaaaactcatcataacccttaccatataccatgtaaaaactcaaattcaaatgaatcataaatctaaatgtgaaagataaagtaatatagtttctagagaaaaacttatgggttttctcttcacgaccttgaggtaaccaaagatttcttaaataagatgcaaaaaggcactaaccataatagaaaccattgataaattagactacattttgaagagcttctgttaatcaaaagtcaccttcaaaagagtgggagaatatatttgcaacatgcgtatctgaaaaataaatggctttattcagaatacagaaagaggtcataacaatatgaagagaagcaatcaattcaacagtaaaatgaacaaaagacttgaacaaaatcttcataaaaaaaaagatatcaataccagcatttgccaggatggggagaatttagatctcttatactgttgctggaaaactgagagtatcttgcaaagctgaatatacacatagcctgtgatctaagcaaacctgctactaactcaatgtacagtagaaatgggtacacatatgcaagaaaaataaaaagcaaaaaaacttgtatagcactcagtgtaagagtgtaaaaatcaaaacaattcaaaggtccactattaaaatgaactttaaaactgtgttgcattcatccaatggaatagttagccatgaaaatgaattaatcacttttgcaagcaatgaaatggataaatctcaaagatataatgatgaatgaaagaggccagacactaaacaatatagaatgtatgattcaatgtatatgaaattcagaactgatatatggtaattacctttgcagggtagaggtagggactaagcacttcaggtattggaaatgttattatttcttgacacagttgttccaataaaaacatttttttcaccacctacctggaccagtggggtaggaacacagtggagaagatggctggctacctatatactaaatgagataataaagggaaaacattttgtacactgtaagccactacgtaaaataaggtatctctgtatacctattgcatttgatggctcagacagtataggaactgactgctatatctcacataagcacagtacagctcgtgttggctcagctggtaccagggtcaactggaagcagggatgctactgtggccgggacattcccctgcttggtctcttgggtctctgcttttttcagtatgttcaattctttctatgttaccacagattgcattttcttttcttttcttttctttttttttttttttttttgagatggagtctcactcttgtcgcccaggctagagtgcaatggcgtgatctcggctcactgcaacctccgcctcccaggttcaagcgattctcctgcctcagtctcccaagtagctgggattacaggtgtctgccaccacacccggctaatttttgtatttttgtagagatggggtttcaccatgttggccaggctggtctcgaactcctgacctcaggtgatccacccgcctcggcctctgaaactgctgggattacaggtgtcagccaccatgcccggcctcacagattgcattttcatgaggaaagcatgctctagatcttcacgttccgcagttactacctatattgaaggacagagcgggccagggatccccttcaggacaaattatctatggccctgaagtcaggatcatgtaacagatttttatcaccattgtatagatgaagaaactaaatgtttctgtgatttaaaaaaaaaaaaaatcggaaaacaaatcaacccagactgttacagctgagatctttaaacctacagagtgtagcagtctcttctttctgaatggcctgtacaacacttggtatattaactgctaccaagaagcatgcaaaatctttgatgcggattaattaacacaactcaattctacagatcctactatatgtcaggatctgtgctatgcttagtgggggataatttgataaataaggcatggccattgccctctgggtctcagaatctggtagaagagaagttcaacagataaatgattttaatatatatggaattttaaaaaatattcaaaatacaaacagaaagaaactaacagattaatttggaattgcagagactggagggaaaaaggagtgtagagcaggtgtcctttcaaatgaatttgaaatatgagaagtactttgaaaggcagtgatagggaatgaggacattattgggaaagggtagaaaatgagcaaaattagagctgagagaatgcaggaaggatttgaggaactgtagtttacatgatacagctaggacacctggcatacaggcaggtgtaaatatgaggtataacaagactgcagataggctgacacacttggaatgtcaatgtgagaaatctgaattttcatgtgaacacagttgaaggtgttaatgcaacatcacattggtttcaaaaaaaaatggagctatgtacatatttaaattgtatttactagctctctgaccttaggcaagtggcttaactccaccaaaactgactccttagatgaggtaatagtgcatgtagaacatttagcactattatatattcagtatataatatgtgctttgtaaatgttagctgccattattattgtttctatgaaggagagagaatcatacatattcaactctgtatgatggttaaaaaccagcttctgagttattttaaattttatttagatttacgtttgtgatgctgtggcttaaatccatacaaaatatttggtgataggtcccattgttctttgatatataaaataggtctataactgatttgtcacttctatgaattagcctcctgtcaaaaataacactttattggaagttgtctgcaacatttaaaagatttggattctttaccgtgaaacagcaatgtttcaaatcactataggtacaaggtttaattggtaattgttttatgtccctctaacttaagcaatattactgtagattatttctggagataaaggcaatccttttttcagttaaaccttaatcataatggtggaagtaaaaaggtattgtggggaagcactggctttggcattggcttgatctaggtaagagtcttaattctattccttcctctttgtcttcagagaaattgtttaacttcccaggaacccaattcctcacttgtaaaatgagataaagatatttatgttcttaacacaatgcttagacacatgataattccttcttttccatgctcccagatcacagcacaagtactgcttaggggggaaaaatgtagtgggcacagactggaccagagttcagatacttcggtcaaaaagttgagatacttttcaagcttcaatgttggcctagcctgcccatgctgtgattcgggcagcagtgatgcatgctgtacagggctcatgaattgactgaagatacttgaaggaaataaaattagtcattttttatgggtctttgttgtttttatacccatcctcccaacatcatttccactttcttttcctaagaaggccccaactcaactttgatgagcctctccattcccacttgcagttcaagtgccctgggtgggcaccatgtgcctccagagatggagcatgtgacccagtcccagccaattggagcactaagtttctctgaccacagtaattagttcatcacaggaaacatgatccaagttggtccaatcataagaataaagagatatgtgtagtagctatcagaatattctatttttctgtctgtcccactggatttcaatagttggagcctaaaacataaatgtcccatggactaagccccacaatactcactggctagagtttttagggaagtcaactttagggaagtcaaaatggagaaaccatgaaagttatttatttatactttcaaatttaatttggcaatgtcgtatactgccaaatcattgatccctagagaatcccaatcagaatactggagggcgacggctaagatgaggaatggtgcaggagcttagaaccttgctctggactatctaactgcaactgtaaacttaggcggaatgaactataccccaaatctatccaaaaatacattcttgtctggatgaagagctggtttatcaagcgataactaaggctactttggagccaacagtgtaaaccgtgcttactttcacattcactcaacaaatatttattgagtgtataccgttctaagaaactgggtaaaataagcagtgcctgccttcatgtatcttaaagtcttgcaggggaaacaaacaaacaggcaattatcatataatatcataaatattataatgagaagagtatataaaatattaaggggacattttagagaagcagctaatctaggctttggtggtccacaaaagcttctgagagattgtgccataactagccaaatgaagtggtgaagaagaatgctctcagtagcaagagaatgccatttatggaaaaatggaagtaatgcattagaactggaatacgggccgtaaagtagaaagtggtatgatacaatatagatggaacaggggccaaatcacaaaagcctttaacagccatgttaaaaagtctggattttaatcaattgaaagcaatggggaactactgaaggcttttaagcagaaaagcagcataacaagattgacattttagaagcatcactccaaatgcagcatgcagaatggattggagggagacaagagaagaacatttctattagccccttagtgtgaccaacaaggaggatattgcagtaacccaggtgagagatgatactgttctaaatcaagccattgtcagagagatgtaaaagaatttcagagggattaaggaggtcgaagcagtagggtttattattttattggttctgaagcttgcctgatcttcggccatcaactcccagatggccagtcaggatgctacatattctatcaggagtgttaatagaagagattcttacaacagacaagggactggttcatctcacttaggatccttttcaagtttgcagtactttgattctgtgctgaagatagggaataagaatgaataattacttaattaatgatttattgaatgataggagtggggaccccctcgttgcctaaaaattggtaagatattggaaataaaaagaaagcactacttataatggcattgcattgcacacacagctaacctattctgagagagaaagagaggacccaattgaatattaccggcaattttgttcagtgttccactgattgatcacatgcccccaaataaacatgagacaagagctgggtatcttctcttccttcagtcaactcagttcccactgtccttcactggggacaaactctggcattcttcttctaattctggtgatcaaggatatgaatttttgaattttcaaacatcatggctccccaaaatataaggcaaatacttattacagttctcaagataatgtgttccaatactagaaaaatggtgatgtggatttattgagaaagggcatattaggccccacttttgtataatgtgcttgtgtataaggaatttttaagggtttttttttttttttgagactccgcccaggctggagtgcagtggcgcgatctaggctcactgcacgctctgcctccagggttcatgccattctcctgcctcagcctcccgagtagctgggactacaggcgcccaccaccatgcccggctaattttttgcattttttagtagagacggggtttcaccgtgttagccaggatgttcgcaatctcctgaactcgtgatccacccacctcagcctcccaaagtactgggattacaggcgtgagccaccacgcccggcccatgagccactgtgcccagctggtatttttttttaactgtgaaaattcaccttaaatattaatcttagaaacttttgagtgagatttgactccagagaagaataaattaatggaaattacactatcccagaagttgcagaacttgaaaatacaaattttataagttccagaaggatcattggaagccagggcatttcagaacaattctaatatgatgttgtccttccaataaaacattgctcatcacaactatctgagaaaaagagtgagtggaggccttcttcagccctcatagtcttgtggatagaaagctcctaaaggtggtggaggagccaagatggccaaataggaacagctccggtctacagctcccagcctgagcgacacagaagatgcgtgatttctgcatttccatctgagctttgaagagagcagtggttctcccagtacgcagctggagatctgagaacgggcagactgcctcctcaagtgggtccctgacccgtgacccccgagcagcctaactgggaggcaccctccagcaggggcacactgacacctcacactgcagggtactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagtgcctctcctcctccaaaggaacgcagctcctcaccagcaacggaacaaagctggacggagaatgactttgatgagctgagagaagaaggctttagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactatgtgaagaatgcagaagcctcaggagccgatgcgatcaactggaagaaagggtatcagcaatggaagatgaaatgaatgaaatgaagcaagaaggaaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttactctcaaagggaagcccatcagactaacagcggatctgtcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatgtaaaggaacaaccggtaccagccactgcaaaatcatgccaaaatgtaaagaccatcgagactaggaagaaactgcatcaactaacgagcaaaatcaccagctaacatcataatgacaggatcaaattcacacataacactattaactttaaatgtaaatggactaaatgctccaattaaaagacacagactggcaaattgggtaaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactattctaaatatatatgcacccaatacaggagcacccagattcataaagcaagtcctgagtgacctacaaagagacttagactcccacgcattaataatgggagaatttaacaccccactgtcaacattagacagatcaacgagacagaaagtcaacaaggatacccaggaattaaactcagctctgcaccaagcggacctaatagacatctacagaactctccaccacaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaacgagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgatatcaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaattaataaatgtaatccagcatataaacagagccaaagacaaaaaccacatgattatctcaatagatgcaggaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcacaagacagggttgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatataccaacaacagacaaacagagagccaaaccatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattctatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacttgagaaaaacaagcaatggggaaggattccctatttaataaatggtgctgggaaaactggctagccatatgtagaaagctgaaactggatcccttccttacaccttatacaaaaattaattcaaggtggattaaagacttaaacgttagacctaaaaccataaaaaccctagaagaaaacctaggcattaccattcaggacataggcatgtgcaaggacttcatgtctaagacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaattcaaacaaatttacaagaaaaagcaaacaaccccatcaaaaagtgggcaaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcagcattattcacaatagcaaagacttggaaccaacccaaatgtccaacattgatagactggattaagcaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaacatcacactctggggactgttgtggggtggggggaggggggagggatagcattgggagatatacctaatgctagatgacgagttagtgggtgtagcacaccagcatggcacatgtatacgtatgtaactaacctgcacaatgtgcacatgtaccctaaaacttaaagtataataattaaaaaaataaagaaagaaagaaagaaataaaataaaataaaataaaataaaataaaataaagctcctaaaggtatgttaagtggttaagtttctggatcctcttcttgcagactgctcaggtaaaatgctgattcaggactttcacttgtcaatcaatttctccagcgggagccaaaatacttttttgaaaaatgttgtcctgtctaaattgacccagatgctgtgatttaatctgcaactggaagatacagttcgggcagtctctttttccctttggtttccataagctttctctccttttctatttttcaatataaaataaaggacaagactttacagtgattaagaagcacacatagtaattccacaaatgttgctaggcaacaagggccacgtattagctcaatgaatggattctgggcatctgcacgaaggagaaatatgaggagcttgtgagtgaactgtcttgataaccacaagggttagtgctttttgacacacatgctgttggatatgcctgagaaagggaaaaggcacacttattttaaacctttctgatggtttatttttccaaaatgtgtttagaattctctttgatggaaatttgacacagtgtgttataatgatcattatctcaagcgggaaagtaggtaaaaatggcctgtttctatttctctagttcagggctgcacctatagcctgagttattttaacatcttccctcctgatcctaataggcatgctttttccccctcccataccagtccattcactcagctgataaattacaagggcatgttctatctgctagtgagcaactcctctcccttgtgatcagtatttaccctcttcagttgctgtgataatataatattattgactctaagaagtctgctttattttgttcctattacaaagcaatacatgatcattaacaaaaaagcagaaaaatatagacacatgaatgaacattagtatctgtgttcatcttcaccagaaagaataatataatataaattaaggcaatgtaaataccttggtgcatatcattctagatttttttctgtacatacacagacagatttttttcttctatcacccatataaaaaagttataacttaccttataaactccacaatagccaacatagtttttaatgacttctgcactacaccaggatcatttaagtattttaatgaaacttggaagagtaattaacagggtaaatgatcagctattagataactctactaatcttattgcattttcctgttaatcacctaaacccaaccatagttagctttattaattacagaatcttatatcattatttcctttccattttgatatggtttggatatttgtcccctctaaatcttatgttgaactataatcctcattgtcggaggtaggacctggtaggaggtggctggatcatgaggatagatttctcataaatggtttaatgccatgtttgtgctgttctcacaatagtgagtgatttctcacgagatctggttgtttacaagtgtgtggtccttcccacttccctctctcttgctcctgctttggtgcctgcttctgcttcaccttctgccatgagtaaaggcaccctggggtgccaggcagatgctagtgccttgcttgtacagactacccaaccatgagccaactaaacctcttttgtttataaattacccaatctcaggtatttacagcaatgcaagcacagcctaacacacacttcttataatattaccctagtcaagtctctctcttttgtttttttttgttttttttgagatggagtcttgccctgtcacacaggctagaatgcagtggcgcgatcctggctcactgcaacccccacctcccaggttcaagtgattctcctgcctcaacctcctgagtagctgggattacaggtgcacgccaccacacccagctaatttttgtatttttagtaaagagagggtttcaccatgttggccaggctggtctcaaactcctgactttgtgatctgcctgtctcggcctctcaaagtgctgggattacaggcatgagccacggcgcccagcctaacctagtcaagtctcttacctggttcttacagtaatgaattaatcaggactctggtttcaaatttcagaaacttcaactcaaagggactcaagcaaaaggcaaagtatggctgcgatgctaaaagttgcagtaggagaggctagctgaatgcatagtggaagtcacagactcaagtaagtcagcaaggcttagcttcactcccactgtctctcagcaattccctcttcggcaacagcttcattcctgggccagctctctccaaaacgtgaggagatggccatcagcatctctaggcttctatgttctcaagaactctaggggaaaaacagtcctctgatttagtcccaggagtcactctgattgtacccttctgaaccaatcactgtagccaggggtcaggtgctctgagtggggccagacctggagaacatgcccactctgaagcctgatgacacagttcaccccacccaaaactcaagaacccaagagtcaaggagcagtcattccccaaaagcaaaatcagggttctatccgcaaggatactgtgcagtcaaaagcagcaaccaacttttcctgtgtgttccatctactctttctgatccattctacactcttctccaaccaggctcagcttatggaccgtatcaaccagcttctttccctctggcttcaattgggcttactcaacaggatgcattagcaggagagtgaaatcaccatatttcttcatctcctgccttggtgggttacaggttggcagcagctgtgttcctgatctctttgtgggatctgataataactctctcccctcggcccttcaggcacaaggatgataacagctcactgctgtgctaagctccaaggtattccaccatcctttgttgattttaaccttgcacacacctttaactcatttgtgcctgctttccctttcctatgggacctcctatcaggctgctcaacctatcactgttccttcatgtcaaccacaaatttggttagccgttaaagtcttcattcaagaaatggatgtgaatatttaaagttcaaagctaagggccactgtcaatttaatccaaattgcctgttattatgacctaggctttggtgaccacagaagtatactgaggattgtgacacatacagccgattccaatcactttcattttgggttgatttagtagggtatatctggaatatattctgtgaaggttatattttagtggagatgatcttgattctctaggaggattgaaaagaaagtgaatgaagaaaggaaagaagaaagtaagaaaagaattgagggaggaaagaaggaagagagagaaaaaagaaaaaggacctaggaataaggagttttgatcttggagtaaagaaaccttagaattcagtccagctttgtttttgaccattgtaggtggccttgggacatctttccttttcaccggacctctctctcctggcttgtaaacactaggattgggccagaccatttttaaggtcccttccagttttaataatctatgaagttctaatgaactacaattaatgatgcttgcaagaaaaaaatgcccttacaaacactgcctgttcaaagaaaattaagatactttattaaattagataaatatatttttttctgaccaagaaagcaaaatctttttgaaaactaggcaatcatttaagttaattatggaatgaaaacccaaggtagtgcctgccctcaattcaaaacaaacttgtttttgttcagattcttgctacagaccaaattttatgtacagacaacgtggggctatcaatagggatctgcagtgaagcccaaggaaaacactaatgaagccagcaggagcccacacagcctagccatcgacacaatgcaaaattgaaaacacgactgaaaatccacagaggaggatgtccccacacttctttgtgtgtgatttgcctggtccagccaagattgtagaagctgtaggaggaagataaaaaaatttttaaaaaagaaagggccaaagcaggaaatgagctgtaacttgacagagtcacaaaagaaaacagaaaagcatgaaacatatcaggtccaaagaaggaatttggaaaatatagcctgtttattttgaaatgaggcaattgataatataaaaaaggataccaaaataaattaaaagctctgaggtattttatgctaaaaatactcattataaatagccagggtacaagaacagacaatagacaagccgagtttgagaaactaaatgtgttgatattttaggggaaaagaggtaatgtaagcaaaagagagactccatccttgagggctggatgttcacctggggcaaggtcagacaagggcagagcacctgcaccagacccagtgagagcttcacagcctcgacaaagaaggtaggagaaaagggaagaaaagtcagaggttgaaccatctgtgctgacaaaatggttttaagttgcttgccaagaaactgatcagtctgtaatggcagccttaaacattgtgttgaaaaggaaggtgaagtcatagcagaaccaggcacaggaataaagaatgatagattggcagtgtttccagtggggatggcagtaggaagggaaggtggtgacccacttgagtaatttgctgaccttggaatgtatgttctagaactatactgtccgatatggtagccactagccacgtttagttatttaacacctgtaatgtggctggacagaattcagctgggctgtaagtggaaaatgcacaatggattttgaaaactaagtacaaaaatatatactactttaataatttgcatattgattataggcagaaataatactttagatatgttaagttaaattgaataaattattaaaattggcttcacccatctctttttgcttatttttaacatagttgttacaaaatttaaaatcacatatgtggctagcatctgtggtctgcattatatttctattggacaacctgctctgtaaagtcccttttctgtctctccaggcttctgtgatatgatgatattcaggaagccttgacttagccctcactatcttctccatctcaagcagagccttgtctcagactaaccaaaaggaaaccacattgagactcaacagatgctgtaaccacacaactcacacccacgtgagaatatacacttacttagaagaacagtcactgccacctcctcacgtgtacaccccattcatcacatatgtacacaagcatatttgtatgtgtcagaaaaatatccataaataggaaaggaatattagcagaatcattgtcacagtgaaaattacatttcaactgtaattatttgtttgagttagggagactcattagtgcttgttaataagaaaaggttctttgaaattcaagaatatttaacttcatgtcttccaattcctaacaagaaatcaatttactgagaggggattccagaatcatgcttctatgtataaccaagacatcagggctgcccacgcatgacagagagtcaaaagtaagctttggccttgacataaaaacctccagtgtgatcgccaaccagcacaattggattctactctcttagctgtcttctctggacttctgctcttttccaaccctatgagccacctggtcttccagtcctgtcttccactagaatctaccacctagcacacctagcagtacctgccagttgcatcaaactcctggtccagactctgctagtcagtccatggtagcatagagagaccaattctaacgactgttttgaggctgtggtccagcaagtttgtgttcttgaacttttcaattaggtgagctagtaaattctcactgttgctgaagccactttgaatttagtttatcttgcttaaaactgtaaaaatcctaacagcactcttcaaatatttgaagagcgattccatggataatctattttttctgtacttcaaggggtggcttctagtgaagtctctcctgatgatgtactttcaccctgaaatttccttttcatttatccttttcaaaaaatggtctacaggtcatgattatcatttttagaacttgccttggtgatctggtccatccataataaagggaattcaaaggtcatttcaatacttcattctgagttactgacaatactcaacatcaagtcattcttgctgcttatttggatcccagctctgggctcttggcttctgtgtggatcctgagacccagatgccaatttgcattccagctttgaccggtatccaaatgcatcctgatgtttctgactgcctcttgtaataattgctccaaaccccagtggcttcaggatcaggagtctgtctacctgatcattcctcccaatctaagaactgcaaatgggtccctagtacattttgagaaacttctgtaagtaaactaagcatcttctctgtggtttaaaattgtcaacttccagattactcattgctatggtctaaatattaccatttactggatttgcctgatgctaactgtgtgttataaaactgctttgtggactaatctttcctcatgtacctgttatgtttctctgtaaccagccctatcctgatgggtaactttgtcttcaaatcccagccacatctcaccaaactttacttaacctttccacatgtcccaacctacaagaaacactgtataaaaccaccatgcctctctaccaatagtttatcatattgtgatgtcattcttgtcaggctgatatccttctgatactcctgtgtttacttactgacacatggatagtaagaaaacattgaacttaagcaaaacttacagattcaaaacttggttctgttatttactagcggtgtgtctttaagtgcaaaagaaaatatcttttatacctctcaaattttcattttccttatctataagttgggttaatgatacttgcccttattttgctagatattgtgagacttagataacaatgtatgtgaaagcacgttgtaaattttttgaaggactatataaataaatcattaatataaggttttattactagccagaattgttatctcacactcctttttaaccacaaacagccatacatattattaatagttggtgaatatttgtcatttcataaatatgtacgcaagtacccctaaaaacctatttgtaaagcaaaatggaaatgtatgtccaatgaactaagtgagggagggactagggggataaagctgttgaggaaaaagaaggggtagaaaatatgagttgtaaatgtgaatgagaaaaagagtgttgggcagagtgcaaatgcaagagagaaagagaaacagggaagacaaggcaagtagaatgcaatacaggagaggaagaggaggaaaagacagcagggaatgagaaaagacaacagaacagaaaaggcaccagacattcctaaaccacaattacctgcttggaaaatgttcagagactgcaatggaagcaagctccttgcccccaggtccttcaggaaaaatgggcctttgaacttatcttaaggaaatcttaggcagcccagtgaggaaaaccggtagccaaggcctctccacagagacagacaatgcctgctctgtgggaagagacaagagatggggacaaaaattggacaaatgaaatactcggatgtttaacaacagcacagaaaatgaggggagtaaaggggcagaggatgagcttaacatcctgtaaaacaaaacctgttgtcagacctattaaaatattgcataatttgacacgatctcactgttgttgcttttcttcactgatatatgtaataatctgggtttagttgactgctaagtcaaatttaaccaattatctggacatacttaaaaacaggacaggaattttcaagcccaagcagagttgctgctttctaggatcctgaagtgggaatggaattctgatacacaggagggacttcaaccctcttttggagtgttcccgtgctaacgttctaggtcctcagctgatgtcagtcacctctgaggatggcaaaaataaataaataaataaataaagaggtaacagcaactgcagatttctgattagagatgagaaagaattcctagagaatgagtcagtcaaagagaaacagaaaggttattaaaagggcgttccccctcccggattttcttggagggttcctgaatcacagagcacatggcctcacctatctgggatgatatagacgttccttcttagagtgggctatttgtattgctgactcagtgacctaaggtacggtcagctttagcacagcacctggaacaaagaaagtcttaggggtttatggttatcgtagtagagacagtagaaataaaatgaatagtaacagctgcagtagtagtagcagcacttgtagaagaggagtaatgctgatcttaggaattggtgtaataataccagtatctgtaaattctacaaatagctgtaatgtggtagtcagggatctgagcactgcaataagacctcctaggtttggctggttggttccatcccttactattagttgtataaatttgggcaagctaattaacttttctgcacctcaatatgaaatgcagataataagagcaccccttcatagagtggtcatatggagcgcatgagaaaatacttgtgaagagttgagctcagcacttacactcattgagcattcagtgcctgttagctagtagtagcagggatggtggtgagggtggcagcctgagcaagggaatagatcccacctaagggatacaaaataaaaggcatgttgtccctgtcattagcaatcacatgccaggaaatctgcaaacagcaccacaggagaagccttttcaacctcaaatagagaacttgtgttcttttcactctcccgtctcttctccaaatcccgtagcctcagattccaggctgcaagtgaaattcagtgtgttgtgggtgaagtttcaggggcatagagtggagatgggtaatggttattaatatccactgggcacaaaactttctatgatgggccttcaatgatgtggagatattgcctaaagagttaaaaaataaaataaaggctttatcaatgttttttaaattcttccaacattataagatgtcagactaaataccaggcatacgaagtccagcagaggaggcaggcatgttaaaccactaattacaaacaacaatgacaattataaataattgataacagcaatttgtatagagaggtctgggagcatagaggggaggtcaggaggcttgggggtcaggagatgataaatgacttcatactttgaggtgcaagtaggaaattggtgaaagaaagaggggacatgaaggctgggattaggctatagaaagatggccagtcgtctggctgaaaaatgaattggagttagggagtcaaaaaggtgtttggagatgatgccaatcatgcagaaaagaggtgaagccttaagacagcaatgacaggaagggtagagagagggtggcagagtcaaggttacataattctaaataaaacactgctaaaattaagctggtataaaaagggtactagttattattttcagagtaaaacctcatcagttcaacataattggatagaagcatgtcaaaattaatcaaatatgatttgtagctttaaaaaatacatgactaatagcttaggaatttttgactagatgagatattttaaatacttttcaacttccccactcttaattagaagcatcaatgttcctgcaaacaaaatgaggttcttagaagtaaagttctttttgtttgtttgtttggggtttttttgtttgtttttttagacagagtcttgccttgtcgccaggctggagtgcagcggcatgatctctgctcactgcaacctctgcctcccgggttcaagcgattcgcctgccccagcctcctgagtagctgggaccacaggtgcacgccataacacccagctaatttttgtatttttagtagagatggggtttcaccatgttggccaggatggtcttgatctcttgacctcgtgatccacccaccttggcctcccaaagtgctgggattacaggtgtgagccaccgcgcctggctgcaaagcctttttttttttttgaagtggatcgaacccttttgttttttcattttgttcacacagatgcacttcatgaattccaaggctggtctctactcatagcctattcccctcttactagtgtagaaagtcacaaccctcaggcttgactgtccagagaactggtctgagtctctcagtcatagaagactggttggctgatatgccccaccctcagttaggggtgtcatctgggtgattctaggccatcagtaatgcaaccaaagaaaataacatttgaagttacaaatagaaatcagacacaatttttctgattctcaggactctgtggcgtgactcaatttgttttgcaaaacttctgtcagtggtgcgatgataaaattcagttcaattcaaggacaagccatcagaacattccctttcagggaggggattttatcttatcctctactaaagtactaaattagttgaaactcttaattatcatagcttgtctaaaagtcacactaactcaatgcactatttattttccaaatacctgcacatttcttacatcataaccctaatgagtcataaagaatgtatttactatgaaaaatattagactcgattctcacatgttgactagaaatgaaaatacaaagaaaataagtcagtatgtcccactttaccaatgaatacacaacaggtgatttgctctcataagcttcctgagttcagatcagaaaggtgacagttttaacctttggatacttcctaattatgcaaaatgcttgtagtccttgcaaatgagagaataaaatgatccctttggtcagaagaaggcagagcttccacaaaaaggtagttttctggatgttaatatttggagagaggtttaccttttggtggtctagaaattgggagtcaatttattttatatttaattgaccatagagcagatatgattagaatcctccccaaaatatttcccaactgagattcacactaagttagccagctttctatagacatttttttacctgaatgttccacagttatctccatctcaatcaacatcaaactaagtcctcattccctatgcaccacacttcttctccaaggtcactttaaaaacatcttcctcttcctcctcatgcaattcatcatgatctaccggaaatgctacttcataaatttctctaggatctgtgttttttcctttactctcactctgttcttcctcctggtccttatcctgcctcccctggactactgtcaccgtttcctcaggcccctcctcttgtcaaccctgtaaccctatttgcattcagtgtcagtcatgcttcctacatgcctaacagaacttttctgtcttccgtgcagactgatagatcgtatttctgaacttccatatttagttgtctacagtgcctctgtattttctattaccaacattttttgaatgctaagaagtttgtcgatttttttaacatttaaaaaatgactctaatgtatccatttccacatacgctttttctggcattcatcttttgaggatttgaactgcagtaattacatacaatgaacagtggtggcatttgagataaggtgaggctagaaacgtcagttacactgttgatagagaaagttgagaataaatacgcatctatatttgatatgcacaaaggtatgattagtattgaacattcaaagatgagtatgttgtataaaaccttttgaaattaaatgaagtcattacaagctaaggagtaagtgagtgggcagagaagggggaaaaaagattcttcttacattctttaaaaatgcaaataagaacattgcctgaacattattacctgactgataaaatggtaatcacttagcagatatttatttagaaatctgttccaattgaaaaaatgtctgaaatttaacacaaccctatttgctaaatggtaataaaacagaattcctgggagaaaatagcaggtactaaaagtcataatatggttctacaaagttgaggataatttttaccactgttttcaaaatgtaagtgataaggtggaaagccctccagggccaggcaggcagattgcacactgaacaactgtacgctgtggctatgaaaggtaatgtgatagttcaagatggcttcctttcagacaacagggactcacagttacgactctggtaaattccagagtgcccagcttccctaaaaggattttaatccatttttaaaaccctggacaggccaaatgaacatatctgctaggccttcagtttgagaacccaagtctaaaatatcaaatgatagaccttttgccacatagaaatctttagaaaagcaaaccattgaagttcaaaggataggctctgatatcacaaaaatttgggtgaaaatactagcttcacctctttctagaaatgtgcctttgggcaaaataatgattcttctctgcctcggttacttcatatgtaatgctggggccactatcagtgagatcagataggtcacatgtttggagaaatgtctgaaccatagcaagtccttcttatcaaatgttcaaggcatcaaacaacagtgatttgatattttccttttattgtcgaaatccattttcatagatattgtcatggttgagtgacattttaatctaaattatatataccttaggagatagtttgtctttggagagttgggagataatttgaaaaaatcagtgattccggaagcaaagacttggattttagtctcaggttaatcacttattagctgtgtaggctgaggaaaaatcacttaatcctctgaaactctttttatttcttttgtaaataaagatatttatttctttatttacaaaaattgtgctttgtaggactgcaagaagctacaagtcataggcaaggctccaaattatagaaaggagcttctaagaaattgtaaataattcacagcttcaatcacgtttcttgaatctcatcacagcctgtgcttgcaaagtgagacaaaaagacacagtcttacaggaatccaagtgacccttccatctagaccatgctgtaatcctattaggtacagaggtaattctgactgggcttgagctgagagtcataaagatcttgcaattttttttttaattaggcaatatctctacccttgccaagctatttgcatccgctgatttgcacaagtcctaataaactatgtaaaaaatctcattaaaatgtgacatttaaataaagattggtaataaaagaagcaaactgcagggaggaataacaaggtgtcataagaaaagaagccagatacaccagggttgactgagcaacagacccagaacgatgcaggtcaataataattctgagaacatgtaactgttgatactaaaattcatcataacactaccctctgtgtgttccagggaacaagattaggtctgagaatttgaaatgctacaatgcttgcttctgaaatacttctatctcaagcaattttagtatggggcccactttgatcaagcatgacatggaaggcatactcttctcacttcacaggtgaaatgatgtggattttcattatcaaggagcttctgctttactaaagtccagggggaagctttgaggcctacagactgctcatttagcaggctgtaattcaaagtatgcctcagtggaactgatagagctggaggctgcagaggttcagcttggcaagcaaaacaaagtcaggacacttgggagcacccctttcagtaataaccaaattctctaaaacaggtggacaaggtaaactgcacaaaagactgagcttcctgcagtcaagcagattgagactcagatgcttatattaatgccgtcacatctgcaccctcaggtttctgaagccgggtgaagcagcctccacagcagtaagttccagaagaaaccaagcttatatagtggggaagctgtatctgttatttgccacagtttttatgcacttatatcaatcaatgagagccagaagcctgaaaactatatttttcagactttcttgcccactggcttcaggttatgttttccaaatgagagattcaacatggaaatttgggcgatgaggtgagaaagaggagtatatttcttctctatttggaggtgctttaagcagtaagagcaacagcaaatggttccagaaatgtggcaatggttgtgcctccagcagacccataacagcaaggaggatcatgaggcttcttgacctctttaacatctccttctccctgctctgccatggagctctgtgacctgcactaaatctccgtttgcttaaaatatatacaacagtttccattttcctgcctggacactgacaaatacaatagcagaaagaaataagtcaggggtattttcttgtaaacaggggtcaccaatcaagggaatgattgcatataaaggagagctggctgtatggaatccagcacaagaccaggagtcaaagagacacaagatcttaacccagatgctccaattcccaaacagaactgtgtccaagtccatggaagctgcagagaaaagagaaaatggtgctaaataggtatagaagaccagtggtttcattccaactaagccacttattagctccaatattgaaggttttctgtcatctttgggagcctttgtttcctcaccagagaatgggtacagtcagggataaatattcaaacaatttaataactgatcattaaggtcaaccaggtaagtagatggatactaaattgaaacaatcaagaaacttatagcttatagtaattaattatcagtttttgggtaataaatatctacctctcatgatactcgtgatgactaaagacacatttatcatttactctatgcatactatgtgcaaaatactatgttaagaattttacctatgtttttctgaagattacctgtaatcttaagaaaaatcccattttcagacaccaaaactgaaggctcagagagattacataaattcttcaaagtaatacagccagtaaatgggaaagtcaagacttgaacttatattattctgtttccataaaccctacttttccagcatcccatggtgttggtagttgaagttctgttaggaacgcttcagaagatgtataggatcacgtatatgtagaagattactagcttaattccataaccagaaaatttcacacattgcaagaggccattgctttcaaaatataaatgtatcttcttccttctagtagtttgtgatgcctctagcttgaggttccccataaccccaagtggcacaggggttttcaacacaagatgagtcccagctcatattcactgtattcctgatctaatcaaagtactaactgaatagtcaccattttgtcagtcaagcagtgaagttgagtattattctcatttacatttctaaagcaacataaaaataaccccttttaaatggtacccactcactttctccttatatgctaacgaatgtcacaatttccgagcctgaagagagatttcctgcaaaacacctaaatgccttaaagttgcacatgttcacaattctgactgccaggttacaaacatgaattgactccagttccaaatcaattccacatcgataagtctttagggcaaacaactaacacacattgattttttaaattctataaattatttcaaggctttagaatattcagcattaaaaattaccatttcatttcaggctttagtgaagcataatgtgtatttttaccagtattaatcaaccccaaaatcaacttttctgtttaaaaaatttctatctttttctgtttgctaagattggaaaatttcaattcattcttgtagttacattgatatccaatacatttaatttcttgatctaaagtaatgaattgtgacttggtgtcatgacagaattaaggcaactaggtaattaatttgaagccaactactcactttgttatggtttttaattaatgttgttgcatgtgtatagcaggagactgcttttatataaatattatgtattttatatttaaattattcaacttttggtatttactcagattttctgtgttgtgtataaaagcttgccagtttgatcttcagttaaaaaatatttagtggctccctagtaccgtcatcaagcctaccaaaggaatcaaaaagaaagattctttccctggaaaattcttctttcttggatttctttctcactttcctccttcttcctttacatccttaaagtggcttacaaaaatgatcaatacattatttaaaaagcaaaggaaacaagacgaagcgattaaaagggttggaaaatatagtaaaggcttgttagagccattgtacacacctagagatcttctacacttattagtggtgattataaatttgtctctcagtttcctagaaaccctagcaaagggcggaaaatgctaccatttatatgattcataatcctataagatgcttttctggttgctaatgagaaacattaataagaaagcacaacagtcatttcgtggagaagaagccgatccttaaatgaggttgttcttattaaagaaggaagaagccccagggactgcagggtcagtgaagcaagaggatagagagctcatggggcagggaggtgagtcaagggtaggcagaagctaccgttaaaaagaaccaagacataaaataaactttttctctgctcaaagcctggaggcattgtcttgagaaacctccaagtgcaagtttatatacaaatggactttccttcacctgtttatctcctgtctgaacattgtactctctggaacttaaaaagaaattgattgaaaaaatttcttagaaagcagaaactttcaaattataataaacagccagaaaaaagagacagaaacctgaactgcatttagcgatcacacttgaactgaggaaaaccacgtgtcagccgggagaatctggtagttaaacaacatcaaaagcatagctgtttctgaagtcaggcattaagtgttttagggctgaattaagtagggtgaggcaccagcaaggctcattccccaaatacaagccaaagatgttctacagggtatctgctgcaaaatcatcaaagccagtgtttccatttttctttcttcaacccttcaaaaaaaaatgcagctgcctcctccggagccttgaggaggaaaaaacagaccaataaaacagatcaggtgggtgtcagattgtctggaaagagctgcctgttgactgctaagttggctgacactatttaccaagggacaggactcatcaggaacttgcctccccaaccagggcctgattcactgccagcttttcatcatgattcaatccatcctgcatcaactgctttctctgctatggagactcttaagaggaaaatgcttataatgcttctcatattgctaaaatcaagacctagtatgacttttcttaattttaccttatagttcacagagaacatagcgcattgtatgtatcttactattagaattcttttttttttattatactttaagttttagggtacatgtgcacaatgtgcaggttagttacatatgtatacatgtgccatgctggtgtgcgcacccattaactcatcatctagcattaggtatatctcctaatgctatccctcccccctcccccaaccccacaacagtccccagactgtgatgttccccttcctgtgtccatgtgttctcattgttcaattcccatctatgagtgagaacatgcggtgtttggttttcttttatcaccgtattaaatactttagttcagtgattgtcatctagctacacagtgagatccttaagcccaggaaattgtctccctctttctgacacaaagtgtaggtgcttaattattttatagtaaagaaataaaggcaatctactgacaatttcttcctgtggttggccatgattgcattttctaactttcctggaactcccaaagttcttttttatgtctaatcctggtcctccagcatttttcatagtaattctttgagcttgtacactgtaactactcccaaattacctttgattatgttagccagagttagtttctgatgtttttagtcaaggatgctgacagacacattgtagcaaggaccaagctgaattagaaaactcaattaaatgacgccaaacaaacaaaaatgaagtgagcagtatggccggacaaaacacttaactgtaagacattttatttaatagaaaatgtcaactaggaccactctgtctcttgacatctggggaaaattgactggagcccctcaattctagagcttgtggaagtctaaagccttctctgagatttctgaaatctctctagggcatttgcagtctcctgccatcctgttccttttgggtgtccattctcacataggcatcctctcttccaaaccccatttaccaacacaggaatgtcagacatctcagcaatgtatacatagacccacacacaaacattcacatgcacatatgtattgaaataaaatatcatataaaagaaggcaatgcagttttatgaccttgaacaagttattcaacctccttatgtctcagttgacacacatggtaaaatagggataataatgatatggagcttgtaggactgctttaaaaattaaatgggataatactagtttatagcccatgctgagctcacacattcaacaaaagaaacattcaacatgaattcatagccaagctagaaaattttcctgaaggactgagtcctcggagaagtcagcacacacattaaagaaaaaaaacaaaaagatatgcaactgtactctcaaagtcccttacaactaatgttttgccccttcccaaacagagcccagattctccttctctgaatcatgtctcctccaaactcctcccttttccattcattttcttctatcttcagagcaagtaaaaggattcttttcctgggctagaaacccaggcttttcaattctcaccttatgtaggcacttttccaagtggggacatcccttatcaaagaagaatttctggttcatgcttttaaaataataaaatttcttcttgctaattacacctagaaaaagggtgtctagactttagtcatttgcataatacccttgtgatttttttaacattcccttattaattaatataaaaatgcataatatttttaaaaataaacctacatttacattttaaataaattaatcatataaggaaatatttttcactattataagtggcaaaatattattactcatcctaaggaggtaacctcaaaataaacatttgattttaaaataaaaatattgttggcataccacctaaattcattatgtattcctaacaattcatgcatcacaatttggtaaatgtgagcctaaaaacatcttttattatggacattcaaaggctgtactgagaggacatgagggaaagtctgtggcatttgcctgttattaatattgtggatagagagggggagtgggtgaggagaaacatatgttgatgggatctggttagaaaactgacagagaagatggtccagagacaagattctggggcgtgatatcatcttgtatcctgcactattgttccacagcacccaggagaatggctaatgtccatttaatcaaattgtattctgctgttagaatctaatgctgctataaataaatgtttaaaagctagaaatgttacagctcataatatctgaattattcccccaaaagtacattttaaccaactgatccagtttgatacagtgtctgaaatttaaaacaatattataatgtgtcaccattgatattgctcactctggccttttaattaacaaaaataaaattgagattctctgcatttcactctgctttctctgggcaaataatttcacaaactttagaggaaaattaaagacctggcaccaggtctggcaccagcctaaataatctatgttaatgtcctaagactctgaaccaagtcagtacatctgggaaataacaaagtccacacacttttattgagagtgtaaaatgttttattgctaaaaatacagtctctttgtatatctatatgtattagaacacaaccttatttgaaatatatatattacaacaatgacaaactgatcaacatctctttattaaatacccaccatgtaccagggattttgccagggatcatgaaacacattctaccctcaagaaattccctggttggggtgacagtacatcttggcaactcaagtcatattacactagagtttctgtcaagatatttgacagctccttttgtgatagttttctactatgtcaaatgcagaggcacaaggcccctgatctatacctgaaatatacttttctagaggtctcaagtgaatgaaaaacagttcttgtgattacagcaagaatgtattttttaggatgtattccagctactgatatctatggataattctcagcctcaaatgccaattcataacattgaggccttattgaatacacttttctttgtactatttgattgtgccaaataaagcaatcttttcgaaaagaaaatcttccctaggagtcagactactatttcatctccaaggcttgcagaaaattacaggaaaacaaatcaaaacgaaacaaaaaccatttagctttatgtaactataccatgcaaccattatgtcacataatataataacctagttgagaaaagaagtggacaaactagaacctgctataaaaagcaacgtgaatttgtctcaagtttagatatacagatagatattcttaagctatttttacccctacttaaatacatctttcttcctattacagagatgaatatctattttcaaacatcatctccataatgcagacttttagtataggaagctggaaatgtttacagtcatattacgtttttcatttaaacagaaatgacaaaacactaataatcaaacagtactgtgaacatgattatatatgaaacatcaaagaaaatccacatccattaactttataactctacaacaacagatttttagagtcttcatagcagaaatgttctcagtttacaacacaatatgtacagaaaggtaacatacctcacattagcatcaagtttgtccattacaggaaataagcatgagtgagttggatttcaatgcccacagggtcctaaaatgggggaagtaaaaagatgttataaaagaaagcagcattgaaaaatacaagtccttgttttaaaaaactcaaataactattgcttcctattatgacttgttttgtggaaatatttaataaacaatactaaagcaaaaagcttttggcatattgacgtatggtacagccgagtgtcacaaaaggtttatttacaccctactgatcgctttgtgattaaaacatatgggtgcttctttttgctccatttattgttatttatgttctttccagaaacatggcttatttttatgatctgcattaggacagtaattagtgaagataggtagctacattcttatgcttaaaatagtatattgcccaaaatggccattttgttcctatgaggattttaaaaaaatgtttaaatcattttaagggtaggaaatcacagattcttttgagaatctagtaaactcttgagaactgtctgcccagaaaaaaatagatacgcatgcacacacatgcacactttccagagagtccatgattccttgaactcaggaatccaggaatcccaggcccatccaggaaccccaggctaagaattcccaatcgaaggagagttaacttcaaattaccaaagttcctctatcacagaccctcagaagacctcacactctttaatggatgggcattcactgatctccacaaaatcaaccctctttactaattgttcagttccatttttgcatttttatatcttcatcacatctgttccacagcatgatgaatcagtaagtgtaggggcagggtccggctgtctcttctagggtcaccatgagcaagtcccttttccttctgaacatcatcattcacttctcagtaaagagaagagattggaaaaaaataatctctgagttcactcctagctctgatattctatagttctgtttgctagttttctagttgaatcttaccaagaagaacctggaaatctgttatctacataaaagaaccatgaaactcagcctgggcccttggacaccttggccagggtgagctaaacagatgtggctggcagccacgaagagaatggcagatcactagatatggaaaggacctcgactctctgtgtttttcgatgtttgtttcttagatcctctaaacttaacaggagctcccatgggcatttctgggcctggggcaggcatgggaaaggctccacctgcagaactctgagccccctcccctaatctgaaggaaagtagctctgtccacatctgtctgttttatattttgaatgtagaataatattttgctggaaatatacaagtacaaagccctaactatcgaagtgacaggtctcaatcctctttccttgtctatctaaaatttttcctgagaggatcacatccatctggtggctgaaaatacagtacaattacaatactattcactgtagactcccaaaattttatccctacgttgagactttcccaggtgtagacagtgcccatccagcatctcaagatggatgattaaaaagcatttcaaactaaactcttcctttctcatctccgacacaaaaacctgctcttccccagtgttctctatctcagtaaatggcccaccatttacccagtggttcagaccagaaaaacttcttctcataccctaagaccaaaccatcagcaaactcattctctctactttgaaaatgattcctggccgggggcagtagctcatgcctataatcccaacactttggggggcctaggtgagtggatcgcttgagcccaggagtttgagaccagcctgggcaacgtggcaaaaccccatctccacaaaaaattagatgggcgtggtgatatatgcctgtagttccagctacctggggggctgaggtgggaggatcacctgagcccaggaggttgaggctgctgtgagccaagatcacgctactgtactccagcctgggtgacaaagtgagaccctgtctcaagaaaaagaaagaaagaaaaaaagtaaaagaaaggaagaaaattattcctactcctgacccttctcatcacctctggacccagcatctgggtccaagccaccaatttctttctctgaattactcacccacacccccaatctgtctcctgccagaatgatattttttaaatgtaagtcaggtcatttcttgcttgcataaaattctagtggcttcctatcacacttagcatacaatccaaattccttatcatagctaaccagaccttacatgatctggcccccactcttctccaaactcaactgtagccatgcccctcccctttcccacccaccagctcactggttttgctgctttcctgggccgtaaccgtaggttcccatctcagggccttttcactttgtctcttttccctggaatgtgaccatgtagattactctctcacttccttaggggtgccgctcaaatatcacttcctcagacaggtcttctctcaacacctaactacaatttcacaccccattttctaaaaatgtctatcctctttctctgttctatttttttcttcccagtatatatatatatatatatatatatatagtcaattgcttctttatttgtgatctgtcttgctcactagaatataaatttcaagagggcgtaggacactgtcttgatcactgtgacatcttcagtgccctcgagaaatgcctggtatattgtgtcctcatcatagatatttattgagtcaactaagtagttcattagttttgcaaatgagaaaactgaggcttaggagtttttgactttcacactgggaggaaggggaccatctcagaatagaatattgtaatttaaagaatagcaaaagtattatatcttaattagttgccctttactacgtgttaataagtaccagacattgccctttttctcctcctccaacctttgagtccaacctccgagtccaacctccatcctatagatgaagagactgagggtcagagagggtaattgaattgccaaagtcatacacagcagcacttgaccaatctgggaatagaattcacggctatgaattccaaaactcgagctttagcttacatcattcttgtcatcttattatacgtcctcccactggagcaacagagtatcctgatgaaagtgaacatccactataattttctgctgtccatccatctatttcatctttctctgagaataatgtctggattttccttactggaaccacctcttcccttctccaatccctagctccagtgatgaacacataagcagggctggtcgatcagaatagtccattcctggcaacaagaatcccttagcttactggctggaccagggaaagccagtcctagaatttttgctagaaagactctgtatttcctctggtgttgtcagacagtttgaagctgctagtggccatcattgccaccccatgggaggagcttgtctgagaagaaaactaacccaaaggaaggcagagccacaacacagggaatgccagtgtcctgactacataatttgaggcttaagatccagcagtgtcttaagataattttacacttgaatgtcctaattactagagccaacaaattctttttgcctccttaagccagtttgagttgtgttccagtcagcaagcaaatgaatgctgagtaatatacaataaaatcaatattgtattgttttgcagattaaaaggaagaaaagctgggcagtttcagctttaaaagccattaaaacctaaagtttgtatcattaaaactgcatgtgaaaatgttacaacacaaggaaaatcttgtatattcatagcatatagattgttacattttttgcactgaaacccaatgagcaaatttaaaatgattgcctttcaacaaaccagtgagatagcatgcattttatcagagagaaaggaacagaggaaggaggagttgatgattagtacctatcctaatttgattaattgattatgcctgactattttctgcaggactcaccagggagaactaatcagagccatgattataggaacatctcttgctgggaagattgcatagggtgagggggatgtggaaggaaccagtgcttttatcttgaatacttatatttctggcttcttcacaaaacactgcctagctaattaaaaacacaatcaactcagagcatctcctatgctcaggtacaagttgtgtcacttctaaaaattctgccaattcaaatccattaagacctggtgtgtatgtgtttgggggtgtgagtgtgttttaatgacagtcacgctgtactctaccatctggactaaggtacaagaaattataccctccatactaatccccttcggagaaacagtcctagatcatcggaaaaagatcatggcaagttctggaaaagggatgggcgaggagttaagcaaactcttctaccaatgtgaggtacaaatgcatgtctcaatagtctctcatgaccatgcatgacaagctcaaaccactggaattactcaaaacattttatccatcataaaagtaaaattgcagcaacatatagctctatcagattcccttgagcttctttttcttcacggatatattcagaatctgatttttccttataagactaggaggaggaagagcttatcttatttatgccactcaacaccattccaacccttggttttctggcttcacaagttttaagtgcaaaccccaaaggtaagtgcatcccatctttaccctcgtttctgattcagaattatctgaaatattgctgtggaacagtcattaatggttaacagaaggtgtgtagttgcatctctattataagaagtgtgagcacagggttcacatgtgaatagtccccacctactggaatgaaatatcgatgtagtctggtacagtgccaacatctgcaaacctggagctatgtcataacctcggcttgctttgctccactttgttttgttttctctggttttggttgcatggatggatattcatgcataactatgcttggattgaccgtgtttctttatagactatgcctacatgggttaaatcaaaagacatatcccaatacctttcttttgggacaagtgtcaggagtaagtaaaacattattatgttaatagccaaatcaagggtgggagcctgacataatggaataattgattatggcccagtggagggggagtcactggacctaggccctccacctgaccctgctactgtcttattcttaagcaagtctattcactattcatgatctcagttttcccaactgcagaatggaatggggcagaggatgaacccaagggagaaatgtcaagtaattagaacttctctaaagttacaggaaacttgtagaatgtctcaaataggttccataggtagaataaaagttagagaaatgtgtaaggccagatattggataagaattacctatccaaaggcttgttgttgactttgtcacctcactgctataacctactacccgccatatgcactaaaacacacaatcccatcaggatcacacaagcaaacaacccacaagcagtcttacaaattccatgatgatcgtgatttcctagtactccaaactctcttgaccttcagtatgaaaaaaattatcgaatcatctgaaaacttgcaacaaagaaaatactctcactaaatggaagaaaagaatcctctccttggctatttacttggattttgttttctgggaaacattcagaatttataggatgctgtcctagcaattttttttaaccttaatcagctgatacattctctttaaaagaatttctgcctataaattagtccctcaccaaaaaaaccatattgtttacctagagctctaaattgcagtgtacaggtgaaaatgtgtacaaacgatttaaaaaaaaagaagccttttcacatgctggatcttattagcactggtagtaaaaatgtcatttgaactaagtcatttagaaagatttagtcctaaataaaaagtttatagccatttcatttgcataactgaatatccaatacggacgccaattccattataattgaaatacacctatactgatacgtacaattaggatgcaaaatgtttttaacttttttaaaagtaaatacacttttctcagctgggtaaataaacatattacagctggtaagtttagcatctttgtcaaaaaactattatataaaacagcccttaaccaactaaaggatatttaaaaggcatacccaagcaaccttttgttaaaaggaatggattacaggaaaaataaaggggtaacatacacttccatttcatgttgtgctgaatgggatatatctagtgtttctagaaatcaggttttttttcccaaaggcagagatttttttcccccaaagaatacaatgagatcccaagaaaacaggaccaattaagtgtgaatctgggaattttgtggggaaaaaaaagagaagattcagtcattaatttatgtgcttttgcaatcacttgattaacatttcacttgatatttgaccacaaattctatgagaaaagagatatagtacatgatcagcaagcacctgagaataaatggcatggcataatctgaaagttctccttgataattagagaaggaataattagctttgtctttgtggctccagaggagaaatgggtgcaaggctcaggaggagtttgagactaactgtgaggtagatcatttcaatcatcagtgctgttcaattattgatctatgtgccttggcaagtgaaaggatccacctcagtaggaggcttagaggccagaaagccatcagatagtcacgtttgagggaaagaaacaaatcttggatgattctgaattctgaggaaatccaggaatgcaatgagaacagaactaactaaggggctgtttattgcagagcaatggttctcaagtttaggcatgcataagaatcacccggaggcttgtaaaaatgaaaagcctggaccctaccccaagtttctgatgtagtagatttagaatggagaatctacattttaacaaattcacagatattactgttgctggtggttcagggaccactctttgagaaccaccacggcaaaacagcaattctccaaaagtgtggttcacatcccccggggaaagaatatgttcttatgcagtaggtatctagagcattaagtactcatcaggtcgtatgttaaaaaatgtgctcccttttcattttctgttttagttattgttgtttatgttgactaaaaggattcaaataggtgctagtttttctatgaaaaccctcctgttatttcctaatctctctttttaaaagatgaataggtctcaagctcacaagtttttttttttttttttttttttttttttttttgctggaaacactattgtcttagttgggaccccaagaagcagatctcatgataaggactaaatgcacattgttaatttggcaggtgccagtacactgataggggaataataatataaaaaatggaataagacacagtcaataagatgtgtgttattaagacactgaagcttaatctcacagggaagctttgggaaatggtgtaaaacatatgcctcagaattcttccagacaaggggataggaaggtgggatgtggatactcccgcacccacaatttgttggttagagctatccacagtggaacttggattctcaggcacccccaatttattgtgcttgtgtgcaaaggggattccagtagactgagagcagccctccaaaaatgtttcaggtccatcattggaagtctgatggcttacagagaaatggtcaggggatctgcagggaaatgaagcaacaccaacattgtctgttccagctatttagctgaaatctaatatgaatacactgttcttggtatattgtatttgtttttacagttttcttctatttcttgcaattggtactggttttcgctttcatttttgtttctttataaaataaatttatttaaggaaaattaattgatctaaagaaaaatgtcacacagttaatgttccagatggtatgaaaaggtggcaagaatcatgaaggagtagaattcaaatggctgaagtttgagaaatgcaggcataatggttcaagtgggaggtggcacttttttctgtaaatggctatttaccaaatattttaggctttcaagagcataaggtcactgtcacaactactcaactctgctgtgtagtatgaaaacagccattaacaatacataaatgatggacatggctgtgttccaataaaactaaatacatggacatagaaatttgaattttatgtaatttacacttgtcacaaaatattattctccttttgattttcttgaacaattaaaaaatgtaaacatctttttttttgcttgcaagccacacaaaaacaggcagtgggccagatagtttgccaacccctgattcaaaccacaaccctggaatctgtcctagttctattaactaccaatatgaccttgggcaaattacttgacttctcttagcctcagcagcctcatctgtataatggagataaacataccaaaaacctcacaaggttgatgcaaaatttaaaaatagaaaatgaatactcacaaagcaggtgctcaatgagttcacagtatgacattaaccagctgttgtaataaggtggattccagctttcctgtgccccaatcattgcagggtagatatttcctactctgcttcttcacaaaggcagctgtgtacctagtggcccatctcccctactttgggatgtggctacagaaattattcctcttctctataggataagcctctgaagactgagcctgaaaatgcccaaaggttcttgtcattactgatttcagaggtctggaattgggagcaggtcaaatcaaaatttgcatttcagctaaattaactctttacaactagtattttgaatcttacagaattatgctgttgacagcagtggttctcaaacattagtatatctaaaaatcacatggaaaactgtagattcaggcactgccacattcaaagcatttttgaatcataaatgccccagtgattctgatgaaaatgattcctggagagcagttcaggagacactggaaggatggagtgcaatctgtccaggtgagcatacccttctgaaatcctctttaatgatttttctgtatctgtttaaatgcctcattggctgagacacctggattatagtatttgctctgcatgccaagagaaaggtttctgcaggcatgtttacctctgctgtcctcactctgtgctatttcttctgaacctcctggattaggaaaccatttatacagaattctccatttcagatatcatgtgctaatgatcatatccaattaaacatgccagtgcaatctcaaaagacataggctatttacagcctcttaggtgaaaattcttaagcaaaatctacatttttcctagactaataaaatgtcacctccccaaaggctgctgtctacaatctcctaccaaaagtttctaaaccaacccctggagcaaaaaataaaactatacccatagattttagaggggcccatttaacacagaagaaagggatcctggggaagaagcagaaggaaagcaatggcacatttttataacagaccaagaacctaacccttcacgtgcattacttcattcaccttcacatcacgctatcaggaggttctgcaattattctcatttcacagatgaagaaactgaggcataggaaagaggagctgcccaaagcaattccagaccagagtctagagttttaactactaagttatcccacaaacaacaacaacaacaaaaaacccagatctcaatgatcccctatctcagctctcccagcttaatttactattacttatttagcttctcaaagcttccagaatgtctaccagcacttgaaagacaatatgtttttaactaaggctcaattttgctcttggcatcatgtgactttgagctcctccctttgccccaggtttatcgctgttcagtgtggttaagacatccagcccacctgtcttatagacctgctaccactcatgaagttcaaataagataacttatgtgaaagtcctctgaacaatgcaaaaagttatccaaaatggtaatttctcagtctgtcattttcataaattattttgaaatgttgagaaggaagaaagagtgcattcattttatgaaatcatctgtgtcaaaaatcagattttccagagatctaaggtagattgtaaaataccaaaactgccgatctttgggggagcaaagaaactctactacttggaaggtggactattttttgtggctcaatgtaatggaaattaccagagcttgagaatcagatgacctgggcactggacattgccctgccactacctgaactttagtgagtctttccctctccccttacaggggagacaaagctgcttagtggttaataaggtggttagggccgggggtggtggctcacgcctgtaatcccagcactttgggaggccgagactggcagatcacctgagctcgggagttcgagaccagcctggccaacacggtgaaatcctgtctctactaaaagtacaaaaattagctgggcgtggtgttgcatgcctgtagtcccagctactcgggcggctgaagcagaagaatcgcttgaaccccggaggcgaaggtttcagtgagctgagattgcaccactgcactccagcctcgctgacagagcgagactccatctcagaaacaaaacaaaacaaaagaagaaggtggtttggggattcagactgccagtgttaagtcccagcccaattaccacctcatgagtgaccttggactggtcaggtcacctgtcttggtttgtttcctcagcataaaaataagaataagaaacaacaactttgcaattgtccaaagaatggattggtgaatagatagacagaaatatgacaaagcaactgtggtaaaatgataattatagaatctttttggtgactatacgagtgttcactatatagttctttcaacttttcccttaagtatctattttcataataaaatactggaaaataagcctcaaaaagggcaacaacagagtttttagaaaagttaaatgagacacagagctctcagcaatgctcatggaaggtgcttggcaatagcaatgatgatctactgtgcaggtagaagatgggatacaatctgtgagttagagtcgtgctaggtgaacagatgtgacaaacatgagcagaatgagaagccaggccacatgacacagaaaccaggtggacaaagaggagccaggatgtgcccactgaagcatcagagtccaagagaggtgcacgaatggaaggatcaggatgttgtgtctgggttgcccaatgtgcaggaacctcaaaaagaaaggcagattgtctctattacaagccacagtatgtgattctccatccaacatccctttcagagcagaaaaatactggtcttgaagtcaaatctgagtttaaatcctgtctttgccatactagttgtgtgataggaggggacatttattcaggcatccactacaccacttgccattggaaaaatttaccgcaaccacaaggatgagcccgtggcaactatgcttctgctatgacttcttggtcataaacaattgagccaatcagattctctttcttgagagtctgaactaagagaacagactcctgggaatgtgtcaaactaatggcagagcaatgtggaaagggtcatggactccaggagctgagttttctagaattgactgttttcccatccttcctggagccaagttccttaactccactataaaagcactattgttttttcaataaatcctaattttttgtttaagtagccagtgttggcttttattatgtataaccaataaatacatttactaatacacctagccttctaactaatacaaaagttttcttaaagtgtctaggccttagttttctcatctgtagatgagagagacaatacttctctcaggagttgatagaaaaatcaaagactaggtgtgcaaaacatacatatgataaatattcaataaacattatttaaattaaatctgagtttcagaacagatctttctgagtaagtgcttagagataccttgcttggatggggaatgtgtgatcatgaaaaaaaaaaaagaagctaatattcaagaagaaggaaggagttcattgaatttgaaatttggttttaaaagaaactttctgattgagatatcaaaaattaaattaattctacataaatatgcagacttaaatttctgttgggtttctccatagtgctaatgtggatttgaaaggggaagaaatacaaactcgatggacagataatatatttttcttaacttagactcttcagaatttatctggcagtagacaagatattaaaggacttttgatttggattactctgtaagtaatgaggaattttatcatccaaattaaggtagcagtgggggtaggtggagacaaggaacatgacaagatctaagaccagaattaattcaacctagaagtacaattgctgagaaaaagcaaaggtttttctgaaactcaaaataagaggcaaagcttagatgcttagtaagaatgtcaattcatccctagtaattattgacctttcagtcttgttccactcattgattctcattaatccaaatgtttagttatcttaaaatcagatatattttcattctaaaaatccaggtggctgcattgtgagtttcattttcgttctttaggtcttaacccaatagttctcaaatagtggtctcaagaccaggaacaacatcatcacctgcgaacctattagaaatgtaaattctcagatctcaacctaggtgaatcagaaactttgggagtgaggaccagcaatttgtgttttttttttaagttttaatttgtaatttttgtgggtacatagtagggtacatgagatgttttcatacaggtatgcaatgtgtaataatcacatcatgatcatgtaaaatggggtattcatcccctcagccatttatcctttgtgttacaaacaatccaattattctgttgctcatgaaagtttgagaagcactctcttaaccaatcatgaggctggtgaagccagtgctctatcatttattcactggcagttaccaaacctgtgaacttgttgacatagcacttaaaaaaaaatagtcaaccttctcagacgtgccttagatttgcaagcatattagtaattggtaaatggtaaggcagtcattcttactcagactatacttaaggctagccctatgaataagtctatttggtagccatttacattgtatttccctctgtgcaaatctgtactactttctactgtctcaatagcataaaaaagtcaacagcatgcagaatggaggaatcaaagggcaaaccaagaagaataaagacagagttttttttaaaaaaaatggtgactttaattttgacaagagaagaaattttagattgatggtaaggagaagttaatggaaaaataaaggtataattcactgttccttcctccatccttcctctcccctgcacctccccacttttccattacccaacactgccaccacccctttcactctgcatatgcctttgagctatttctgaataacagagagggggcaaagtcataaaaatgagagaaatcacatttcagctgaacacaactcacaaccttatagtatctagcctgttttctagaggcagacttggatatacaactgggcttgaggatatctaagctcttttctaccctgtaacaccaagatcccattcatgcaaggcactataatatggaggttcagagcatgaactctggaatcagacaacacacaatttcatcctagcttcactactccacagctgagagaacttgggcacattactttacctctctaaggttgagttaccgcattgctaaaatgagagtaacagaagtatctctttcataggattcttaatgaagattaaataagatcattctcattaagcatttagaacagtgtctggcacatatcaaggtctagattaatgtgggctattaagattattattatattgccttccaaatgcttctcaaccttcagcagcatgttgagcattcccaggcatagcaacaaggcagtgaaaagcaagagggataaaggtaaatgtgtgaggatggtaaagttggaagggggtgggaaggcagctagcaccacagcaattcatctatttatttaaaaactttgttgtcagatgttgctgtacaaggttacaggactcgtgcttgaattacagcagtggttttcaactggagtggtaggaggaggggtactttgcccacccaccccccggacatttagcaatgcctagagaaatttctggttgtcccaagtaggggttgctgctggcatctaatgagtgccagagatgctgctgaacattctatgatgcagagcacagtcctcacaacaacgaaccatctagctcaaaattccaatagtgccaagaaatcctgaactactgcatgctgtgaagttaccttaataatattattgaatattattgaataatattattgaataaaaatattcaataataatattgaatatttttcaatattcaaaaaggcagtgatatggaagactgaattttcatatcaacaaattgatcagttaaatatcagaaggtaatcataagaaattaggtgaaatgtttcttgctacaaccaagaacatcagtggcaatcagagaattctagcattgaaagaacccttggaaatgatctagtggctagattctagctgaaatcattcatcacatttcacaggtgaagaaactaagacttagaaaggcaaagaaacttgatctatgtcactcaatgatgctatagtcattatccagattcttctaaaaaactaatttaacttgtcagacagtgataatatcaaaggtgttcaattcatgtatttgctttgcattttttcagtgatcatagtctatatctattcctatctccagaaattcccaagtaagggtcttacctgataacgtggtagcagtgggaataaaaagaaaaacaaaatagatttaagaggtattgagggaaaaacagataaaacctgcctatagatgaaaactatggcagctactgatgaaggaagaggaggaataaaaaggtgacttcagttcccagcctgggtgatgtagaggatggtggtgttcaataacaggtggaaaaatcaggaagcgtcttggggtagcaggatgcttatgttgggtttcaggtgctgtcctttagtctgtgaagttggggaaggagatgaggagatgaacagaatcagggaggtccagaagagcagggtgaaagaatatacatttgatttgttggcttcaaggatgcttttgcccctacagggaacagcatcagaactgaaatccagataactcagaggaaccagagacactactgtcctctgggccctggggcctccttctgctcgatatgaactgaactaaatgctccctgaagctcctgctagcttcagtgagctacagttctcctggcatttaaatgatgactgtggctctcctctataataataattataataaggatatttcccacaggagggaatgatgcaaacgtaagagagattttaagatgagaatgcaggaggaaaataaacatgattaagaaatgacttgctaatgctgcaaaacctgtttactttttactaatttttttcctgacacttgtatatttcctaggtgagagctgctcttcagaactctgcaggtctcatcccttccctgactctttccttgttttcagggcaccgcatccaccacccacgtccttttccttcaaaacctgtgctcaccaggagcacgcagcaacatctcccttggtcactgatgctcaagttccattccagggacagggtaaatatccactactgctcaccacagtcacccacagctttaagggccagagaatccatcccagcgatggaagacagggagggcaaacttgaaccagtgtccttccatcaaaagcctcctttggttcatgccaaacctataccctaagaaacattctgtttcttcatttgattggaccaaatggaaatcaagccaagattttctcttaacattgaactctaggaagacaagctcatgcctaccactttttgacctctgccagctgccacttccttgtaccaacatccacttctttcaaagacaactaacagcacagtgccgcacagggtagcaagctgtgaggaaatgcatctgaaatcgggattgggattctgtgaaaggcaactgcaggatggttgcgagtaccggcagtgaccgccaaggctttatgcagcacatcgtacccacacactcatggctacgtatacacacacatcaaagtggacgctcaagacacactatcttgtctctctctctctaacacacacacacacacacacacagcacactctgggctgcacatcaaggaccagccatagagtccacacacacatccagttacacacttggctatggatgcacagcctgtgcgcgctctctcttacacacacgcacacacacaaatctttacatacacaacctcccttgtatagtcagtgagcacacatgcagtttcacaagtacttacatacacaagtggaaagcaccagccccaagcctacagtgatcccacgctggaaacacgttgtatacaaccagccagcccacctacaccctgagccgccccgaagcccaccctgccgcaaagccgggtgtcctgagtccagaacccccaagcccccgaccccgtcgtgctgccccgcccccgccgcgtccccaccggcacccgtgggctcctggggtcccgacccccggcgcacttgccgcacatacccgctgccagaggcgagggagcgaggtgccctggcagattcgagcggccacccccagccgctgagccgagcttctgctgccgccgctgccgctgcgctcccagccgctgcctgcg

SEQ ID NO: 1244 - DNA, 186030 bp, Homo sapiens
ccaacactgtcctccatgtacctcctctgggctctcagcccctactacctgatgcctcactggtggtgatgaggttcagaagtgatgccagggtgacctgttcatgcaaacatgaatgcgaatgaatggctaagttgtgagccatgtcctcaatcagaagcatgattccagggattctgggtcattgtgtatgggcagtttctcgagttcctgatgatgtcccctgtgcagaacggtgtacctagaaaggaaggaaagaaggcatgagaattcaacaggcatgctccaactgcaccgaagtcaagagcactccttctactcttgacttcctttctttgcatacttctgagggtatggtgaagtgggagtggggatggggtgatacttcatagagatagaaaaccaaatgaactgcacccagattactcatattaaatgtggagaaacagtcctggaggaaacgacaggcctaggagtgcatagggggtaagtggcagagctgggacaagaacccagatttcttactgccaacaaagcctggggttcttgtgtcactcatcagaatgaaccctatgtaccacctcaagctgtacctgaatatgctatgtcctatctaccagggatagttttgggttctgactgctgattgagatgaataaaccactcagagcctgaaatacaatgtaactgtatttgttactttcattccttttggtgccatttggaacagtaaatcaattagatgaatcaaacagcaagttgacactaagcatcacagtgaaatttactacttgacaagtgtttattatttttctgccgtatcatacaattgcactcaatatcttaattgcctttaaatgcatctcaattgcaggcgagtctcatcatcagttacccagattccagcatctggcagccattcctatgaaatttctacagattttagaagcatgttcaccactcatttctctgaggccagtgtcaagcactttcagtgagacaaacaaacaaataccattcagctatttggcatcatatgttgacaaaacaacttggtggtagtttctcatgacttacattgatgctttgctttgaattacaataatttattgttgatttgtattgacaaattggtttgtactaagccctctccataaattactttatttaatccccataattgcctattagatagtatcattttcattttacatgtgagcaaaataacgcatagtcaagtttagtgatgcccatgggaatataggtcatacatgaagacacatccaatcaaacccactctagctcatgccaatacccatgtgtttaactggttctcacaaagcccatggactaggtataagtctagaaaagtggttctcagcagagagcattttgtgccccaggggccattttggaagcatttttggttgtcactgaagaggtagctctactggcacctagcgggtagggaccggggatgctgatcagtgttgtacgatacatagcacagcctcccacaacaaagaattatctggcccaaaatgtcaacagtgccaggattgagaaaccctaatctagaataactagtccctttagctggctagaagcaggtgttgattgaagaacagggcctcagtgaagggcatgagtccgagttctcacagaaccgtccaccgcagctgttgttgagagagagctaagccaaggggatgtgacatacagaaccaaagcatctgctactacttgccagataggtcagtgttaagaagaataaaatgggaaaagagatagaaagggccagatcagccactattaactagggtggccaggaaatgtcccagtgagatatgcaagaccttagggaagctagagtcccagctagtgagtcgtagatgctcagcctccaaaccatgccttgcgtacttggctttgccattctgcaaaccaaatgtctgctttgttggctggcttcttgtgcagctccatgaacacagggtgtcacaggggagtggaagctggaggaaggaaaggggctcgctcctgtgagctttctgtctgctgtggttcctatatacgtcattcctggaatgcttctttacccctcagaggcagtgcttttccggagcagcagctgagtccaggttagtctttctaactcttgcagaaccagccttacagcagcccctcagaaacatcaggttcatctggacagtccctctttctcaaaggtctaaatttctgctcagtagggtccctattctaagtgtctaagtttttgtgattattttatctattttctcagccctagagctagtagttgctccctgcagttgctaactccataatactgcagagcattctttcagtgttaacgactatatgcctagttagcaatattttatgttaaaatggtgtttaaatactcaggccgtttctgtctcctgactgagccctgtgagatatagtgagaaactgaggcatgtgcctatctgggaaaataacattctaggtagagggaacagcagatgcaaaggtcctgaggttcgatcctgcctggcatatctgaagaacctcaaggatgcagctggttgaggcagaaagagtaaggggaggaatgaaaggagttgacgtcagcaaggcagccagggccaagtgggcgggggtgggcttgaaaatccctataaggctctggcttttactacatgtgaggggtctgagcagagcaccaacatggtctgaatggcctctcagcagactccctctggatgctctattgtgaatatatgggatggaggtaaggtgtggacagtgagaccaattaggagtttacagcaataatccaggtgagagaagacagtgacttggtccaggaagtagctgtaaaggtggtgaggaatggtcagactctggatatagaaatataactcccagtagccattgtctgatgtatttaattctgcaaaaggtttagccttcacaacttttctcaggccctgtcatgtgtggttatttccctttgccttgtcttgtcagctagagggctgcgttatgcagaatagtaaccatgaccctcacttgagtcaagcaaacctagttcccattcaggctctaccacttgccagctttgtgacatttgacaacttatttaatctctctatgcatcactttctatacctctgtaactgaggttaatgatacctaccacatagctttgctctgtggattaaataacataatgtaagaaaaacattaacacagagtctgccacatagtagaagctcaatatgttgaagctaaaattattttttttactttttaatcttaattttactattttattgagattaaaaagtaccacttaccaactttgtgacatttggcaagttatttaatctctctatacctcactttgctcctctgcattgaatgaagagtatgtaatgataatgatgataatgataatgatgatgatgatgtacacatagccttaatggcttagaaatatttttctcttttatttcctttttggatgaaacttaactggcctcaagatatagaagcctccctgactttgcctttcccttctcccttatcagaatcacaaagccctcttttggcaaatatgcgtactaaagcaacaccaattgatttccctatcaacagactccttttataatcacagttgctctgcaggccaggcaaggcaggtgataagactggtattatacagaggcgagaagtgaggctcatagcagctgagtgagtctcctgagtgtcatgacgggtgagcgcaggcctggccaggaccaaggtcaggaaccccttccccattgctcttgcccctgagcagcattgcttaatgacttatgtatgagtcttcaaacaagggctcaggaccaaacagccctaggaaatggggctacgctttagtatctgaggtgcagggatatccctgaagtggatgtttgtgcaggagaaaactgaatgacaatactaagaaatcatacacagctcaatttattaagacattaggatgtgtgccaggtaccatttttggaagttacataccttatttcatgtatacaatttactttttatactcactaagtggcaggtgctctacttagactgttcttacagattagaaaactgaggctcagagcagttacgcagtttatctaaggttacaacatgcatggtgcccgtacccttaacctcagaacacactcctgaacctttgccctgttctatggctaatagatcactttcactggcaagcaatgacaccttctcctacactgagttcgcatgaaaaaggtatcctagttgagaaggcaaccagacatctgtgaccacgtaaaaagatgtactgccgtggaatgcaggcaacctctacagcagcctgcttttcacacgtctctcctcataagcatctgtttctcatgtgctaatgagtcacttgtcaggaataactagaaaagaagtgtgggaatggagtggatattccaaatggagtttccctttctccagagggcagttgaaaggcaacagctctctgtggatatgagagtaagcagatgggcacgttttccagttacagttgatcgttgaacagtgtaggagttagggttgctgatcccctgtgcagttgaaaaatctgcatataagttttgattcccccaaaacttaaatactggtagtttactgttgactgaaagccttactgataacatagtcagttaatgcatattttgtacttataataaagtaagctacagaaaatgttattaagaaaatcataaataagagagcatatatttactatttgtaatgtggaagtggaccatcataaaagtcgtcatcctcagcatcttcacactgaggaggctgaggaggaggaggatgaagaggggggttggtcttcctgtctcaggggtggcagaggctgaagaaaatccatgcgtaagtggacccagacggttcaaacccacgttgttcaaggctcaactgtacaacatttgagtggttcctctcaccatggtatggtgactgatagacacaggaaggaggaactagtccaagctttccttggcaggagtctagcagaggacagcacatcccaactggagtctggcttataaagacataccctgggtttgagtattcccaagtctgcatgattcaagcatatatttttaagttggtattttcactttggtaataaataaataataggagcagatctggggtcatctggttggccaccttataaacttacattgccttgtgaattcagagctcacagttgcgttcatgtacacaccgctgttgctggctaactttatgcactgtctctaactggagggtgcaaacctccagcagtctgtaggcccattcatggggatctaaacatcctcaatttgggaaatattgagagaaaagaaagcacagggtactgcaggcaaaccgaatagcattcaaatcccaaattaccatctactagttatgaggcatggtcaaataagttactcccacctccttgacacctttgttgtgaaagtgaacatctacaaatgccttaacagaagggctgggcacacaatggatgcagtaatcttcactggtaagtaagacgagattcagaaaatgtgagtttcctaggctcaaagaaataaataaatccggaatcattaagaatacaggttcttgaggcagaatgccttggttcaaatcctggctctgccatttactaattctgtgaattatcacaaatgttctggcttgttgtagacattaaatgagataatgcacatataatgtttattggaatagtgccagccaaaaagtattgctcttatctgatgattgaggtagaacttgaactcagtacaaaattcccaattcagtgcagaaatcctttcctcagtaactgaacaaacgtttattcacttgttaattgatcacagagctaaggaaaccttaaccctgtgatcaattaaggtcacttagagcagcttggatttgggaactagtagtacaataatagcccccctctgcctgcctagcctggcattatctgtaaatggctttacaaattaacagctctggaaagagacaatcatctgtcagagtggcaaaagtctccctgttccatttggtgcgagatcttacttgccttctcacagctgctttggtggtaagacaactctagatgagtgggtatacctgggcagtttcacatctaattaaaaaacactgctgtttctcaagcaacagcaatgcaagcgacaactcccttcaagctgggttgcttcccccatttgcattaatttactcaaacatgacgggagccacattagatttggtaattacctgagtctacaattcattcactgagcaattagcatcgcacttagagcagcctggatgtggtaattagtagcgtaataatagccccctctgcctgcccaggctggtattatcaggaaatgattagactttattatacatcaccccagccttctcctgcaaggcagtgttcacaaagactgggtgaggagggaggtttgctagatgttttaatcatcaaaatatattatatattaatatatatttaatatatcattaaaatatattttaatatatcattaaaatatattttgatatatcattaaaatatattttgatatatcattaaaatatattttggtatatcattaaaatatattttggtatatcattaaaatatattttgacatatcattaaaatatcatatattttgatatatcattaaaatatatattttgttatatcattaaaatatcatatattttgatatatcattaaaatattaaaatatattatattttaatatatatttaatatatcattaaaatatattatattttaagatatattaaatatatattaaaatataatatattttaatgatatatttaatatatcttaagatatattaaatattaaattaagatatatttaatatatattaaaatatattatattttaagatctatttaatagatcttaaaatatattatattttaatatctattaaatagatcttaaaatataatatattttaatatctatttaatatatcattaaaatatattatattttaatatctatttaatatatcattaaaatataaagtgccttggtttaaagagattcaaccctaaggcagtttcacaaaagccagagctctgttagctggaaacaaagattttacagttggtattttttccatgaacacaaatcctagacatttattcatccagccacttatttactaaaatttttttttttgattgcttacaacagtccaggcacagtgccatgccttggacatatcagagtggagacacagtccctgtcctcatggagctagcagtgtagtgtgagagaccacagccagctataagattatagctacaagtagtgtcaggagtgagaggtatttggtgatgctatgagagcatgtcagaggggggatgagatctcggttagtgtgtcagggttctgtcactgaggaagcgacaggagatgagaactgaaaattgagtaggggctcaccaagccagggtggggaggatgcaggcaaaaggaccagcaagagcaaaggcccacagtcctgggggcaggcccatgtggtgagaggggaacaaagtaggcatcagcctaagatgagggcacaaagtcagcagggacccaccacactaaggactgttgtcctcgtcctaaaagcaataggatggcagccaagttcatgagcaggggaggttcctgaagattttatgtttttaatgaacattctggctgtggtgtgttgaatggactagagtgaggttggagtgaaaacccaggggtaaattaggaggtgtattagcttcctgttgctactgcaacaaattaccacaaacttagtagcttcaggtaacacaaatttattatctcgcatttctggagcttagaagtcctgtatgttggtatcagtggaggtattgagatgtagttggattcaggatatagcttcaaggtagagctgacaggatctgctgatgcattgactgtaggggcagtgaggacattccaggcatgggcatggagttggcatgactgtaattgatagactgttagagactctgagtggacaagtatatgagagataagaactcgaggggggagggcaataataggggacctctcaattttgtgagtttcaccttcaggaactcaaccagatttcactgtaaatatctgagaagaatcccctcatgcttctgacagggaggagggaagtaattattttgaaatattccagagcattctgttcttaatgaggtctgccttcaggagaaatatgtagcaagcctaacctatgagaattttatctagcccagctgaccttgggggaagggaaatatccaactccagcccccttaagccacccaagaaccaaagggggtgacaaactaagaagcacgtgtgaagttcactcacagcccagaagcacaggatctctagaagacagagaactaatcacaggactacaaaccattcccctccccgcataccttaacaccatatgggtaaatagtgtgcctgtttactaaagtgtctttaccaaagacatcatgtgtagctatcaagaaaaaattacaaggcatagtaaatggcaaaaaacaaaaccaaaccaaaacaaacaaacaaaaaaaaccacacagttggagaggccagcttaagcatcagaaccagaatcagatatggaagggacattggaattatcagactgggaacttaaaacaactgtgattaatatgctaagggtctaatggaaaaagtagatgacatgcaagaacagatgagtaacgtaagcaatgagatggaaattctgagaaagaaccaagtagaaatgttaaaggtcaaaaacactgctgcaaaaatgaagactgcctttgatggacttattagtagactagacatggttgagaaaagaatctgtgagctttaggatatctcaatagaaacctccaaaattgaaaataaaaaaaagacagaaaaaaaatacagagcacagtttccaagaactatgggacaactaaaaaaaaaagtgcaccacaagtatacaagaaaaagaaaatagaaagaaacagaagaaatatttcatggagaataaataatcatggagaatttccctgcaaatgaatgtcagatgccaaactatagatccaggaagctcagagaataccaagcaggataaatgccaacaaaattacaaccaggcatttcattttccaactaaagaaaatcaaagataaaaaattctgacaaaaagccagagtggaaaaatacttatagaggagcaaagataaaaattacatccaacttctcagaaaccgtgcaagaaagaaaagagtagagtgaaatgtttaaagtgttgagaggaaaaaaaaatggcaacctggaattccaaccctgtgaaattatcctccaaaagtaaaggagaaataagaactttctgggacaaaaagaaattgagggaatttgttgccagtatacctgccttgcaaaaggaaaaaatcttcacagacattatttagatggaaggaaaataaataggccagattctcagttttacatagaaaaaggaagagcatcagagaaggaataagtgaagtaaaataatagcttttatttttcttattcttaattgctcaggtagataacagattgttcaaaataataatagcaataatgtattaattatgcatgcttttatgctcctcaatggagttacatcctgataaatccatcataaagttgaaaaattgttaagttggaccatcataagttggtgactatctgtacatatgtttatgtgtaaatgaaatgaatgacagcaatgaaataagggatgagaagaggaattatgattattttgtcattataaggtatttgtactaccaaaaagttgtatagtatcatttgaaagtggacttggattagttattaaatatgttttcccaactctagggcaaccactaaaaaaagtaaaaatagaagttaaactgatatgatagaaaagatagaaaatagaataatataaaatgcttatttaaaaccacaaaaggtagaaaaagggtagaaggcaaaaataagaacaaagaacgagggcaacaaatagaagacaaaaaattaatttagcttttttaagaatcactttgaatgataattggcctaaatacaccaattaaaggacagagattgtcaaaatcgatcagaagtaagaccaaactatatgttgtctacaagaaacccactttaaatttaaagacatatagattaagagtaaatggatggagaaatatataccaaggtaatattaatcaaaagaaaatgagagcagttatattaattttaaacagaacacacttcagagcaagaaaagttatcagagataaagaggtgcattacgtaataataaaggtgtcagttctccaagaagacataataatccttaacactgcatacacataagaacagaacaccaaaatacaggaggcaaaaactaagaagtgcaaggagaaatagataaattcacgattatagctgcagacttcaacacttctctatcataaatgaacagatacagaaggcagaaaattagttaagggcataattgaactcaacagtactatgaatcagtaaaatttatatcaatagactactttacctaacgatgccaggatagacattcttcttaagttcatatggaacatttaccaatatattacacattctacataaaacttaccttaacaaatgtaaaagaatagaaattacacaatgtctgctctcaggccacagtggaattaaagtagaaatctataacagaaagataggtggaaaattctgaaatacttggagattcagcaacacacttctaaataacatatggatcaaaaaagaaatctcaaaataagttataaaatattttggactaaatgaagaaagatctaaaatcagtgatttaagtttctaatttaggaagttagaaaaagaagaggaaactaaattcaaagtaagtagaatgaaataataaaaattaagggagaattcagtgaaattgaaaataagaaattcatagagaaaatcaataaaacaaaaagctagttctttgaaaacaataaaattgatacatctctagccagtctaaacagaaatgaagagagagagaaagaacaaaaattattaacataagaaatgaaagaagcgacatcactatagacaccatgggcattaaagggatagtcaagaataatcaagtactacaaaatatgcccacaaatttgataaccttgatgaaattgaccaattccttgaaagacacattctgctaatacacaagaagaaatagacaatatgaataagcttatatatatattaaagaaattgaataaaaattaataacctttcaaaacagaaagtaccaggctgagatgggttcactggtgaattctgccaaacatagaaggaagaaattataccaattctctaaatctgttttagaagatacaagcagagagaatactttctgactcattctatgagcattatcctgtaccaaaaccaaagacattacaaaaaaacaaaaaaccctataaatcaatacctcttgtgaacatagatgcaaaaatcatcaacaagatattagcaaatcaagtctaacaatgtatacacagaattgcccacccaactaagtggaatttatctcaggtatgtagggcaaatacaacttttgaaaatcaattaagtaatccatcatatcaataggctaaaaaagaaaaatcacatgattatattaataaatgcataaaaaacatttgacaaagtgtaacctcaattcatgatttaaaaagctctcggtaaactaagactagaggagaactttattaatttgatatcgaaaatctacacaaaacccacagctaaaaccaggcttaatggtgagaaactcaattatttcccctaagatcagaaagaagtcaaggatgtccgctgtcaccactgcttttgctttgctttgcttttcatttctttttttttctttttttttttttttttttttttttgagacggagtctcactctgttgtccaggttagagtgcagtggtacaatcttggctcactgcaacttccatctcccgggttcaagcaattctcttgcctcagcctcccaagtagatgggactacaggcatgcaccaccatgcccagctatttttgtttttttttgtatttttagtagagatggggtttcaccacgttggccaggatggtctccatctcctgacctcgtgatccacccagctcgacctcccaaggtgatgggattacaggcatgagccaccacacctggcctgcttttcaagtttgtactggaatgttgtaaaattgtaaaatatgtacaagatttatatgaagaaaagtacaaaactctgatgaaaaatatcaaatacgaacataaatggagatatattccatgctcatggatagaaaggctaaatattgtcaagatgtcaaggcttataattgatttatagatctaatgcatttccaatcaaaatctcagtgaggttttttttttttgtttgttttttaacaaagaataactaattctaaagtttatatgaagagacaaagacccagaacagccaacacaatattgaaggaggagaataaagtcagaggactgatactacccaacttcaagacttaatataaaactgcagtaaatgaagcagtatagtttggccaaagaatagacaaagagatcagtgaaacagtatagagagcccagaagcagaccaaggtagatatagtcaacttatctttgacaaagaagcacaggcaatacaaggaagaaaagatagtcttgtcaacacatagtggtagaacaactggacattgacatgcaaaaaaaaaaaaaaaaaagaatctagacacagaccttatatcttgcagaaaaattaactcaaaatgcatcatagagctaaatataaaataaaaaccatgacaattctagaagatagcttaggaaaaaatctagacaactgttggtttggtgacaacttttcagatataacaccaaacgtacaattcatgaaagaaataattgatgaggtagactttattaaaattaaaaattttgctctttgaggttaagagaatgataaagcaagacatagactgggaaaaaatatttgcaaaagacatacctgataccaaaggcatactattatccaaaatatacaaagaactcttaaatttcaataatgacaaaatgaacaacctaattttaaaaatgggccaaagaccttaacagacatctcatcaaagaagatatttagatggcaaataagcaaatgaaaagatgctgcacatatatcatcagggaattgcagatggagatgagacaccactacaaacctataaaaataatcaaaattcatcatactgatagcatcaaatgctagcaagaatgaggagcaacagtaattcatacaaaattggttggaatgcaaaatggtttagccactttggaacacagtttgtctgtctttttacaaaactaaacatattgttatcatacaatccagcaattgagcttcttggtatttacaccaaggagttgaaaatgttgatgcaaaaacctgcacacatgtatacaggagctttatttgtaattgctaaaactggaaagcaaccgagaaatttttagtaggtgaatggataaattgtagtgcttctgacaacggaatattatactgtgccaaatcgaaatgagctatcaaaccatgaacagacatggaggaatcttaaatgcatatactaagtgaaagaagccaatctgaaaagtttatgcactgtattatttcaaaaatatgacattctggaaaaggtaaaactatggagaaaataaaaagatcaattgttgccagaggttggggtgggggaggaggaggaagagataaacacgcagagcacagaggatttttagggcaataaaattattctgtaaaataccacaatggcagatacatgtcattatgtgtttgtccaagcccacagaatgtacagtactaagaatgaactctaatgtaaactatggactcagggtgataataatgtgtcaatataggttcatcagttgtaactaatttaccactctggaagaggatattgacaatgggggaggctgtgcctggggtaaggaggcatataggagatctctgtaccttcccctcagttatgctgtgaacctaaaactgctctaaaaagtagtctctttagaaaacttttttaaaaagtaccttatttagtcacgatcaattgtttaagaagtatgaaggagtccaccacttacagccaaggagataaagaaatgaattggagcactgggggtaatccagatgagaggacttctaagaatcacagttatactgggtgatttcagctccatcgcagtgctcatctcccacagggcttgtgaaggccgtgctcccagaacagggaagaagccaaacccatcattaaaacatttaaaaatagaaaattaaataaaccactgaaactatattaatatgggctctgcagttctgtgccaacaattgtgcacccttaactttgtcctgtgaggacagaagtataaacagacacttaaggatattttgtataaagaaataaataggcagacacagacagactcacaacagacagtgacagacttacagagcactttcagagttagacaggaactggtctattgcagaagagcaggaggaagctggagacaggggaacagccacttttagttgaaacagaaaacagccacagatgagggagagccaagcagaatttgggaaagaaaaaagaaaaaaaaaacatagagattagtagacacatgatctcagcctaaataagcttgccaatattcttaaagtgcttttagaggaggataaggaggggagcataattattgcacaacatggttatgccacagtgtacgtctaaaaagcacacttaagttagtgtttcatctgagtcttgcaacaacttgggatgttcacaggacacattactaccttaatttaccaagtaaggaaactcagcctcttcttccctcctgtagctaatctccatgatatgtctatgttgaaggatctttgaaaatatagttgaatatatatggccacttcctccatatagtcatctctgaccgtctcaatgtgatactccctttccttcttttaaacaaacagcactttctgcttctgcaattcatttaacaatacaaaccgctgtggcttgttaaatgcaactgcaagtgaattgaaatagcacgttttcagataaattacagaccttttggggaaaggagccatgacgtactcattcagcacagttagatatgtcactgaccattaactgagcaatggtggctgagagttaaatgtccagaattctaatcccagctccattactaagtagccttgcaacctcagtcctccctacggttcagtttccacatctacacatagagacattaccagtaccctctgtcagagtgttacagtgaatagcaaatgaagtaagtcatgttcatcatatataaataattcctggtataacatttataaatatcagctagcatcattttaatgcaactttaagttaaatacatgattaagtggtcatttagacctccaattttttcttccttcaacttgatttgtcttgtatttcattagcctgatgatatgccttggtatcctgaactaacaaagctctcttagtgttaccatctgaaaactacgtctattttatgaaaatttccaatttcataattcataagccagtgtgaaaatttaagaaagaaactcaaacattttcaatgggctctagataatcatttgaaaatttaaatatctgggtatctgcatgtcatgcttctctgaaaattaaacttcaaggcaataaggatccattcactcaaatagcaggattgttgaattttagtgcacaaagggtagccaaaaccattccttcactcttgatctcccacaattaagcggtgttgaatgttcctgcgtggagctagaattacacatgagataatattataaaattattacacatcaccaatatctggcatatatatgttattttattagaccttaataattatttaattatgatcctaacaacttttacatgcctatttaatatttcttcctaaattcaggtaacaatggtgggtttttttggatgcaacccttaaggagttaaatgactgaacttttgagtgtgcaccatgtagataatatagacatgtctgaaattactgagcaaattctggcaaaaaataaccacagccctttccttgtgaaaatttcagaagaggatataatgcttatgaacacttgtttccaccacaacatgcttaaaaatgataaatgtgattaatgtcacacaataatgttaagatgaaatctaaggtattactataaaataaaaatttagattttcagaaactgtataatttgtataacatgccttatccacagtctcctattcatgtcagccttgctggattaacagtatagttttcctgagacctctggctgtttgcatttttcactggctcgaatgaccatgtaaaaccacaccaactttaacatatgtttttacatacagagattgtcacttacatttgtattgcaaaccataattgtacaaagcccttggacatccattattttgttttctactcaccacaaacccttgaggttggtatggtgaaaaggagtgttacacatttcccccaaaccccacttcccagacaatgtagaaaactttaaatgaccatggcacagcctattctagaaggtcagtcttcccattcttaagtttggatatgtttggtacaggtagggccttagcctgtcagcctgggatagagctgaggtaggtcacaggcctaggaagcagcgcaggtggctgttgtgttagctgttgtgtgaatggtgatgtgacaggccagggattggttggtggttagccaactgcctggcagcaggtgttaggaaaactcaaaaccaggaagagagggcttatgtagccaacaaagagaagaggtcagtagagacatgggatcccagaacattggctcagagtgcttcaaacacctggatagctcccagacctgctttgagtttctaagaaccccagctttcctcattacttctatctcctgtactctggcaggaactcttggctacttaaaatggtcttatttacaaatattgagttataagaccttacacttgtttgcctttgccttagaaggaagaactgaatctatcccaccatagggatccataggggtgtctttctaggaagggaggtcttcttgtccccttcctcagactgagagctctgtgtcacaacagttggggaacaagtctcagaactgcttctaagcacagcttacttccatcgttggaagcagatgtcatttgcttatcctagcatggcaaaaccctgtctacaaagtgtattttatttattctgccctatacatcaaggacaatgctgaagagtcttgatatggctggctgtgtcccctcccaaatctcatcttgaattgcagttcccataatccccatgtgtcgtgggagggacccagtggaaggtaattgaatcatagaagcagttacccccatgctgcttttctcatgataatgtgtgagttctcatgagatctgatagttttataagagactttttccccttttgctagggacttctgcttgctgctgccaagtgaaaaatcatgtatttacttcccgttccgccgtgattgtaagtttcctgaggcctccccagccctgcagaactgtgagtcaattaaacctgtttcctttataaattacccagtcctgggtatgtctttattagcagtgtgaaatggacgaatacacttcttaaacataatttttattatttttgcagcaacaataccaggaaacacaaatttacatactgctccacagtaaagtctatttgaatctcctgacttaaaaaaaatctgagctaaagctggtttaagtactatagaaacaacggggtgatatgaagatatgatgactccttttataaactaacttcaaaatgttagctttttttatagtcatcagctcactctaacgctgtaccactgtgatcttaactttgtttaaacatcaatccttgtgcacactgtgcttaaatgagtcttgccatagcctttggcctacaccaaataataaaacggttctgatctgactacacaagatctgctgtcaaaaatgtcttgcctcctcacctgaacatttccccagtccaaaagctctgcttgtcgtagtggcagtctgagtcctggcacattctgaagccagctctgcagcataaacaataagttcctacacgggggttgtgtttgtttggtcagagctttatccactaggcttggtcatcagcagttggctggttacaaatgcagtcctgagaccaaatggctggaatccaattatcccagcttcctgtctgcataaccatgccagggaggaacatagtcatgtttgcctgccttgtcaggctcctaggatgcaaagtatatcatttggagaaaactaacaaacaacagatcctcagatattttgatggagaggcagtatgatgtggaaagaggacacattggtccagaatgcaaaatctctggcgctagtccacattccgcctcttcctggctcagtatctaactcttcatttctccaagcttcattttctcatgtatcagagggagatcacaacagcaacaacagggtggttgggagcttctagtgagatgatgtacgtgaaagagctttgaaaattataatgatgataatggtgatggtgatggtgatgacaacagcaatgatagctgacagttattgagaacctattgtgagaagggcactgtcctatttgtttgatggtcactatcttatttaatattcacaagtatttttgaataactgatgacagtggtaacggtgctattaataaagatagctaacatttcttaaatatttactatatataagcctcctttttcagcattttaagcatattaacatatgcagcttcccatcatgtaaaataagtgctattatcatctctacttgacatatgaggaaaattagatacagaagtttggcaatttgctcaagatcatactgacggtaagaggccataaggattcaaatgcaggcattctgactatagaataggagttgccaacttttttagagttagcaaactttttctgtgaagggctagatgtaagtattttaggccttgaagccacatagagtctttgttgcatattcttttttgctttccttgttttcctgtttgattgttgttatttgtttttatacccctttacaaatgcagaaaacatttttagctcaaggatcacacaaaaaaacacacatatggctgaacttggcccacagagctgtagtttgctaactcttgctctagaagtaatttcttttttttgagatggagtctcgttctgctgcccaggctagagtgcagtggcaaaatctcagctcactgcaacatccacctcccagattcaagcgattttcctgcctcagcctcccaagtagctgggattacaggcacccaccaccatgaccagctaatttttgtatttttagtagagacggggtttcaccatgttgaccaggctggtcttgaactcctgacctcaaatgatctgctcctttcagcatcccaaagtgctgggattacaggcatgagccactgtgggcccagcctctaaaagtaatttctattttacagataagaaaactaaagatcaaaagcttcaggaatttaactaaggccattcaataagtgctgaaatcaggatctgaatccagttttgcttactttcaaaaattgtgtcaacccacactacactgtctccgtgtatgctgttaaaatgtaggatattattactgagttagggatactgtactttctccagtcaattttcaaattgaatatagtttctcctcttggaacagacttgggggctagatagcaggctgagagctagccgaccccatgcctagtacaatgcctgacacatagcaggcatataatacataactccctgttgagtgaaataattctgatttctgattgaattcaatcattccccaatatctcagccattttcccagactcttctgtattttgcatttgaatcatgccttccttgtaaaggaaggcaataatatattccttaatccagtttctagggaacctggaacaatttatgagataatttccatagaactatgtggaggaaagaaagatgttatacgtagaaatattatttttacaatgagtcattgtgctcacaaaaatggcactagaagactgtacttatgacttctaaataaatacatcactaaccacaggcaggaaaatagggagaacctagtgactttattataaatcactattgttgtatccaccaatacagattcacattaaagcagggattttaattgttatttaacgttggatttttatttcagggaataaatgaacttcttagaaatgtggcaaaaattgtgtgcatatgtccagatttttagggaaaagatcatggatttcatcagactctcaaaaggattttttatgccctaaatgttagcactacagtagaattgtttcagtgtagtttacctttgatgagaaaaagggaaacacaaaaagttgctggtgtgtggtgatcagtactaggttttccaggtgtccctgtccgtgtgatgctttcttatactctcaggatactcacatagggttccactcaccagtttcccactggcataggtgtctgggtctgcaaaccggtctggaagattaatcacagtccaggctggccacagtgaccagcattcagagcacccaacagggtatatgcaaccacagaaggtggcaatacagagtctcttccattttatcttcagccccaagatcaggcccatagagactggcataacaagccctgagtctattattttgcattactagcacttagcacaatgcctggcacacagtgggtgtctccttaaagtttgtttaaatgaaaacaagcaaaatggtgaaattgatagcattttttccttacattcctgagatggttaattaggttgtttcatttctgttatctcctgagatactctatctatatggacccacgtgtctttgccaattagagaatgacttttaccttgtcctgttttttgctggtggtgctggtgatgttggtgttggtattgttgtttagttttatgtggagatagctaatttggatgcttctctttggtatgtaggcctgagaacacccagggagattatggttgttgccccagggaactatgtcctgtggaaaaatgtattaaacaggtcagggtaggctccattaggtttcatagacaaggtagtcaatgaacttggccttggttttaactggcaggcgatggaagaaaagcatggttagcagggagaagttgcacacagcctgagagctgaaataggaagtgggagttggcccagttttacttattgtactctgaattgggcactgtgttgtaggagtggatgacatattgatgagaaactgggcactactacataaagtttttgagtagagttgctgaatatagaaaattttaggagggcataactttattttttctttttgtatttattgttgtgtgtgtatgtgtgattttaaaaacatcagcctgatggaatgtccagatgtagagggaaaaaaggtagaagaggctgggcgcggtggcttgtgcctgttatcctagcactttgggaggccgaggcgggtggatcacaaggccaggagattgagaccatcctgactaacatggtgaaaccccgtctctactaaaaatacaaaaaattagctgggtgtggttgtgggcgcctgtagtcccagctactcgggaggctgaggcaggggatggcgtgaacgcagaaggcagaggttgcatgcagtgagccgagatcgcgccactgcattccagcctgggcaacagagcgagactccatctcaaaaaaaaaaaaaaaaaagaggtagaagatagccgtagttgtcctcatatgaagtggtgagtagtgaaagactagataagttgtatcaaagtaagagaatttgaagaataaatgtaagagacttggaagattggaaaataaaaaatgacttcctacctggaatattagacaatcagtaataataacagtaatatcttgaatttgttgcccagtcctacatattttagaatatagtatcttagtgaatctcactggtcttactactttttgcctggctttctgttttttgtgactagatatttctcacctattaacataatcactatcggtgtttgttcagtggccattgaacaaaattgatttatgtatctctcctctaacagcgcaaaaacacttgtcaagtgaatgaataaaatttggtgaggtagtctagggcatctgtttcatgagaaagctgagacccagaaggtaagtggcttaccagaatttacccagctagtgagcggcaaaatgcaaggtggaatcacaatccatgtcttttttttcccattattcagtaaaatcatcagctgtaataggaaggtctgaatagcaaagaaatgccaggaaattagagaataaatagagaatgctctccaccgagacggctactattagatgagacagaattcaagaatgattttggccttttagtcttacaagttcagtgtttccagatggttctgtgctgaggagaggagatgcaataataagagtgaccctgataagagtaccctttcctagttccttccactgactcatatcccttgaccaactgcccactctctagctggctgggacaagaggtcccaccagaaatggtgcctctgctcagcgagccaaggccttttcacttgaagttacagaaccctggcttgggttctctttcacaaagccttagtagctgatgactcacgaccttcccagcggcaagttactgagaatgataaaaagcgatcgctataaggctttggagaaagaatgtgggggtggtgtgggggggctgatctttatcctggccaagaatttcatcattaagcagtggcatatgggtccctatttgtaccctattgacaggaaggccatatactgatgattgccatgctaattcagggaatgaaatgacgtaacccccctaatgacattcaatacggagaaagactaaatcgaaattaaattatctgatctcgaccaagtttttaaaagtacagataatgtctgccctttcattcaggactccagaccaatttaaatgactattcatccaggctactagactaccctcacgtattgtaaaatatcttctaatttcagagggagtgtctctttaaagtttggtggcattacttctgtctctcaccttctaggcagccagaaaattagagcatggattctcaacatagacagatctaggtttgtagcctggctctgctgtttataacttgcatgaccttcggttagaaacgtagtctcggcgggtggattacctaaggtcaggagttcaagaccagcctgggcaacacggtgaaaccccatctctatcaaaatacaaaaaattagccgggtgtggaggcgtgtgcctgtaatcccagctactcgggaggctgaggcggagaattgctggaacccgggaggcagaggttgcagtgagccgagatggcgccactgcactccagcctggatgacagagtgagactccttctccaaaaaaaaaagtagtctccttaggcctcattttacttacccataaaatgggcattatatacaataataataaaaacaataatagaaactaccaattatctccctggcagtgtgttaattgctatcataattttatttaaattatacaacctcatgagttaggtagtgttaatacctctatttttagcaatacagaaactgaagctcagagaaattaattaaggtgtctgaagaagcaaatttgcaaattgggaagcagggattcaatccagtcaaaatttttttacgagaattaaatgttaccaaatatgtgaagtgtttaggtagtcctgactatcttatatgctcaataaagttgcatccttttactgtcttagaaggtgaagtgagactcttgcttgggagacacattaattggagaggattaagaggcatattaggagtgtcataagaagacactgaatgacaagtagataccattttccatgcgtgcagattatgtttcttctgtgactccacagccaaatcctttaccatctccatcttctcctgaatagtcctcttagcctttgccttctcagattagacaactggcacagaaacaatcactgcctgccacttccaccacttccccgctcctggtttctcaacaaccctttccatatgactccacatactgcttctgaatttcaaatgtcatgaaattcagagtaataatagtaacagctacacttcagtgagagcttactgtatgccagagactgtgtgccactatttatatgctttaacccactgacgcctcatcacactgggtggggaatgtgctatcattatccccttgcaaagaagaaactgaagctccaagagttgaggaacttgcttgtgtcacacattcagtaactggtagactctagatctcaacttatgtccatgtaatgtcaaagcccaagttcctaaccaaagacagtttctcaatttacaaatggcaaaactttaggcagaaaggtgcagagacattcccagccacacagcaaattagaaaggatgctgctgaaaaatctgacattttatgacatctttcaaagatgctttgttacactctagcctgaataactctcactgggtccattctacatctctggctcagttcatgcttcatttgctctatgttgtctcaatagatgccattattggtgaaatggaggccaatgtcctctaagattacacaatgtcaagtaactcacaaaacttcagtccgcttcatcacaactttctataaatacaaaactttaagcttaagccctttttcaatagacaggaccaaaagagaaaataaacttgccataactcggtgatataacggtattttaaaactctaatctttctgccacttgaaagaggtgtgataaacatcttgattttattcaaaactgtcacagaaagagttttctcttatcagaaggctgcagcttttgaagtgggtggagtactaatggcagagcagcactgagatttgggactgaaggggcaaagtgggctggtacagtggagatgccgtaacaatgaaaagcttcacattcttccaaacaaatacatccaatgaatttatttgataacttcagtgtacaaaaacctgtgttgggcactaagaaaaaaaaatgagcaataagaattggccacagtcctcaaggagctcaaaatctggtaggagagatcaaaaagaacgtaattaatgaaccacactgaaaagcatatcaaaatgtcacaggagaagaacaaataaaatgtttggggattggaataggtcaaaaacctcatgcagtcctggaggctggaaaagacttcaggtaggaggtggtatttgaaatacactatgtaagaggtgccaggggaatcatgcccagtggaaagaacggcaggagtagtagctgaatgtgcaaatccgaagagttgagcatattctggaagaaaaactctaacagtggacttacagaaagtattggtaggctatgaggagtccttgagggattttgattggggaaatggcatgctgaaacttatgttttagagcctaattccccaatccagatgaaagataatgtcagttgtagaaaggatgatgtcagtaaggatagagataaggaaatgcatgagaaagtctactgattacatagccagattgatttccactcatttctgataaaataatttttatcaagaatcactttctggctggccaataattggcttttccttccaattagatgctatttggaactagctaaattgaaatcaatgaagacctactgtataaatgcatctttgtttgcagacagccaaaactccacggagaaacaaaggggcaaaggggaaaagtgcacaagaagagaatccatccatttcaaggattgttcttgctgctaacaagaacgggcctcaggtggatcaagtccccttagatttggtggaacctgggctccatttccagctgcaggtaatttctgcatccttggaaaaattccacattaacttctctgacgtacagcctggttttctgatccctgtgataggaaaatgatacttaccttaacagggttaaatgaggtgtctcatgtaaaatgctttcaccaaggctgacatgtagtaactggtaaatggcaccaaagctactgaattatgatcagcctttacttatttctctgatcccatctcctaccacttttttttcgcattaattaggctgtactggctatgtcaagcacattcctgccctagtgcatttgtatttgcttttcccttcgcctgacttgatattccctcagatcaaatatatgcctgactccttagaatgcttgtcccctgtcacagagctcacctcctccatctaaccttccctaactacttcatctaaaacacccccttgcccatctctattttttattctctttatagcacatatcagtatctaaacttgccttattcatgtacatgtgtctccttgtttattttctagtttctgacaagagagagtagagaccttgtccggtttctttattagtagacttctggcaagagaccctgcctcatagtcggtgttcagaaaatctctttttctctgaatgccatagtgctgttgagagaattaaactatagcaaatagaaatcacctagcgcacagtaagtgctaaatcaatactagtctcttccccttaaatgaatctagagatgctccaacatggaactaggcgatttgtaaagaaatcaagaaagaggacattctcccaagggtaggttagtttggaggtggattctgcaggaggttctggggtctggtagcaggtacttcacagccggtgaaggcttaggtcttcattctaggaaggaagtttcaggagacagtgtgctttctgaatggaggaagagattttctaacggggaggtgtgattctgaggaaatgattgtcacctggaaaaaatagttcatggcagtattatgaacaccgcctcagaaaagctaaggacaggaggtaaacaagcaccagcacagagggtattccctggtccagcgattgggctttaggctcccaagaacattccatccagggcatagattataataaccagagatgggagatccagacctacctattccccgtcctgcttgaatcttttatgtgatggaattccaggtagatttgtgtatgaagaaaggattctgatgtgtaaacctaattcttgtccacccctggcattttatatgtgagaagataggtcccaagaggtaaacaaaagagctaagtctattttactctggacattactctgtctcctgactgctgacagggttcattccattgttccacactcagaagagatgggacctagatttcatcacacataacctgggcctaaaggagatgaactccaggctcttggatggctcgtgacatgccccctccagttttttttttctaaaggcttcagcagggatgcacatgcttaacctcaatccaagacctccagatatacattgtcacactgccttaaatgcctcctcgtggtttgtgctctgagagtagctggacaggatccccatcctctgctcattaggtgaccatgtcatagaggtttgtcttattgctggaggccttgatgaaggtgacagacaggcagacaggtagaatctggtaaaatcacattatctaggggcccggggctactagctttcctttgagaggaacctggtactggagtcagaaaattctctagcttcaaacgacatagctactggagaatgccctgggatcttggaggttaccgagaagctccacaagactgaggcatgggagttgactttggcattttattgcatattcaaaattcagttattagttttcagacgcatttttccttgaatatataatttatataaacatgtacagaatgcactcatataaacatatgtataatttatcaataaatataatttatcaattaaaaaatctatgtaggctccaattttttccataacacatttctgggaactgcatcaaaaagtagatgatcataaagccaaagatgctttccatgtaaacaaagttagaatcaaggattctaggaccttcaaagccttagcttcaaataaatcatagctataactaacaatctcataaaccaaaaacacaaccatcattacaatttgtaatcctttgaaattagagaattaagtttcatgttctatgtggtgggcacacatgtactttatatgttgatcacacaagggatctcagtgcattataaactgtataagtggcccctttgtaattctactttattaaaaatgtaaataaaattaagttgttagctaaaatagcattaaaccacaattaacaatcatatacatagactatcagatcaggaaaattttcaaaagttatcaggttcaatatcttagttgactctttatgtagtattcatgctatctggtcatagtctggtccacgtttgatttttttcataggatttgtatatatataatttatagcatggggatgattttgatggtccaagtattttcttcttcaaatacattttttcatagtgaacaaacatttgaatcttattccatgttactttgaagttatatgagaagttacgctcattattatcaaaattagcctgtagtcccttactttgtgaataaccaaatccttttaaatgagtttctgtgattcataaattcgtgtgttgggcaacctgaaatgaccaaattaggatgggtggatttggaagaattaatatccaaagggtgcttctacaattcctagaattttatttatttgtttatttagtgagatggagtctcactctattgcccaggctgaagtgcagtggtgcaatctcagcttaatgcagcctctgcctcatggatttaagcaattctcctgcctcagtctcccaagtagttgggactacaggcagatgccaccatactcggctaatttttgtagctttagtagagatcaaatttcaccatgttggccaggctcgaactcctgacctcaagtgattctcccacctgggcctcccaaagtgctgggaatacaggaagaattaatacccaaggggtgctcctagaatattatttttttaacaaggctctggtttggcatttaccttcctgcgaactttgccctgggcatttctttctctgtttctttatcaacatagaaacttactctcttaagttggtttacctcccggtaaataaattcatagtcctcgagtgctcaggcacatccacagtaatccaaaacgcccaaagtaatgataaatatgtggaatggcattttatgatttacagaatgttttcacaaaaaaattatcttatatctccacaacaactttgtgaagtaggcaagagagattctctctgaggtctgagacattcaggaattagttcaatttgcttaataagtcagcaatggacccagtgcacgtgctgcctctgtgctgtactcctcccaccaatgtgctcatgcaggcaatgggtgggtgtgtgggcagccacagcagattggttgggtctcatcatcaggtccagagccatggagcccagaagctggctgctcccttcttcatattagaaaagcacctcaaaatggtgcttgcctcctaatggtggttgctgagcctagtgatggcaggggaacaatgacttgaaaaatcaaaggggattggtccagccacagagtcagagtcagggtgtaagttagaatttaaataaactttcttcatatgtgacaagaatggttccctggttcaatctgcttcattgatcagggagaatcccagtctacacaaagagcatttcagcatggagagatatttctcacgaattctgaatagcatttctctttcagaggctattttccttccctaaaacatgactttctccccaacagaattaagtcttcataggacagagaggcttttttttttctttttctttttggcatttggatggtttggtcaatcttctcttccttattccaaagtttcttcctgtcggtttcagttccagaactaaagtaaacaacaatggaaacaataactgacaccttataagcaataagaaaaaaagagaatatgataaataatcctgagatgctattaaaccacagccaagatcaaagtcagaatctcacatggctctgggtttggcatttaccttcccgggacttctgctatggggcattcgcaagagccactgactcagctttgaataaaagacatccagattaatctgaaggacaaagctggaaaggtcaggggtctaaaaggcccaaatgaggagggtcgttcctttgaaacaaagccaaaaggcaggcaggccatggcttctcgaggtagcagacggctatagcagcatactgttgtcttagaaacagaaagaaaacttaaaggtcctctagtccaagcttgagtgcacagatgtggaaagtggggtccagagatgaaagaacactattcaagatctcacagcttgtttgcagcacagccagggcggcaatttgggtcctctggcttcaagtacagcattgcctcggcatccccagtgctgctggatcctgccctcctgcaccttgggggagctgcaggggaaaatgagtttccccagtgtgaacttccaacagttatctcctttggcagcaacaaagccagattgaagggtttcaaaatgatatcacaagttcatgggaaagatcctgaagcctaataaacacctacgatgttgctagccctgcccaaggctttttagaagacgtcccgttctagcccagcaggagagcgagcatctcagggcagacacgccagcggccaggacaccaggaggaagctatctgtcttcagcttccctccagagttgctgtggagaccattttcctctgacagatctctgaccctgtgtcttccatggaaaataaatggagcatgtcctgaagaggaggacagacattggacataaggaagagcaagtggacgtctgggactgacaagggggccaaccaagaggatgcacgtttggacccagacacagggagaaaagtgtgttagcgtctggcacagaacagggcgaagaagaggcaggggatagcttgaacatggctgtgacggacgtgaccaagcaagtaagcaagacaggagcgacgcctctggctaagacaggaacagagagggagtattttgttgatatctggaagcccacacagcaaagaaggcgtatttggagacatcagtgaccgagataggacgcagcaagctatcgtgcttagaacgtgagtgagacagatcagacacagtgagtgacgggaacatgtcagagacaccagagaccacgcggcaaaagcagagaatctgggaagagggagtgttgggaaataaaaagtgaacaaggaggccattatgtcccctgactccctccagcgccacctgctggaatctcagaggaaaagcccagcgagcaccgggttcctgcactggcggacggaaagcctcaggtgaagagaataccgggtgcagtcgcgcacaagcagcagcttaggacctggccctctttcggaggcatggctgtcttctgggtcattgtcccaggggcctaagtgtcactgggctgagcagccaccaaaggagaagttgctggcgggtgacactgactctcccactggccaccacactccactgcatccctagagagaggagaagattacagaacctcagaattggaaaggatgttgcagatcatctcctgaaagagcccacctgcatggcaggaacactctgtgccatgcagatgagtagctatttggcttctacttaggaatttccattgacaggccagtccatattaatttttggcaataataactattagaaatagcccattaatgttcagccaaaatcggtgtccatatggcttctacctgatggacctattacgcctatcaggccccctcaacattgtgccctctaccgattatatcctccaagttttctctactccaagctacacattccgattttctttaatagttcattatatattatagtttccagattattccccataatgggcactgtcctttgaacacctctcttgaattatggtactaggaaagtgcacaaattttcgcagggagcctgacttacatcatgtgcttttcatcatcaattgggtttatttctattaatgtagtcaaattcagttcatttctaaaaatggtaataagttattggcgtatattgagcttgctgccaactttgatcgtttttgatacaacaactgtcaattcctgaggttctttattacattgctgcctagttgattttattatttatttatttatttatttatttatttatttatttatttatttgagccaaaatataaaccatcacattttactcagttaaactttgttatatcggtttggtatcactttagtcagctgagatcattctaaatcatagcaattttaacattcaagatatgattatttagcacccactcaaactagaccttaagttttttgcaagcacataggaagatcaaataatctacaatggtagatatttcagtttagtgtcatctgccttttagtttttcaggcaaggtaaaaaatgttgagcaagataaaacagagaatcatagttaccccaagacaggcttccttgcagtcaaacatctaatgctcaatgtgcctgagaatggacccgctctggcaggctttgtccaataccttgctaaaatgtctctgtcaaacagaaaatctgtcctagcagataaagaaattatttggcatgaattattatacaacagtgaatcttacttacacaagctatgagtctatggtttctggagattagctttagtgtttcttgaaaaattggggcaatatttactatctccaggcttccacctattccccagtcctagaagaagttcattcggacttgttagcaacaagttttttttaagcccctgagatatgacacatcttggctcagagagagttaaatgctttccatcaatcctggacagcaactttctccctaaaatgttctcttctttccagttggaagtctattcttattatagcagaatatgcaagatttcttccctaaataatgaaatctaactatttctgggttagatctgaacatagctctgaacatagcttttgttcatccttgattcatccttggttatatgttccttcctccagattttccacatgccattttaaagtgtaaactctctagataactcaagatgtgccctcaggcctttacatactcccttacatttttatctgtctgattcattgaatatatctatttagagaaaaaacaatgaatgaaaaagaaggaatgaaggttaaaaaggaaggaaggagagaaggaagaaagggaaggaggaaggaaggaagaaggaaaggaaggaaagaaggaagggaaagagggagagagggaagaaagaaaataagaatttctcatctctcattggccaaatcccctttgtatcatatttgttattattgtcattattagcaacgataaaaacaaccacctattagtgcagcactggtgtgccaggcattgggctgaatgcagtatgtgccttaattcatgtattacacccatttaacaggcaaggaaactgagcttcagggagcataagtaatttgcccaagtatacacagttaataaatgacagggtcagaccttacatttaagtcatttttgacaccagcacctgtgctagtaactgttctactgtattgtcattcatcattttgacaactaccactatggatacagtatttaggtctcgctgtctctagcatttctttgtcccactatggcagactcctgggtgaaatgaatatgtagaggggtgcatgttataaatgttccacctgtgagaaacctgcagtgtgatgtggcatttccatttattgcaacacaatatgactgtgacactaacatgagactctttcctgctaactccatctgaccattaaagaagagtcattgccaagtggaaccccatgttttctgtgacgtagaactagggagactaggtgtaaagggggaaaaaatcctgtgaaggtaggaggaaagtccggaagacaaagagaggggccacatgaataaacataataaagaatgaggggtgaggataaaagacaaggcgaaaagatcagagctaaagaaagccatgtggttgggcatgtggaaggctccagagcaattggagagaggaagaggttctttgagaaatgtttccgaagggctacattggctctctctttctctccctctctatctatctttgacattggcaaactcagcttcaatatattggctctcttgtacaattcttttagagatttaaataaagattgaaaatactctagtattgctatttgatgtctaatgccaggttacatcaatatagctctggccatggagaaaggacaatggcccagcatctaactccatgaaggactcacaacgtctctctctcagcaggacgaatgggaatgtgagaataatgacagagtgatcttatggtcagttggctcatagccgcagttctcattgttatatttacataattgttcacagttagcagtttagtgtcatctgccttttaggccttcatgcatgataaaaaaaaatgtggtacattatactgcaccataagagacctccttcctgtgcaataagatcatcctcagtgcacatggctttaacactcaggaagcccctttcactcccagctagaaggtcaccttactaattcagagaagaaagcagcagagtgtagcaaccagaagacagggacctgggttctaatgcctttggagcctccagttgagtgactggatgactttgtccctttcctgtgcctcacttttcccatttgttaaatgaaggggaggataatctgtaagatcatttgcagctctgacattctgattctatgagtagcagggatggtgggtgacagagacaggccttctgattgggcaccagctgtgtgtgggactgttctccaaagctgtgggtaattgcttcaaatctggcttttaatattctattgttagtatctgatactttatattccatgtggagggaagaggtttcgctggaaacacagggagggtaattttggatttgtattaaagaatctgaaagacctcaatttcggaatctgtgaaattacattgcaaagctgttaaacgtatttgggtaggataggatagggtggggctgagatgccacaacttaaaatgcagcgagatcacaactgtctctcctcaaacatatgtttgatcaaaaacattggcagagccactcaaaatccctgatgcaaaacatcatttaaaaagaatctttctccaatattttaacggatgagtttttaaaatgcagtttcttgttgtaatcattttggtaaaatccctgacaatttacaaagcattgtcatatctttttttcacatttaatcttcaatgcaaatctgtaaggcaagaaggtacagagtcttgtttccatgttagaggaagaggaaagtgtaatgtagaggcatggattgatcgatgggtaatggtggatctagtgctataacttgggtattctgccctccaaatcaagaattctgcccatttggaaacatggaaatcatttatgtggtgggaagttttataacaaagttattagcagttaatgaaacagacttacaattacttgttctgtggaagaaagaataggaggaggaagaaggagaagaggaggaagaagaaaaggaggaggaggaggaggaggagaatcacttgctaagtcatctttctcaaaggtccagaggctatgtgcatgagaactatattgggtacttttataaaatacagattcccaggatccataccagacctttgacagcgagggtaggagggcaggagtgagccagagagagcagcaatctgcattttaaaaaactgctctcagctgattcttacgcacacaggtgtatgagatttccctccagccattctattcataccagagagcgagcttagagatagagacagtagagagagcgagcttagagatagagacagtagagagagcgagcttagagatagagacagtagagagagcgagcttagagataggcagtagagagaaatcacaggcaggtcagaggggccagagatagaagtccctgctcccaaagggaaaggaatggaaacaataaaataaaacatacatttcagcaaagtggacaaggaagtatttattggttgtcatcacattgaagataaacagatgagaaaagacttggtgattatgaaaatgagaaagcaaaaaatgtaaagagatgcacagagcaatgtttttttaggtgcttttcatgtgatgagaaatagaattcttgggtattgttagctgataaaaaccgagttgtctataaaccgtgaggcacatagatttgtaataagttatcagcaagtttgcttattaaaagtccatttcttaaattgtctgtagatacactatcaaccagaattctactaaggctagaagatcaagtgtttcccaaacataggatgtgttctgtgagtgacatctcagagaatgggcacagcattaaataatctgaatgacagcaaggggattcaaattattcattcagtcattctgactcagtgtggtcctgctctggtttaacaagtctctaatacctaacaaacacagtgcaggcgtcaggctcaaagcctttggcaaaaaaacaggataaagctaaattttaataactttgttttactttcattgcatttgtattaaaaatcatcttctctatatagttttgcatttaaggtcacaatacagagtttcctttacaaatatgtttatttagatttaaaacgtatttaaagaaaaatagtaaataaataatagcatggcatgggtagagtggtgatatgataaaaaaaaatcatgaaagtagcatgcaagttacaaaagcccctatcagacagatgagaaaactaaattgcagaaagcatagtgtcttggcaaggacataaagcaatgcatctgcagggcatgacatctaggatctttctttctactgtcttttgaagcttgcagaaagctgagctttcatagtttgggatgttaacattgtggcctctggacaaaatgtattcccaagggccctttaatctcatcaccagtctcagatatgtccatgtttcaatacaccaaagtgcgagatcaaatcaggtgtggctgattctaatccctatgtacttctttccctatttcccaatatgtgcatagaactaagaggtcaaatcaatatcctttcatgacttttttccattgtttaccacagttcctaaatggcaaataaaaggattgaaactctgaatctttgggagtcagactatctacctgctttttctatagtattccaatataaaaggacctaaaatatctaggagaaaataccttaaaagtacgttttaaacacagccaatatttactgaatgtttattatgtgtcaactactgtgctaagaaattcatggattatttcatataaacttcacaataatcctatcacatgggttttattatttgcaggctctggctgagtggaatgaatcctagtaactttccccaggtagagtatctagagagtggtggggtcaggatctgaactcagagcctgattgaaacaacatcactaaatttgcaccttcatggaacaggcattctcaacccctaaacagtgctcttgagaagctgcccataggagtgacagtgagtcaggtacataaagaatacttaagatactgagggataagctgagcttcctaaagaagggcaagtgggtggtaagatagcccagagactgaggagaaagtggggcaggaaagtttagagaactcctattggaactgtgcctagaagaatgagtagtcttgtgccaggctggaaagtgagacagcattcaaggcagcagagatgatccagagacaatataattcgctatttgtttgggaaaagctgaccaatcttgtatgtttattgcacgaagagttaggtcaggggagctgggctgcagcggggagagttgagggaaatgagctggaacaccagattggatcaggccaagaagggtttcatatacccttccctctctgcccactgcaagtcctactgtactgctcaaggttatcctattacaacccaatccagctggcatttgcagtttaaaatcccacatgtctgaatggcctttccatcttcctgagtgataaacacgaagcagcttctccctttatggctatattatatacatagtcccaaaagaaaaccagaggcagagaaaataatttataatttgcaactctgtcaaggaaagagcatcctaaaatcaccaaaatgtgtgaatagcctttcagttcaattctagaactcacccttttggaaagtcatgcaaatgtatatatacatatacatgtatatatataatatataatatacatatacatatatatgtatgtgtgtgtgtatatatatacatatatatatgtatatatatcctgatcagtaaatatatccaatattttttccaaatgcaatctcaggcatcaaattagctgtttaccactaagcatctatggagatatttctcctttggaaatgtctacattttctaccaaccccagattgccaaagattcagtaaaggaaagcagaatggccccctaaaattgacagtatcatttctgacatatgtcttctcattagtaatatttccagaaattctccagcttcaaccaaacaaaatgttacactggctgaaatagagtttgctgtcccctacacttaactgcactgtgggacgatgcttatgattttgtaactcacagaatcacaaaaaaaggggctgagaacgtgttattcaatctactcacctcttccccagaaatgttgactaatgaacattcagttcttccagttactgatattcggtcaatcaacacttttaattgactgatggtcatccaattgtctccttcaactttactaggaactccctagtaaggcaatccattccattttgtgctgaaatacatgttcttataacctcaatcctttgtttcttacctctctccctcacattatgcagaagaagtcgaattcctgtttcctctaacagccctttaaatatataaaaacaataattatgacctaaaacctctttgctctaagctcagcatccccagttccttctactgttatttatatgtcataaattctgtagagaaaatcatggcatttaccctcttctgaacatactccggcttgtcaattcccggtataagatgaagcttttatcatttccatggaccaggtacctgcacattgcaccatggactaaacacacatttacatgggaatatggttttccaatgggtatctcagtgtgctttggaggagatttcttcctgaacagctgctctgactaaattggaaggtctgtgtcctcgccaagtacatgctgtaagagaacaagctcctagagcctgcctagtggaaagggcttatctgcaaggttactgccggtactctaaccacagaagttcaggacccttcctcctagaaaccgtatcagtcgccttctacggcgctatatatttttttttttttggtcttgccttaagaatgtatgaggattaaaaggagccaaatggtgcaggggctgaacctcctggtactgttgaaagacctctcctgctgtccttggcagtggcaaggaagttctctgttgtaaagctcagaggactagtttgaagcagggtttcttaacctcggcactatctggaaatctggggccaggaaattctttgctctggggtgttccatgcattgtcggatgattagcagcgtccctggcctccacccactatataccaatagtattcccacgttgtgacaaccaaaaatgccaccagatattgccaaatgttctctggtaaacaagatcattcctgataaagaactactggtttaaacccacacaatctcagtgatctaagacatgcagctagatctaaacttaaagcattatctaattcaacttcctcattttattggtgttgggagaggtaatgacttcctgatgatcactaagggattagaagacaggcctcctgctctttccaggacaccagcggttgttaaccctgctgcgcactcaagctcctaaaataaatggatttctgcttcccaaccagacccaattaaaatggaatctctacaagcagagctcaggctcaggtattgcttaagaggccccaggtggctgtaatgtgcagccagggttgaaggccagggcaccacatcacactgcctctatctttgacctcaaataaaccacgttgggcatttctggagctgagtgttgtttgggggcttgccctgcagggtggcatgcataatccctttttactgcgagcgctgatctctgagggctggtacacagaacctcgacaccctgacagtgggtgcacctacggagcaaaagggggaaaacaaacacacacggaatgtgctcaacttgtttgacatggctagtatattttatgttgggtcaaagaaatgcctacaggtaatttaaaatccagaaggcatattcaaaataacagccccaactgttcagcacagggtatgatgtacccaggaaacaagtcttgtctcatgttgcttaaacaattgtttataaacagtgtgattaatttatttctggcttttcttctagtagaggagccctgcatcccttgtttcaggagaagtgtttagaacatggagatttctattgactcatttcttaagaaattcttatcaggaagctgagaaaataactggagacctggaggaagatgttttaccaagatatgaatgatgctatgcaaatacttatgataacaatgtagcagtttccattgattgagtgctttctgtgtaataggaactggcatatccctgaacggatgttatcaatttaaccttaacaaaagccccatgaaatgggttctaatattatgtccattttacagatgaagaaaaaagcttggagatgtttggtcaaacacttaaggtcatattgacactaaatggtagatctcagacaggactgaaacccaggtgggccagattccagcacctgcagccatggcactgtgctgggtgggatggccctttgattacataccagtggtcgccttccaccaagccagaagctggaacttttcctgaacagtaagtctcaatggaagggataatgtttcagcctcaacacattagcctagaagtgggcatcctggaaagaagcttaggccacccgattaacacatttctgaaaagcaggtacattttgcaaaaagcactaacttttctaatcctgagtatttgatgagaccattggtgttcttttaaagtttttattcttgctattttcctggtgtgatctcaacaagaacagtgttttctgaaagattacttcacgttgtgatggggaccaaggccggctttgtgggtatgtgaccagtgcatatacaggaatccagacctaggtttaatgctctgctgttgccatcttgaaattcttaataactttattcttgaatttgtgaatattagtagaatgtgtatgtatcaaaaagtgaaataaaagcagttgagttagttttctgcactactctggtaaaaacaaaatacttaagtgtgtatgaactacctaccatgatctgtataattttgataattccacatacaagttaaatgctcttttatttacattcgaagttggcattgcacaatgtaaaagtgaatgataaattgattcatgtatcaacgataaatgaatgataaatttattcatgtatcaatgatgaatgataaattggtgctaataattttaaaaatttcttaactaaaacaaaggtaattagcaagtaaaaaaacaccaagacaagttgggagggagtgaatgaaaaaaaaagaaaggctttaaattttaatacctttaagaacactttttcctgccattcgaacaagttgcttgtatttttattttgcatttggccagcaaattatgtagtctgccctggtaggggttaatggagacaaaggaaggtcatcctcattcatctttgatttacccagattaagtctgttttggctcaaaacaatgaggtaaacgttgaatacaattgtaacctctaaagttcaaggtaaaggccataagatggcttttaaatgtcaaacaactttccgacattagcagaaacctctgaggatccaaagtaagtcaactctaaatcatttcctcatccatgggtaaaaatcttccaattcacagtgtgaaaacctttatttaaaaggggaattctgatgtgctgaagtcaaaatttaacaagtggtttcactgtgaacaaacaactgtttcagctgtggaattaatacatattttttaaagtggtggaagcttattctggcatgcacagtccagatgaacagtgaagtataagaacatgtgtttatttaacaaatatattaattgagcaatttctgcaccatggggaaattttagggaataaaattgacatggtacctgccctcatagactggcagtctggctggacagacagataataaacaagttaacaacaacaaaaaatatatggtaagttatcatagttgttatttataaaggaaataacaaggggctgtaacccggattattttttcttctgctgtgttttgcctctcactcattctctttgcctcttactcattttcactttttttctatgtttacattttctccgctattgatttcatatagaaatctgaatacactaatgtcgtacatggaaatgttaaagatttgtatagcacatccaatagaattggttgattagtttttgagcgttgctgataacaagagttagtgagtctgagagaaagttgtattgcctccttccagagagaaggcacatatagctctggagatgcttggtcaaacaaactttttacaatcatgagaattttctacatttatatctaagccaagagccactcaccacatgtggctaatgaacacttggaatataactagtgtgattaaaaaactgagtttttagttgtgtttcattttggttaaattaaaatttaaatagtcatgtgtggctagtggttaccctattggacaacacagatctagagatctcaagtcaatggacagcctgtttatcacagggattaacagtggatgatggaggatgatagccaagaaccaagttagataggcaataagttctttggaaagtgcttgcaaaagttctcagacttctcaggaattgggtaagtgtcctaggtttgagtaagatctgaacctggaaactggggaagaatctaagcctggtgagagagcagggaaacccatctccaaagctaaagtttgcatacaatctctgctgtgttgcctaatttataaatagtctgttcttaaaattatcactctcatgtggacagagctttgcagttagcaaagcaaattcacatcaattattttgttattttgacaatgaaggagtgaaataggaggatggggattatctaccaaagaagtcaaaactggaatctttagcagattttgtacagggaaattctctgctctaaggttacagtcagcaccgctagtcccttttctgccctcagttatctgaactaataatcatggagacagttaaacagaagagagggtaagccagtagactagagacagagcattttttcatcctcttgtcaagtcctacaatgttccaggcactttactaggctctgaggatacaacaggctgcaagactggcaaggtccttggtatttgtccaatggacaaagaaccccattagcaagtccccaaagaacctcaaatcaaattaatatgacttgttcctaccacctgccaccttgttgtggtcacaagactatgtagtcataccatgtcttccaagtggggagagaggcttaaagcatgactgaactgaagcaggcttccaaaaggaattttctgataattatattttaccagttaagttagataaagttattatcttttaagagattctggcctgggtgcggtggctcaagcctgtaatcccagcaccttgggaggctgaggcgggtgaatcacgaggtcaggagttcgagaccaggctggccaacatggggaaaccctgtctctattaaaaatacaaaaaattagccgggtttggtggctggcgcctgtaaccagctacttgggaggctgaggcaagggaatcgcttgaactcaggaggcggaggttgcagtaagccgaaatcgcgccactgcactccagcctgggtgacagtgtgagactccgcctcaaaaaaaattttataagaacctaataattctaatatgtgtcataacttgaagccctgaatcacaatcaatgctagcacaccttggacaattctgatccacaaaagtctaggaccatggctctaaaccgttaatatgcataacagtcatgttagtaaaaatgtcatttacaagccctgcactgattcaatgagtgggacccaggaatctgtgtttttactaagctgccagatgattctaatgtgagtgatctgcagatcatgctttgatggaaaaacgatcaagaaaaataaaaataaaagttgcaaataagggaatatatttgcactccccaaatttccaacaataatatatacacagagagcgctaaaagaaattgggatatttattaagaaaaacaaaagcctcagaaagaacctatggccaaatatgcctaaagtgctgtcctaacgtaaaagatgtaacctgtttttctctttctcaaggcagaacgagggttagtgagtagaagccacagggatggaaacgtcaactcaatatcaggaaaacctttcaagctctagagctgcccaaactttgagcagactgctcagatgggaagcttctctcattgcaggagttcaagcagagatgggatgcccatcaccagtgatgacaaggaaactgttgatttgttagcaattccctcagctcctgataaaccttgtgtacacctgcagtgatgttcaccgtactgtaatatcttgctagtgtatcccttgcttcagtggttcatgtttatatctgctgcatgctgccttctgcattaaatgctcaatacatagttcccgtgaatcaaacttcagaacctaataaattgagttccagaatctgcaaacctggagttctgatgggcttcctataacctcaaaaggaaaatctgggttttacagccacctcttctactatccacaatgaacctttagcaatttatctgctcttcttcagtaaagttttaaagtttccttcaataaaggtcttatacttttcaaaaaaaaccattttttttaaggaactttagttattgcttctgtggatggtgttttatttttatttttatttttattttgagacagggtctggctctgtcacccaagctggagtggagtgcagtggcacagtagtatttttcttaattcacatactaattggttttttctcatgtgtaggaaagtcactgaggattgagtgttatctcatatcgtccatccttatgaaatatcttattacttttcacagtttacagtggattttcctggaagatgattataatagatcatacagatggttaataaataatggaagctttgctctctttttccagtttttttatatttcttctttctgttctttggattttgtatgtacaatgttgaccacaagagatgataagacatcattgtcttattcctcactttagtgggaatgcagctaatgttttatcattaggttatttcttttcttctctgccactatgtgcactatgggtttcctagagtgggaaaagtgatttctataaaaccaagacagatattggtgggtggggaaaacacagctgcagaacaagattaaggatgagacaaggacaaagaggctggctccaaattcactgagaatctgagtttgcacatttgatgaacctcttagaattccacacactggcattatgcctctttctaatacatgcatgcagacaaattaaaattgccctcaaaatatttatatgaaaataattcatgtttagaagctatatttagaagactatgtaacctatatgtctagacaaatggtgtcatcattcaaccaaatgctgtcttcacttctattttgatcacgggttgcatatttccaaagacacttcttgtccaacagaaaatagtcaaacacaattgcagacatctctgctactgtgtacactagttagtacaattttagcaatcaaaaccctctaagaatgtctttcaaaagcatattttatttcattggctacccatttgcttatttaataataaaatttcatgtaagtaaaagggccataaggataggaccaagcttgggagacctatgattctaaaccattgaggccaggcttggctgtttctaattcaacttggaaaagtaaaattccattttgtcaaaaagactttaaaggaaggaggccccacaatatcagagtgttgtcatgaactgggtcttctcaatgtgaatcttgtagactaagttctctataccttttaggatctcagggaagatttaacaaacaaaacctaattttcaattttgagtattttaatccttcataaatctgaagagaatcaggaacacctttcatcagcaaaaatgatcaatcaattgatcatctactgttatacagatactatgttagagactatacagttcctagagaagaggaagccatagtttctcccctcaaggaatacttgatataacaggaattaaataaggaattgtatactctaaagcagtatgaatgtcatgagaaatagtgctgtaaacaggccactgctatccagcagaaatagagaacaaatgcccaagttgaagaaatgtgaaaaaggtatgttctgaaaaccataggaagaagagtttgatcccaatcctgagatgaacttcttttaaattgattctttgtttgaataatcaacgggtacccaaagatagaagtcaacaggtggttaataagaataggtccatctgatctaaacttacttcctttaaaaaaaatgagtatgaaaatgccttcatttgaagaaggaatgttttccatggtttgtaggcaaactagagaaatatgaacaaaatggtagagttgatagattaaaaaatgactcatcaactttatccaaaaagtcaaggtgatcatggaaagttgtaatcttaactctgactctaagtggctggacaaggctgagttttgaagtcagaaacagttgggtctgaattccagctttgttgtttactacttgtgtgactttgggcatgttacttaccctaacactcaattttctcatctttaaaatgacaatgatcataataccttacttctttgagttataaaaattagatgcaaatgatggacttagggctctcaaatatagtaacaaacattcttttctggaataatgttaggtttcataatcataatcattattattaataaaatggaaggaggtctctagtgacctgtccagtactttttaaatgtttgccttgggtgaggaaaatgaaggtatgcctataaaattgtaaattttatacatgcagctagaaatttatcttacatttttatgatttatattttgcccccatggttgaattttacagttatttttatttagctccatctcttcaataccagctgattggtttctttttaaatccttaagcctgccctctaatatgttagttctccctcagagccacagaaaaagtgtcttgatttagtaacatgatacaagattattccatttatggagatagggatgactcagaaaacttgtggttggagggtgagatagtttggatgttcatccccttcaaatcccatgttgaagtgtaatctccagagttggaggttgggcctagtgtgaggtgtctgggttatgggggtggaggccacatgaatggcttggtgccctccttgcagtaacaagcgaattgtcactctactagttattgtgagatctggttgttaaaaagagtctagcatctccctcctctctttctctctcttgctccccttcttgccttgagacatgtatgaaccccccttcatcttctgccatgagtaaaagcttcctgaggcctcaccagaagctgagccaatgctgatgccatgctcgtacagcctgtagagccattagacaaataaacctcttttccttgtaaattacccagcctcaagtattcatttatagcaacacaaaatgggccaatacagggggtaagtgtatagagctaagaattctgttttggttgcatcacatttcatttaagatttccaagagacacctatatggggttgtcaaggaagcaaattggatcttctctctggatctcagaggagtgttatgccctggagatattgatcaaagagtgaggtgacagcatgaagactgtatttaaagttatagatggtgaatgtataaagtaagagcatagtctgagaagagtatcaagagccaagtcctgaagaactccaacagtttgaggccagagagaggggaagagcctctaaaagagactgggaaaaagttgctggtgagttagcaagaaaaccaggaaagtatggtgttaaggaaaattaaggtaggaagtattttaagaaggaagctaggccaactctaagaggtcaagtaaggataccttttcaaaatttgaaacttctgtaagtcaaaagttaaccaaagttaaaaagcaagcaggagatggggaggtgtatttgccaattctatgacaccagatgaatatacagaatataacaaagaacacccagaaattaataagaaaaatacaacaaagttgtcacaaaaagggccaaacacataaagatgcactttatataagaataaatataaatagtatataactaatttaaaagaggttcaatctgacaaaccgctaagtaatgcaaattaaatgatacagcaattacttttacactaacctaatattttttaattaagaaaatatgaaagattgataatattcaatgttggtgaggagaactcacactcacagatgagaatgcaaattgttacagtgtgttaggatgccaatattatagtaaacataaacattttaaatgagcatacctgtcaatacagcaatttcatttttggtagctatctgaaagaaatactagcacatgcaccaagaaatgtgttcaagggcattacaaacagtacagtttgcaatgacaaataattggaaatacttacatgcccactaacagcaaataattaaataaattttaatatgtatttttagtacagaagattatggaacagctgaaacaagtgagttagagctatattttccccagtgaaaagatcttcaaaatgtattgttaaaggataaaaaaacaagatgtagaaaagtacatataaaatgatcccatttacatagagtgagaaaaagttatatttctatggtttttatgaatgtctgtaaatacattgaaatgatcagcagactaatgttaactattgcctctgggaacaggggtaggattagcaggataaaagctgatactgattttcattgttttggttttatatttcttcaattcatctgaatttgctaatgatctacttgtgggatttttaagaaaaatgcaaaaattgtcttagttgtgttaagttaaaacaattgatcagaagaattaattttagaatttgttaattcatcaagagtttaagttcctattacatatcagacaatatgtagagtatttggtatacggcagtgaataaaataggcagaattcctgtcctttgtaagatttaacctctagcagatgcaggtttcaactattctgtataggctacccttactcttataagattctccactcccacagtaaaacatcacagaccaacttcctgcacttttcatgaactcatgaagaaacttatggaagactgtaatcccagcactttgggaggctgaggtgggtggatcacagggtcaggagatcgagaccatcctggctaacatggtgaaaccctgtctctactaaaaatacaaaaaaattagccaggcatggtggcaggtgcctgtagtcccagctactggggaggatgaggaaagagaatggcgtgaacctgggaggcagagcttgcagtgagcccagatcacaccattgcactccagcctgggcgacagagcgaaactctgtctcaaaaagaaaaaaaaaaaaaagactgaacaaaaagcagcagaaaactctgcagacttaaatgtccctgtctgacaactttgaagagagtagtggttctcctagcacagagtttgagatctgagaatggacagactgcctcctcaagtgggtccctgacccccaagtagcctaactgggaggcacctccaagtgggggcagactgatacctcacacagccagttacctctcagagatgaagcttccagaggaacgatcaggcagcaacatttgctgttcagcaatactcgctattctgcagcctctgctgctgatacccaggctaacaggttctggagtgttaactccagcaaactccaacagaccagcatctgaaggtcctgactgttagaaggaaaactgaaaaacagaaaggacatccacaccaaaaccccatctgtacgtcactatgatcaaagacaaaggtagataaaaccacaaagatggggaaaaaacagagcagaaaagccgaaagttctaaaaatcagagcacctctccccctacaaaggagtgcagctcctcaccagaaatggaacaaaactggatggagaatgactttgacaagttgagagaaggcctcagatgatcaaacttctctgagctaaaggagaagtttaaacccatcgcaaagaagctaaaaaccttgcagaaagattagaccaatggctaactagaataaccagtgtggagtagtccttaaatgacctaatggagctgaaaaccaaggcacgagaactacgtgacaaatgcacaagcctcagtagccgattcgatcaactggaagaaagggtatcagtgattgaagatcaaatgaatgaaatgaagtgagaagagaagtttagagacaaagagtaaaaacaaacaaacaaagcctccaaggaatatgggactatgggaaaagaccaaatctacgtctgattggtgtacctgaaagtgacggggagaatggaaccaagttggaaaacactctgcaggatattatccaggagaacttccccaacctagcaaggcaggccaacatttgaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaagggaagcccatcagactaacaatggatctctccgcagaaactctacaagccagaagagggtgggggccaatattcaacattcttagagaaaagaattttcaacccagaatttcatatccagccaaactaagcttcataagtgaaggagaaataaaatactttacagacaagcaaatgctgagagattttgtcaccaccaggccagccctaaaagagctccttaaggaagcactaaacatggaaaggaacaatcagtaccagccactgcaaaaacatgccaaattgtaaagactatcaaggctaggaagaaactgcatcaactaacgagcaaaataaccagctaacatcataatgacaggatcaaattcacacataacaatattaaccttaaatgtaaatcggctaaatgcgccaattaaaagacacagactggcaaattggataaagagtcaagacccatcagtgtgcggtgttcaggagacccatctcacatgcagagacacacataggctcaaaataaagggatggaggaagatctaccaagcaactggaaaacaaaaaaaaggcagggcttgcaatcctagtctctgataaaacaaactttaaaccaacaaagatcaaaagagacaaagaaggccattaaataatggtaaagggatcaattcaacaaggagagctaactatcctaaatagatatgcacccaatacaggcggacccagattcaaaaagcaagtccttagagacctacaaagagacttagattcccacacaataataatgggagactttaacaccccactgtcaacattagacagatcaatgagacagaaagttaacaaggatatccaagaattaaactcagctctgcatcaagcagacctaatagacgtctacagaactctccaccccaaatcaacagaatatacattcgtctcagcaccacatcacacttattccaaaattgtccacatagttggaagtaaaacactcttcagcaaacgtaaaagaaagaaattataacaaactgtctctcagaccacagtgcaatcaaactagaactcaggattaagaaacccactcaaaactgctcaactgcatggaaacagaacaacctgctcctgaatgactactgggtacataacgaaatgaaggcagaaataaagatattctttgaaaccagtgagaacaaagacatgacataccagaatctctgggacacatttaaagcagtgtgtagagggaaatttatagcactaaatgcccacaagagaaagcaggaaagatctaaaattgacaccctaacatcacaattaaaagaactagagcagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgattaaggggatatcactaccgatcccacagaaatacaaactaccatcagagaatactataaacacctctacgcaaataaactagaaaacctacaagaaatggataaattcctggacacatacaccctcccaagactaaaccaggaagaagttgaatccctggatagaccaataacaggttctgaaattgaggcagtaattaatagcctaccaaccaaaaaaatccaggatcagatggattcacagtcgaattctaccagaggtacaaggaggagctggtaccattccaatatccctgatgaacactgatgcaaaaatcctcaataaaatactggcaaaccaaatccagcagcacatcaaaaagcttatccaccataatcaagtgggcttcatccctgggatgcaaggctggttcaacatatgcaaatcaataaacgtaatccagcatataaacagaaccaaagacaaaaaccacatgattatctcaatagatgcagaaaaggcctttgacaaaattcaacagcccttcatggtaaaaactctcaataagttaggtattgatgggacatatatcaaaataataagagctatttatgacaaacccacagccaatatcacactgaatgggcaaaaactggaagcattccctttgaaaactggcacaagacaggaatgccctctctcaccactcctattcaacatagtgttggaagttctggccagggcaatcaggcaggagaaagaaataaagggtattcaattaggaaaagaggaagtcaaattgtccctgtttgcagatgacatgactgtatatttagaaaaccccatcgtctcagcccaaaatctccttaagctgataggcaacttcagcaaagtctcaggatacaaaatcaatgtgcaaaaatcacaagcattcttatacaccaataacagacaaacagagggccaaatcatgagtgaactcccaatcacaattgcttcaaagagaataaaatacctaggaatccaactcacaagggatgtgaaggacctcttcaaggagaactacaaaccactgctcaacgaaataaaagaggacacaaacaaatggaaggacattccatgctcatggataggaagaatcaatatcgcgaaaatggccatactgcccaaggtaatttataaattcaatgccatccccatcaagctaccaatgactttctccagagaattggaaaaaactactttaaaattcatatggaaccaaaaaagagcccgcattgccaagtcaaccctaagccaaaagaacaaagctggaggcatcatgctacctgacttcaaactatactacaaggctacagtcagcaaaacagcatggtactgggactaaaacagagatatagactaatggaatacaacagagccctcagaaataataccacacatctacaaccatctgatctttgacaaacctgacaaaaacaagaaatgcggaaaggattccctatataataaatggtgctgggaaaactggctagccataggtagaaagctgaaactggatccctttcttacaccttataaaaaattaattcaagatggattaaagacttaaatgtcagacctaaaaccataaaaaccctagaagaaaacctgggcaataccattcgggacataggaatgggcaaggactacatgtctaaaacaccaaaaacaacggcaacagaagctaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaactcaaacaaatttacaagaaaaaaacaaacaaccccatcaacaagtgggtgaaggatatgaacagacacttctcaaaagaagacatttatgcagcaaacaggcacatgaaaaaatgctcatcatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagacagtgtggcgattcctcaaggatctagaactagaaataccatttgacccagccatcctgttactgggtatatacccaaaggactataaatcatgctgctataaagacacatgcacacgtatgtttattgcggcactattcacaatagcaaacacttggaaccaacccaaatgtccatcaatgatagacaggattaagaaaatgtggcacatatgcaccatggaatactatgcagccataaaaaaggatgagttcacgtcctttgtagggacatggatgaagctggaaaccatcattctcagcaaactatcgcaaggagaaaaaaccaaacgccgcatattctctctcataggtgggaattgaacaataagaacatttggacacaggaaggggaacatcacactctggggcctgtcgtggggtggggggaggggggagggataacattaggagatatacctaatgtaaatgacgagttaatgggtgcagcacaccaacatggcacatgtatacatatgtaagaaacctgcacgttgtggacatgtaccctagaacttaaagtataataaaaaaataaataaaataaaatggtaattgtactcataccatataagtttcttcaaaaaaaaaaaagaaatttatggaagaaaatatggagtgtacatccatatgccatctctaaattgtctctttgctttacaatgatcctgcagattaccagacgcagcaggattttaacaatacatcttatttagtaaaataggctttcttgggctgccctggaaactcccaaactctctatgaaaaaaaccatcaactgctaaacaactgacttagcaaatgtattaccagagcatacgctgtttgtaagttgtcaacagcctgtacttaggcaactgctagattaaatagctaaaaactatttggcacccacacagaagttcttgtacacacactttatggttgaattctttctatgacactcctgaaggcataataattaagagagaatgtcggtttctaggagtatcctttggggtctttccaccagctgaaaccacaacaccatgctaggctttagctacaaatctgcctacacttgtagcaaaaaatggaattcatgctctgagcagcctctgaggcacaggatttatattttatagcaattcttatttttcttttcttcttttcttacacatgcaaatgaaaatatcccccaattttcagccgccagaacagctgaatactaatcatcatcagaaaaattaaatgcttgtttcaaagaaggaactactccttagaaattcctgcgcatctcagggcaaagaaaaaaatgtcactggcaatcctgttttgctacaggatgaatgtatttatcacacatagctttgcatagctgagaacaattctagcccagggtgaccagaaaagtctcagggtttggaaagaggtaccataactagacactgaacatttaactccaaagtcacttccacctccatccacttatgtgaccttggggaaaaaaaatcgctggacctgtcggtattctcttatatttcatttccttccttgtactgttctatctgcctgaaatggcttccctgccttctcctccatgtctcaaattcttaggaaatactgttctgtgttctgtaaagccttccctgagcttcttaagccaaatcagcttcctttcctttctaccccaattctagattgcccatacatccattatatcacatggtattactgttgtatatttattatggtatttattttagtttatcatgttatttatggccatattaggttctcaggcactacgttattactattggtcctaatattaaataaaacttctagtaccattgtgagtgcttactgtatgtcatgccctatatgaatatattatctctactcatcagaaaacacacatgagatgagaattaacattctcatctgttttaaaggtgaggaaagtaaaaccaagagagagtatgcagatggctagtaggagcaccgagaatcaagacaaaacctattttactttaaaatccatgcttttaaccactactctaaagtaacacctttaaataataatagataacatttactaaatacttgttaagtgtcaggctctgtaccgtgcactccacatatactagctaatttgattctcataaaaactctgtgatgtagatatagtgattattatcttaagtttttaaaaaatgaaattgaggttaataatgtttaaacgacctgcccaaggtcacagaactatggggacttgattagaattcaagtcaatctccctccagagcctgagttcttaaccattgctgtattccatgaccagatagtagaatcttttataatctttgcaaactctatgcaggtttcagggataacccctttggaaacagaaaactggagcattaccccttctgagtaatacaaatcaaccaaatcaatgaactcccttagtatactcaccttagtacatgtgtggatccattaatggttgtggttgaacaagggacagtctggcccagaatggaaggtcttcggtagcgctcatcatcacagcagaggatgatgaggaaggcacgtctaaaagacttattcaagaaggcgtagagaaaagggttcaacccggaattgatatagccgagccagaggaaagcagtccacacctgcccagggacagtgtagtctatgaaaggatccacaatattggtgacaaagaatggtgcccagcagaggcagaagcaacccatgatgatgcacagggtcttggctgctttggtctctgtcctcatgcgatgagtgctatgctggtctgccgactgaggcctgctctcggaggaggctcctgcccgttgtaacatctggatctgatgggcatgctccttagctgtgacatagatgcggtaataggccagcaccatgaggagaaatgggatgtagaaggccaccacagagcaggtgatggcgtagggcttgttgaccatgaagacacagtacgtagagttagagttctggttgaacttcctcttttctatctgagagttggagggagagaggaaatgaggaaaggaggtaaaaaggaaagaaaaagtgaaaaagaagtgggaaaaatggggaagagtgtgagaaaagaaaaagggaaaaggaagaaagtggaggattggaagataaaaagaaggggaagagaacaaggaaagaaaatgggagaataaaagagtaaaggggaaaggaaagaaaagaaagtttatcagcaaagctttggttttcttataagcctacaatacaaagaaccttgatgacagaaaaggaacatgatcatatcccagggcccagagaacttatctgtacaagaggaactgaaggctccaggacagaagagaaataaaatagagacagaatcatttattacatttacccaaccagaagtgaaattctgcctctgttctcccttccctgtctgcttgcacataacagatcagtctcttaacagaatgtctgcagatcagtaacattagagtcacctgcagtacatattataagtgcagattcctgcccactccctgctgccacccctccactctcatccctgaaagatctactaattctaaatctctgggcaatgaagctcagatatatgcattttaagcaagttttttccaataactctaaagctcattaatatttgagaaccattgctctatactgtgctaaacttagctctttgggggatgccatggggcacttttctagagtcatttctctacgtattgagttccctgatgaaggtttgtctcatttagataacacagagtaacacagagtaacagcctgtgttatagtgtaacagcttgtgttttagtgtaacagccaagaggggccttagggcttgggggaaagaaagggtagatattttaatggaagaaaagaatataaagattgggtagggcaaggtcatgagggactttggaacccaaccagagttagaacctagacaacactcaatgcttcaacttactctcctcccagtctctcctgaacccactccatttaggtgttcaccctaatcactccattgaaaatgctctggtcaaggctatcaatgacctctgtgttgccattcctccttttaaatgagccatctacacctttgacatagctgaaccttccatccttcttcttttttcgaatattttattgaaccaaaatacgtataaagtacataaagtgtatatacagatgaatcaattattacatagtaaatatgcctgtgtaattattattcaaatcaaactatagaatattatcaacaacccagcagcctcccaaatgccttctcctagtcattaatatgcccaaacatagccactcatctacatcatcataatgtaattttatttgttttccaactaagtatcaatataataataaaacacacaatctgtatcttctttaatattgtatcactcacattattgcatgtacaggcagtttattctttttcattgtagtataatattgcattataggaataaactacaatattacatattccaatattgacagacatttgagtcatttttgggtttgtgctattttgcataaaactgttatgaatattcttgtggaagtttgtgtgtgtgtgtgtgtgtgtgtgtgtgtgtgtgtgtgtattttcatctctcttaggtatatacccaggactgaaattgctgtatcatagcttgggtatatacagccaaacagttcccaaagggactgtatcaatttatatttccaccacgagagcaggagagttccagttactccacatgctcgccaacatttggaatttattgtcagtatgtagtggtatctcattgtggatttgttgatgatgttggtaaagtttatttgattacataagtaaaatactccatgtgtttttgactctttccattggtttagattaggatttgtcttatgttttgttactgaaaagtgtcctgggcatccatatccacataattatagtacattgacatcactccttttggaaagcatgtgagactgagtttctgcatctgtttcctgattagcactctggttccttcaatgggacgagagcattgccttcagaatggtaaaatattgcctagatcttgtcagtcccaattcttgcagctgtatcttcagtttcaatctgagtaagtcacctcaaactctcagtgtgccctggtttctgcatctttgttccctgtttactatgtcctggctatttcattgtaattttgaattaaatccaataaacttgaatcaaatctaagtttattacaacccttcagtttcttattgcagttttactgtgcatctcctgagaactaataatgttaatcactgttttgccctttcgatatcctgtcttttgaattgattattcaggtattttcccattttaaaaattaagttgtaactctctttcttattgatttttaatataatagttcttttatattctagatgtcttttgtcagatttatgtgttgcacatatatcactctgtggcatggcttttcactctagtatcttgtgatagaaagaagctctgaaagaacctatacttttggttagtacttgtatcttgtttatgaaatctttgtttactcctaagtataaagatactggccgggcgcggtgacttacatctgtaatcccagcaccttgtgaggccgaggtaggcaaatcacttgaggccaggagtttaagaccagcctggccaacacggcaaaacactgtctctataaaaaaatacaaaaattagccaggcgtggtggcaggcacctgaattctagctcctagggtggctgaggcactagaatcgcttgaacccgggaggcagaggttgcagtgagctaagatcacgccactgcactccagcctgggtgacagagtgagactcagtctcaaagatattgtcaagagatgtaaagacattcttttacatgatcagttagcatatctttattgtgttaatttttatgtcttttttttttacagggtcatgctctgtcacccaggctggagtgcagttgtgctcactacaacctctgactcccaggctctagcaattctcccacctcagcctccctagtagctgggactacaggtgtgagccaccacccctagttaatttttaaatattttttgtaaagacagggtttcattgtgtggctcagactggtctcaaactctaggctcaagctatcagcccatctcagcttcccaaagtgctgggattacaggcctgagccactgtgcctgaccagtttttacatttaatgcttctacccaccagaaattagtttttctgtatggtatgatgtacaagatatggatattgaattgacccctgcagcatgtattgaaaggattatcttttcctagttgcactgcagtgtaaacttggtcataaatcaggggactgtatatgcatatggctccacgtttggatttcctatttgttctcttgagttgtctctctctgcatgtactgctttaacttctataacttcatacatcttagacatctagttataaaagtctttgaattgtggtttcttttcttgaagactcttggataatgttttatctcagtatttccatataaaatttaaattaatatctcaatttctataaaaatcttctaggattttgattggaatgagagtaaaatgattaagggaaactgacatctttacaatgttaagtctttgaattaattaacatggtaattccttccctttgtctttttaagtatatttcaataatactttttaattttataattttctttgtgtcttgcacatcttttgttagatttgtttctaagtattttatgcttttactctgttgtaaatggtaccatgttaaaatcctgattcctaattgttgctaatatgtagaacttggtgaggatttttattgtaagctggctatgtattcagcaactttgctaagttagatatcaactaaaattcatctttacattcttttgaattttctccaggaaatactcatatgatctgcaaataatggcagttacatttttttctctttccaatcctaatatcactttctcttgctttattgagcttgatagggcctcccatctaattttgaataaaaatgagagtagttgacaccttgtttcactcccagttttaggggatgagccttcaataatttactaagtatgatatttgctataaattgtatgtcaatgccctctacttggttaaggaaactacattctattcttggtttgatgagatttttaaaaaatcgtgaatgggtattgaattttgtcaaagcatttttggcagtaacaaaatgaacatgtgggttttctcccctttttttattgatgcaatgaattacattgattgcattacaattcctggaatgtcttatttgtactggaccctgtgacacactagtatttttcttaaggattgaaggacatttccaccaactataaacactgcctgctgacaggtcttagtcatcaaccttctctagaaatagctcttgactgaagagaactgcttaacccaatgtcacttacccttcttgggatcaatctgcatccagtgtgaatatacacatgcatgaagatatgaagaatagacacctatatgatatactcacaaacatgctattttattcctgtacatattcagtatcttgttttatagactattataaggttatcatgtatcatcctcttgaattgatatttttatcattatgaaatatttctacctcaagaaatattattttccttaaattttattctatcactaataatagtagagtaacaccaactttccttgacttatcacttgcatagtgtatgtatttctatttttttattttcaatttttctgccactttatatttaatggtcctctcttacaagcagcatatatttgtattttgttttgatgcagtctgacaactttgtcttttagcatctattctttaaataatttaatatttactaaaattgcaaattgatttacatttgtctataatcttactgttatctattaatcttttctgtttcttggttccttgtttccatatttattgcttattttcagaataatacctgtttgtattaacacattacctctctccctattagcttattggatatatattcttttattatctttattttaggggctacaactcattacagtctttttcatacatttgccatttccttggcaatgcaaagatcccaaacagcccatgccccacgcctgccttttatgctattgttttcatgcattttaatcctacatatatttgaaaacccacaagacattaatattattgttattttaatagtcaacgttctcttacactatccacatatttatcatttccagtgctctgcactctgtcctgcattatggtgtttcaatctgggattattttctttttgactgaaaaattcccataaaagtcacaatacaaaaacctgatgtggaaaaattcccttcgtttttgtttgcctgaaaacgtcttaatatcatcttaatgtttaaagcatattttcattgggtatagaattctaagttgtagattttcaacatgtcattccattgtcttctcacttctttcattttattgcatggtcagctgtaagtcttattttccctgttaagtttaatttgtcatttttctctaattacttttgagatttatcaacttgtctttgattttcagcaattttttaaatgaattttctagatatagttttcttctttatttaacctgctggggttttgtagagtttcttgaatctctgactgatggcttttatctttttggaaaattcttaggcactatttctacaaatattacatctgccccattctctctctctgaattcaaatagaatactgattacatggatgttagaacttttttgtattatatatatatgtaacatatatatatatacacatatacatatatgtatggacacacacacatatattctgatatgatacatatatatacatatatatcagaatggtctgtaataaaattttatccatttatctctatgtgcttcaatcaatattttattacaaggttatggtataacatcctcttgaattgatattgttatcattatgaaaaaatgatattacctaaattccagtttactacaggtgttctcagatatgtcaaatctactattaaatttatcattatacttatttatttcagtgtatttattagttgcagtatttccattcaattcccccctctttttttttttttttttttttttttgagactaggtcttgctgtgtcacccaggctggagtgcaatggcacaatctcggctcactgcaacctccacctcatgggttcaagcgattcttctgcctcggtctcctgagtagctgggattaaaggcacattccaccatgcctggctaatttttgtattattagtagagatggggttttaccatattggccaggctggtcttgaactcctgacctcatgatctgcccgccttggcctcccaaagtgctgggattacaggcgtgagccaccgcacctggccaaaaattccctttttttttttgtagatgctccttatctaattactccattatctagattgcctatgagactgtttctcttgtctttctgtgttcatggtttttggccatttagtcttgcttcctacagggtctggtgacttaattaaaggacacacattgtgtataaaaaagtacagttgctctggatggtagtagcctattccagaaataatttaattttcttctggcaagcagatagaatatgaaaagaacacctcaatcatgtttaggttatgtttaatgcattactttcaatggcaaaaaccacaattacttttacacagaccttatatgactcagtaaaggccccaaaggaaatagtagaggtcttctttttctttttgagagtgtagctactaagtcttatttgtcttggttactttccaatctttcaaagaatattttacttaatcttcatattttgtatttaattcagtatgttttatttagctttgatagtcatgcttatgacagttcccgccttatctagaacccaattctctctccttccttataatatgttttaaggcatatttgcttccaagacaattttctctttctttgttttcttcctcactggctgttccttccaactgtcctttactgcccttcgttccttagacctcttctattctgtatctacctgcattcctcaggtgatttcatctagtcatatggatttaaatggcatctaatctttgagaatggtccacttttttttttctttctgatcgggacctcctaggaactgcagaatttgatatcaagctccttactggacatctccaattgcatatctaataggtatctcaaataagtaaaaaagccaagtgtttgactctccacaccctataaacttacacacagtattctcatctcgattgatggttactcactctaatcttctagttgctctgtccaaaattttgggtcatgtttggcttaggttttcctttcacattcctcttctaatttttcaaaaaaaaaaaaaaatcctgttggttaaatcctcaaaatagatccagattctaaattacaatctcgattgttatcactgaggttggagtaccattgtctctcacctgtcagattacttcaatagactcccttacagtctgctttttaacagaaaaaccagaaagattctttaacaatataattcaggtcatgttactcatttgctcaatactctgcaatggcttcccattttcctcatagtaaaagtcaatggtcttaaaataacctgaaaagtcctacacgatctttctcctatatatttttttttacttcctctcctacatttccctccctcatttactctgcaacagccaccctaaccttgatatgttaggaatattctaccatagcactttgcacttgctatttttctggcctggtatattctccaagatatccacaagtacaactccccaacctccttaaagttgtaactgaaacatcaccttctcaataaagcctagtttaacaccctatttaatattacaatctgctatccggttcacctgctttttcatagtacttaccatctcctaacatcctagatatctgcttatttttaatctcctctacttattttcatctcatcacttattgtctgcctctctttgttagaatataaactttacaaggatgtgggtcattgtctatactgttcaataatgtaccctaagcgcctgaattagattctcaaatatggttggggctcgataaataattaattatagagcaaaagaatatgtaaaatctgacaatttctcaccacctcaaattgctatcatcctagtccaagttagcgttagcatcatcacttgccaggataattgtaattccttcccaaaagttttcactattttctgccattccacagtcattctctatagagtagccagaatgattcttttaaaacatagggcaaataatgtcattcctctcacccaaaccctcaaaagcttcttctatcactctgagtagccacagtctgactccaggctacctctctgacctctacttttcttaccaatttcctccttgctcactgctgtctgtaatcttctaggccattccttgaactacccaagcatgctcccactccagggcctttatgattattgcaattttgttccaaaacactttttttcttagtgcttacatgacttacttttcctcttcctgcaggactctgctccagcaatattttattaaggaaggtgaatgtcatgtgtaaatcactcactttttacttgtttttgtgtgtgtttttttaaataaaatgtaacacctgaaatatatcgtactttctcctcactagattttaaatgccatatgaactgaaattttttttaccattaatttctcaattgcctatggaacatagtgggcattcaattatttcttgaatgaataaataaataaatagtgcagccattacgagcttagactttgaagtcgtataattccctttataaaatgaatattaaacatagtaatattgtgttggttagatgatattgaaacatgtgaagaatttagtatattgtctataaatatttaataaatggtagtgatgatggaaagagaaagcagggtctaggtttgggaacataaatgagaaaattattatgtgaaccctttgaatttttaggtggtttctttcccattatgttaacaaccctgcattgggttggtgtggttaccaatttgtaaaatttggggatggattaggacatttctagcaagcttagctttaaaagcacagctgattccattgagcaaaggaagaaagtccctggagtaggtttctgccttgggcatctgtacttgcatgtatgtgtaggtttatatgtgtgggtatatagctggtcatcattaggcatagattccatatttgtgagttaatctactcattagaatttatttgtaacctcctaaatcccccaaatcaatacttgagttgctttcacagtgtttttatggtcatttgtagacatgcatgtgcacaaagcagtggaagcattgtttcctgataggtgtgtttccagctgaagtcaaacaaggcaatgctctatcatcttgtttcacttcaacaagtgtcctttttgctatttgccggcacatattttgcattgtgtgctttttgatggtgatttcatggtttaaaatggaccctaagtgtactgctgaagtgctgtctggtgtttgtaattgcaagaaggctgtgatgtgctttacagagaaaatacatgttttagataagcttcattcaggcatgagttatagtgtcttgtccatgactgcaatgctaacgagtcaacatataaattaaataggtgtttttaagcacaaacacacatcaaacaaggttatgcattgattggctgatgaaaatgttgtgaccagagactcacaggaacctaatcctgtgttttccctggaagcaaagattcagtatttaccaattcagtgtttgcaatgactttatagaatttaattgccgccaacaacatgaccatgtggattgtgctagcttctctctaggcaggttcagtgtgcaaatgagtggacagatatgaatattagccatgttaacaataaacagatgctccatttcccatttaggtgaattagggtccattttaaaccgtgattaaaattaaataggcaatccctttggctcattctaagtgaacaaaaactttctgggttgttttctttagaaattctactcaggaggtagaagtgctgatccctcatcagaagttcccaatgcacagaagcatacacttccaaagatcttctccattagggaataagtttagcatataaattaagagcacagactctggaatccaaagcccgggctcagatacagtccccactacttcctaccaatgactttagtgaataatctccctgatcctctgttcgctgatctataaaatgaggataatgataggatctacttcataatgttgttgtgaagcctaagtgaggttcccaggaataatgattaacagggggcttcatacatacatagtaagtgttcaacattcactggccattattattcttggagtaataataatggttgaaaatttggatttcatttcctccaggaatggtgaaactgacagtttaaaataaattggataggattcaaaaaatgtccatgcagttacacttctaattcactcttctgcctccggcatttctttcagaatcctaaggaatacttgttctgacataccgcatgaaaatcctggcccaggccttggtttagactcctttccttgaaaaagaacaaggcaggactaagggctaagaatgcggtgaaaagaggaaagggcagctccctgtcttgagggtcctgttgctcttaatctctcctctccactccacttcccacatctcgatgtatccggggaccacttctacagcaagtgcctgacaacttccttatggaatatatatccctgctaaagaatccagatcatagattttgatcttcattgtaagtttagtatgtcaaagctggaggactcttaaaggttagtatctagacagaatgagatggttaattttatgtgttaacttgaccaggcatggggtacctacacatttagtcaagcattattctgggtgtgtcttcgaggaaatttttggatgagattaacatttgaatcagtagactgcctttcccaatgcaggtgaacctcatgcaatccattgaaggcttgaataggagggaactcatgctgccttactgccttcaagctgtgatatcagtttttcctgcctttggactcaaactaaaacattgactctcctgggctctagtgtgccggcatttggacaggaactacactattggctctcctgggagtctagcttgctgactgtagatcttgttactggtaaacatccataatcacatgaaccaattccttacagtatccctttctctctctctacacaaacacacacacccattagttatgtttatctggagaaccaatacacagggatcggaataatgcctggcatatgttgcatgccctcctagatccctggtagaccttcttctccattgagaaccaatggatcttctcatcacagtgcttcaggaaatgagacagttcagagctgggctcagggcttagttctctcaacttctagcctggagctgtcttcattccccagcagcctctacccacatgacatattttcttcagctccatgtcagctgatacagtttggctgtgtccccacccaaatctcatcttgaactgtagctcctcccataattctcacttgttataggagggacctggtgggagataactgaattatgggggtggtttcccccatacttttctcgtggtagtgaatatgtctcatgagatctgatggttttataaaggggaaacccccttcgcttggctcccattctctcttgcctgcagccacgtaagatgtgccttttgcctcctgccatgattgtgaggcctccccaggcatgtggaactgtgagtccattaagcctccttttctttataaattacccaatctggggtttgtctttatcagcagtgtaaaaatggactagtacatcagccttatagactctccacataaaatggaataaagaccttttggggcaaatgacatgcctcaggcatgtctaagcaaagtctaagctttgaatatttgttcgcttatctacaagctgtgtgacattgggcatgttacttaaccttaacctacataagcttgtgagcctgggttttctcatctgagaaatgggggaaataactatactttccccataatgaggttttcaagattatatataaagtatttagcatactctctggcatacaggcatgttaaagaaaaaaattattcatgacatttgttaaagcagtaaagcagactttattcaggactatcaacataggttatagggactactgtgatggggttttgtagtagaagagagagattgaaatgcaacaagggaaagtggaaatttatagccaaacagcatggtgagtgggggttagtggatggaaaattaccaatagaaaacatcaggagtaagagaggattctggctaaacaaacctagcagggctcttgctgaagacaggccaaggtgatcatacatcacctgggagatggtggagggtgaagaacctaatcaaatatcaagggtgggggattctggctataccaacttagcaagattcttgctaaaattgggtgatgcaaaaacagacatagaagtccaaaagtcaagacctagatgggacaaggattcagaaaagtctaactaaagttgggttaaggagaggagttttgtcagtaagcattcaaaagtgttagctttaaaaaaaaaaattatcacccagaccactatcagattcttagaatactcaatctaatattatttattcatttaggaaccccatgcaaagttgatcagacagtaaaccagtgaggtctgtgtggatactcaccaaatcaattatgccaatgttattccagccttgcattatagggagaaaagaaataaacgtggggatgacccagcagcctcccagcattaatgcgatgcgcagaggggtcatcttgttcctatagaccaaaggctggcagcagatggcgtaatacctggagagagaatagagggcagagcataggcatgggcaaggaggaatgggagggagagaaaagagaatatatgagagagaaaaggggaggaagaggggatggagcaagggatagagaacagcaaacattgaggagaagagtcggaggggaagcagagaataaaaataaggaaataaaagaaagaatacagggtaaaaagaggagagcaagtggcagaggaagggaaaaagaaggaagagagagaaaagaacagaggaaaggaaaagtgattatataatacaacatgatatactggcctgtgagtttctgttaatataaatattaatatatactttggatcacatctgagaatcattgcctgcagttggccccacagtcctctccatctcccaatatctggaggagctccacacacaccagaaggtcttttctatttctggcactgttccaacactatcccgatgcctgtgcattgaggagcctctgcccagccctctgggcctcagtatccaggcaactgtaatctatttgattacaacttgaggtgacccaggcatagctctacatctgggctctaaccactgtgtctcagatttgtccccttacccttgatcacctgcctacatggaagtggagctctaagtccgtgtttttttttttgaattgtggttcaaggattcccctccatccccccatccctgccatgctgaatcaaactcacctgaggaagcctttttaaaatgcagatcccaaggatctcctgaatcagagcctgttggtgaacaacctggagcttgcatgttgacaagtgtgagttattactaagtgtgagttattgttaaggatactcagtttcctccttccaaacacgtacacttcttggcatccttacggctggataggaccaagggactagtcctgaccaatgaatcatgaacagaattgacatgcatcacttctgggacaaaccatttaactgtttctgggatactaagaatgtaaaattttgaatatttcctgctccatcatttcctgtctactggatgagaccaccccacttccatttattagagtctgacctctctcatgggacacagtgctcactatcttttgattccatgttctgcctatgatactaactttcttcctgcctccagaaagaggtacaatctgcccattcaacagtctggcctctaacttctagaccgttcctgcatgttactctggccttggagatcacctcttccatgcccaggcatggcatggaatttcacaacaggcagaatgctacagtagatctatcattcatttctctttgggagagtacaaaatagaaatgcaaaaagagcctggaggctgtctattctttaaggttttataccatttaatgatgaaccaccctcatacacccctcattttatgcagttcactttgttaatttttcccacctcttcttttcttttcttaattcaaagcctaactaacaaaacaatggctatattctttgaagaggtggtagtaggatgggttgagagagagggtggaatgaggagagccccgtgttggagcacgaggagcaggtgcctcaggagcagggagaggagaaatacccgctttcctacaaggcactgaggagcagctgacgacattgtgccaaaagctccttgtagctggcaagcttggtggggtgtcctgatctgggccagagtgcaagaaacaacaaatcaaagaatgggagactgtcttgctccgaaaaaccattgtctccattataattctgacatggctgcaaaatcaaactaaagataactcagtcattgaaagaatcatgattagctggattccctccacactgttggcttacaagaaagacaaattatatctgagtagcaaatttttctgaatggtgatattcataatcatcagaggtttattattaacatagaattaatgatgaatttgaagtggatgaaatatactctttttttttcaaattttgtttccttcttgatttcctgttagggggcaagtttctttccatttagcatccttcttcctttctcttgttaatagcacttcaaatccttcgggagttatctctttgctgttgctatagtgctgttgggaaaacaaatgatggggctttgacttttctagcctaggggtgacccgatcagactttctcctaggactcaatgtcctgcagagggatgcaaggtgggcaagtcagcagagggctttttatctcagcagcagccccctggtagggctggggattcattcctgctccttggatcttttgcagcatgctcttacccatcaagtcctcactccttagctctctctttaaataaaccacctcatatatttccaataaattctctttttgcttaagctggtgtcatgggttgaattgtgtccttcctcttccaaaagatatgttgaattcccaactctcagtaaccttggaatgtgaccttatttagacataggattttaaaagaggcaatcaaattaaaatgaggtcttcagggtgatcctgaatccaatgtgactgatgtctttatgaaaagaaaaattttgacacagaaactgatatgcacagtacgaaggtggccatgagaagatggaagattggagtgatgcgtccataagccaaggaacacttaaagttgccagcaaccagcagaagccaggaagaggcaagaaagaatccttcccctacaagttccagagggataatcgccctattgatacctttatttcagacttctagcctttagagcagtgagacaacaagtgtgtattgttctaagccatccagtgtgtggtacctgttatgacagctttagcaaactaatacagttggctaataacaatctcttgcttgcaagaaaagtataccacttcacacagagcagtaaaactggcttgaatgccagatatatctttcatagtatacttaagtaagaatatcttttgtttcattcaatatactttcagatcatagctcaagttttggcatcctttcttctattatcccaaaaaggcaatagagggataaatgaagaatgaattctgccctatctttgttgtgtaatcaatataatttttgaggtttagaatgaggtgccgagatgttgccaagtaaagagcagatttcagaaattttggttggatctctaacgtcacaaaaatccaaaagttcaaaaacacaaggccaaattaagtatcctataggacactgttcaccacaaccaaggtatggaacctacctaagcatttattagtggataaatgagtatagaaaatgtggtatatatatacatgatgggatattattccatcataaaaaaaataaaatcctgtcatttccagcagcatggatggaactggaggacattatgttaagtgaataagccaggcacagaaggacaaatattgcatgttgtccctcatgtgagggagctaagaaaattgatctcatggaggtaaagcataaaatgatggttaccacaggctgggaggggtagtatgtagggggagtatgaagaggggtcagcgaatgcatacaaaaatacaattagatagtgggaataagatctagtgtttgggcagcacaagtgggtaacttgttaacaatcacttattgtatctttcaaaatagctagaataatagatttggaatgctctcaacacaaagaaatgataaatgtttgaggtgatggatatcccaactaccctgatttgatcactacacattgtatgcttgtatcaaaatatcacatgtaccccataagtatgtacaactattatgtacccataaaatttaaaatattttacataaataaataatatcttgcaggacaaaaagtacgtttcagaaagcaggatgtcttacctgagaagattctttgatttccataaatggatgtggatgtttagagggttatgttgggaaaataatagaatttacaagagggctttagaatgtatggttatattggtgctcataacatttttatgaaagcctttctttctaaatctagcttgcccagggctattgccagtttcccttgacataatgatcatcccatgaacaataatattgccctacattctgttgtccaaatgttctatgctttaatttgccttaccctagatttctaggagctgctgctatatagaattaaatagtggtaacaggtttccttttaaaattcaacttaaaggaggatactgtgaatgtagtacacattttaccaatcccttacacattttttaatttgaaacagaatcctgttctgttgcccgggctgaggtgcttatgtgatcttggctcactgcaacctccgcctcccaggctcaattgattcagctgcctagcttcctgagtagctgggaatacaggcgtgcaccaccacacccagctaatttttatatttttagcagggacagggtttcgctatgttggctaggcttgtctcaaattcctggcctcaagtgattcacccgccttagtctcccaaagtgctgtcattacaaacatgagccaccacacctggcccccttacacattttacatatacagtcagttccctggaaaatgcttgccagaagtaaagtgcttgggcaataagcccaactcgaagggtgctaaggtggaatacatccaaacatgcccaaacacagatgtagaaatttgctcttgcaggatctagggtggttaggcaagggtgggaagaatcctttatctccttttttaaaattatcaataagtaaagggggaaaaaggattttattttacttaaatttaaattaggttaggtagattgttagtgacaggtaaggatatgaataagaaaaatactgaattatgtctaggtatatgttttacttgcattttgacctctgcagcttcttcaatgtggtcctctgtcttacagtaaacataatttgatttttgagtgggattgagtatagaacataaggttcttatttggagctcgaattctagcatctacttaactttatgtgctgaagattcacaccaagacctggcacctttgaggcagcagccctaaataagtcacctcatatccttccaatgtctttctgatctttgctttcgagcaaaaaatctagaaaagtaaacatcctctgaaggctggactcaagaatgcaaattaagtaggtgaaaaaaaaatcactgaataaagggattaataaaaattgagttctagtgttaaccgatggtgcttccttaaaattttaatatttgtctgtagataagactagatagaaatctgataacttgacttttatatattgcagttgattttcagttcctatatttggattataatgtccccgttaataacaaaaaggaaactgacctatcatgaactattcctgcaacacataaacaccaccactagacagaattagctaattaaatttgcaagttctttggagggaggtaaggcaaaatgcactggctggtttgataataatagctagtatttatttactgaccaagggctctgctcatttgatctcatttaatccgcacaactattagattggtgcaaaataatcgtggtttttgccatcaagaataatggcaaaaaccacgattattttgcaccaacctaacacttttgagacaggaactgtaaatatatccatttcacagatgaggaaagggaagcacaggagtgttcgaaatttgcccagtctcacaggtggtaagaactgagctggcatctagcccaggcagactcactcaagagccaggacataaacctcctatcatttcactcagctgcctctcccattgaaaagccactttggaaacaatcaaaacatgaacatactgaatctcagaacttgaaggatgctaagaatcatgaaatcctcaagtcctctgatatggtttggctgtgtacccacccaaatctcatcttggattgtggctcccacaattcccgtgtgttgtgggagggaccaagtgggaggtgattgaatcacgggagtgcgtctttcccatgttgttctcatgatggtgactgggtctcacaagatctgatggttttataaaggggaatttccctgcacaatctctcttctctagtctgctgccatgtgagacatggctttcgccttctgccatgattgtgaggcttccccatccacattgaactgtgagtccattgaatctctttcttttgtaaattgcccagtcttgggtatgtctttatcagcagcatgaaaatggactaatacagtaaattggtaccaggagtggggtgctgatgaaaagataaccgaaaatgtggaagtgactttggaactgagtaacaggcagaggttggaatagtatggaggactcagaagaagacaggaagatgtgagaaagtttggaactttcttaagacttgttgaatggctttggccaaaatgctgataatgatatacacagtaaaatccaggctgaggtggtctcagatagagatgagaaacttgctgggaactggagcaaaggtggctcttgttatgatttagcaaagagattggtggcattttacccctgccttagagatttgtggaactttcaactggagagagatgatttcgggtatctgatggaagaaatttccaccaggaagaaatttccaccatcaggaagaaatgttaagcagcaaagcattcaagaggtgactttggtgctgttaaaagcatttagttttataaggaaagcagagcataaaagtttggaaaatttgcagcctgacaataaaatagaaaagaaaatcccattttctgaggagaaattcaagctggctgcagaaacttccataagtaacaagaagctgaatgttaatccccaagacaatggagaaaatgtctccaggccatgttagaggtctacgtggcagctccttctatcacaggcctggaagcctaggagaaaaaatggttttgtgagccagacccagggtccctgtactatgtgcatcctagggaattggtgccgtgtgtcccagctactccaggcatggctgaaaggagccaacatagagctcaggccatagcttcagagggtgcttccatgtggtgttaagcctgcgagtacacagaagtcaagaattaaggtttgggaacctccacctagattacagaggatgtatggaaatgcctggatgcccaggcagaagtttgctgcaaaggcagggccctcatggagaacctctgctagagcactgcagatgggaaaagtggggttggagcccctgtgcagagtccctactggggcaccaactagtagagctgcgagaagagggccagcatccccagaccccagaaccagagatccaccaacagcttgcactgtgcaccttgaaaagctgcagacactcaatgccagcctgtgaaagcagatgggagggaatctgtacttagcaaagccacagcagtggagcttcccaagaccatgggaacctacctcttgcaccagcatgacctggatgtgagacatggattcaaaggagatcattttggagctttaagattttagtgccccactgtatttcagacttgcatggggcctgtagcccctttgttttgctcaatttcttccatttggaatggccatatttacccaatgcctataccctcattttatctagaaactaattaacttgcttttgattttacaggctcataggcagaagggacttgccttgtctcagatgagatgttggactgtggacttttgatttaataccaaaaggagttaagacttttgagggactgttgggaaggtattattggttttaaaatgtgaggacgtgagatttgggagaagccagaggtggaaggatatggtttggctgtgtccccacccaaacctcgtattgcggctcccacagttcccatgtgttgtgggagaaacccggttggaggtggtttaatcatggggtgggtgttccccatgctattctcatgatggtgaatgggtctcaaaagatctgatggttttataaaggggagtttccctgtacaagctctcttctcttgtctgccaccatgtgagatgtgcctttccccttctgccatgattgtgagtcctccctagtcacgtagaattgtgagtccattaaacctctttcttttgcaaattgccaagtcttcagtatgtatttaccagcagtgtgaaaatgggctaatacatcccctctaaaatgaagtgtgtatccaaacccacttaatttttctagggatttggaattcaccaggtcctactgcagtacattctaaacttaagggcatcctaaagttaagaaagtttcctctaaaaatcaattttcggtaacttgtagtttttccctctggcttaatttaaatttctatctaattctttttctgcatagtggttctagtgatatctgaagagagcttttacatccctctgaagtcttattttctgcaggtaaaaaattccctgttgctctcaaccaggggtgactttgctcaccaggggacatttgacaatgtctggagactttgttgttgttgtcacaattgggaaggaaatgctactggcatccagtgggtagaggtcaggaatgctgctcaacgttctacagtgccccaataacaatactggtctatgtcagtagtgctgagattgaggacccctggtttagatgagaggattttcaccaatagcaggagtggagctccttgtcctctgtatgtgctataacatgtcgttatctcttaagagtggggtgccacaaggacagcactatgttctggtgcatcctatatggaccaaaaaccactgcattgccttccactttgctcaccataacttaatatagcttaggggatacccagaagcacaggacacctgtgcccctaaaaaagaaaatgatctaggacaagaggtgggaaaaccgtcccccaactgatgtataagttccatgaggacagcaatgtttgccttgttctgctttgtgtccatgatggctagtacaatgccagatatattgtggatactgacaaactggatttttaaaatgtaataaactctcaatcactaccaagtacaataaattccattaaaatatgttaccaggttttggagatgtgaacaggcatatctagcagagggatggggaaaggctttcttcaatagcggttttttaagtcaaatgttagagactggatcaggatggtggaggagaaagtgtaatctaggtgctgtagacagcatggccaaggcctgaagagagaaattatatatatgaaatacatacccataaatgtatattcctatatctatatagccctataaacataagagtaaagttaatgaaattgtagggtgttcacaaggaagtagacaaaaataagcctaaaaaggctgactggggcacgtctcagagcagtggttctcaaattgtatcatctgtcagaatcacttaaaggatttgttgaaacacagattgctggtaggtctggagtgaggcccaataatttgcatttttgatatgttcccaggtgatgctgttgctagtggattggagaacacactttgagaaccattgtcttagaggttttgaatgttaggctaggaggagttaccaaaagatttttaagctggaaaacgtccatcgtaatcaatattgctgtgtgcttttctaaagaagctgaattaaaacgaagtcaagagaaagagttgttgattcatatgctaggtagacagtgtttaacaggaaaagtaattgtctcatctcaggaatacatgaatcagcaaaatttgttctccagccttccattgggtatctcccattcttccttaaccagaaaacttttacaaagtagttaaatgaatgttcaaatgatgagtgaggttccagatggccaggattaactaaaatgaagcaaggatatttacaaagtaatttcttatgcaaaacatttcaaaagtattgctcataaaactccattaaaatctgcttttgtagacccagccaccagcttctcccactgcagccatgtgcaaatgtgtgatcaaattgcttttaaatgtctctggggacacaatttactttgacaactcttagtaggcagccatgtattttaagctccatgctaatcccttccgtgctccttctgcaattaaggaaaattctacttcctcacttcctgccctcccaaccacagaaaaggcacaagaagcaatgataataagttggaattctagactgtcagaattggaggagatagtagcagtcaactttacgtcttcaccattgggtaccaactttccctgccttaactccttagtagctctgtggtcttagaatcagttactaacctcaagaagatccagtttcttcatctttaaagttagaataattatgtcaacctccaattatgcctctccttcactgtgagaattgatgaaataatatgtttaaaacataggaagttcttggcacataaatatctgtttaatacatattattataaacagactcaaatatattttggaattatgagctctacattatttaacaaataataaaaagccacttggttcaacatctttccctaacagttgattctaagaaatataaaggtgaatgaattggtctctaaaggcaaatgaaagcattaagaccatatttgttatgtgcaatggaggtggttacatgtaagatctagtaatcatacattgtcgcttaagctgctgagttttgatgtagatgttacatgccaatagataacaacagggtaaacaggtcatgtatagcttggcaaaaccttccaactgggttccctggccacctcttaataggtgcatttgggctggtaacaggtatgtaccttcctgggatgaagctcccagagtgaggggcaggctgccatctttgctgttttgcacttttcactcttgatacctccatgtagtgggagatccaaggtgactagcaactggagcaggcccccagcatactgcagtagccatatgttaaagtagccagacttaagtgggtacctgttcccatatctcctcaccaggcaggtcctccaggcctgggcctccagccatcccctgccagaggtattgagccagtagcaactcaggacctcccgggacagagactccaggggcaactgaaagcctctctgccactgcttctgcagtggaactgcccttgctacccttggactaatgaaggagtaaagaccctaagtgccttctctacacctccaacaagctgcacttgacccaaggagaggaggccagaccatctctcatgggtcccacctactccttctgcttgcaccagacaggtaacccctaacttgggccccagcacatacccttcagtctgggctgactgcactgagcaattcctgacctcaatctctctggggtggagcctccaagagataagcaaaagacccttgtccacaaccactactaaggtcccttcctctgctgcctccaagtggaggaaggaatatgaatactgagattgccccagagctacagtcagcagcccaggagttccaagccatgatctgcagccagcatgcaagtgggagaggaacccacaccttcagagcatttagagggaacacagctgcaactgtgaggaaacaggggagccacacaactgagcaagagtctaccaattgaccatatgtctaagtgccacccacaggaccacacctcgaagcttaagcatcaaaaatacctcatttatatacccacctctgaaaccaaagacaagaagtcagcttcaaataaagactgtacacaatgccttggccctgtgaaagcaggcaggaaaggagtctattgactgtattcaatctacactgcagttaaaggaatacccacatacagagatgagaaacaaccaatgcaaaaactctggtaattcaaatgaccagagcattgttatgtttccaaatgactgcaccagttctccaacgagagttcttaaccaggctgagctggctgaaatgacagaaatataattcagaatatgaataggaatgaagagtatcaagattcagcaaaatggcaaaacccaatccaaggaaaccaagacacacaataaaatgatacagaagctgaaggatgaaatagccagtataaaaaaagaacataatggatctgacagagctgactaacacaacacaagaatttctcaatgcattcagaaatttaacagcagaataaatcaagctgaggaaactttctcagaacttgaagattgtctctctaaaataagacagttagacaaaaataaagacaaaataattaaaaggaataaggaaaacctctgagaagtataggattatgaaaagaggccaaatctacaaatcactggcatccctgaaagggatggggagaaagcaaacaacttggaaaacatatttcagaaaatgatttatggaaactcccccaaccttgctagaggccaacagtcaaattcaggaaatatagagaactcctgcaagattctacacaagaagaccatccccaagacacataatcatcagatattttaagataaaaatgaaagaaagaatgttaaacacagctagagagagagagaggaggtcacctacaaagggaacaccattagtctgaaagcagacttctcacctgaaaccctacagaccagaaagaatcgtagtcctataatcaacattcttaaagaaatatcttcaaccaagaatttcatatccagccaaactaagcttcctaagtgaaggagaaataagattcttttcagataagcaaatattgagggagtttgttaccaccagacctgctttacaagagatcttgaaaggagcactaaatatagaaaggaaagactgctaccagattatacaaaaacacacttaaatacacagaccaatgatatataaagcaactacacaaacaagccagcataataaccagctaacaacacaatgacagaatcaaatccacacatatcaacattaaccatgaatgtaaatggattaaatgcctcacttaaaagtcacagagtggcaagctggattaaaaaaaaaaagtgtgacccaatggtatgctgtcttaaagacactcatctcacacgtaatgatacccatagacttaaaataaaggaatggaggaaagtctaccaagcaaatggaaaacagaaaaaaacagggattgcaatcctaatttcaggcaaaatagacttcaaactaacaaagatcaaaaagcacaaagaagggcattacataattgcaaagagttcaattcaacaagacctagctatcctaaatatatatgcactcaacacagaagcacccagattcataaagcaagttcttagagacctacaaagagacaacaatgcccacacaataatagtggaaggcttcagcacttcattgacagcactagacagatcactgaggcagaaaattaacaaagatactcaggacctgaactcaacattgaccaaatggacctgatagacttctacagaactctccaccccaaaacaacagaatatacattcttctcatcaccacatggcacatactcttaaatcaatcacgtaattggacataaaacaatcctcaacaaatgcaaaagaactaaaatcatatcaaacacactttcagaccacgatgcaataaaaacagaagtcaaggctaagaaaattactcaaagtcatgcaattacatggaaattaaaaaatatgctcctgaatgatgtgtgggtaagtaataagattaaggcagaaatcaagaagttctttgaaactaatgagaagaaagatataacataccaggatctatggaacacagcaaaggcagtattgagaggaaattcatagcactaaatgctcacatcaaaaagttataaagatctcaaatgaacaacctgacatcacaactgaaagaattagagaagcaagaaaaaaatcaaccccaaaaatagcagaggacaagaaataaccaaaatcagaactgaattgaaggaaatcaagacacaaaaaaacattcaaaagatcaatgaacccagaagttaggtttttgaaaacatgaagaagatagataggatactagctaaagtaataaagaagaaaagagagagatctgaataaacacaattagaaatgacaaagaggatgctaccactgatcccacagaaacaaaactaatcagaaactactataaagacctctatgcacactaactagaaaacctagaagagatggataaattcccggacacatacaccctcccaacactgaaccaggaagaaactgattccctgaacagaccaatgattagctctgaaattaaatcagtaatagacagcctaccaaccaagaaaagcccacacctgatggattcacagcctaattccaccagatgtacaaagaatacctggtaccattcctactgaaactattccaaaaaattgaggaggagagactcctccccaacccatcgtatgagaccagcatcgtcttgataccaacacctggcagagaaacaacaacaagaagtcaggccagtatccttacatgaatatcaatgcaaaaatccctaacaaattacttgcaaactgaatccagcagcacatcatatagctaatccaccacaatcaagtaagcttcagcctcaggattcaaggttggttcaacatacacaaaccaacaaatgtgattcatcacataaacagaactaaagacaaaaaccacatgataatctcaatagaagcagaaaaaggctttcaataaaattcaatagctctttatgttaaaaattctcaaaaaaaactaggtattgagggaacatatctcaaaataataagagccatctatgacaaactcgcagccaacatcataatgaaatggcaaaagctggaagcattcccctttacaaatggcacaagacaagaatgccctccctcttctaatagtattggaagtcctagccagagcaatcaggcaagagaaagaaataaggagcacccaaataggaagaaaggaagttcaactatgcttttttttgaagataacatgattctatatctagaaaaccccatagtattgccccaaaagctccttcagctgataaacaacttcagcaaagtttcaggatacaaaatcaatgtacaaaaatcactagcattcctatatacctacgacagccaagctaagagccaaatcaggaaggcaatcccattcacaactgccgcaaaaagaataaaatgccaggaatccacctaaccagggaggcgaaagagctctacaatgagaattacaaaacactgatcaaagaaatcagagatgacacaaagaaatggaaaaacattgcatgttcatagctgggaagaatgaatattgttaaaatggatgtactgtccaaagtaatttgcagattcaatgctatttctatcaaactaccaaaaacattctttgcagaagtagaagaaaaactattttaaaattaatatggaaccaaaaaaaagcccaaataacgaagtcaatcctaagcaaaaagaacaaagctggaggcgtcacctcacctgacttcaacctatactacagggctacagtaaccaaaacagcatggtactggtatgaaaacagaaacatagaccagtggagcagaatagagggtcagagataagaccacacacctacagctatctaatctttgacaaagctgacaaaaacaggcaattgggaaaagattccctattcaataaatggtgctgggtaactggctagccatatgcagatgattgaagctggacccctttcttacaccatatacaaaagccaactgaagatggattaaagacttaaatgtaaaacccaaaactataaaaactctggaagagaaactaggtaataccatcctggacataggaacaggcaaagatttcattacgaagacaccaaaagcaatcacaacaaaagcaaaaattaacaagtgggatctaaacttaagaacctctacacagcaaaagaaactatcaacagagcaaacagaccctacagaataggagaaagtatcttcaaactatgcatctgacaaaggtctaatatccagcatttataaggaacttaaacaaatttacaataaaaaagtcaaacaaccccattaaaaaatggtcaaaggacatgaacagacacttttcaaaagaggacatatatgcagccaacaagcatataaaaaagagctcaatatcactgatcgttaaagaaatgcaaatcaaaaccacaatgggataccatctcataccagtcacaatggctattattgaaaagtcaaaaaatgacacatgctggcgaagttgaggaaaaaagggaacatttatacactgttggagggaatgtaaattagttcaaccattgtggaaacactatggcgattcctcaaagagctaaaagcagaactatcattcaacccagcaatcccattactcggtatatactcagaggagtataaatcgttctaccataaagacacatgcacccaaatgttttttgcagcacccttcacaatggtgaagacatagaatcaacctaaatgcccatgaatgaccgattagataacaaaaatgtggtacatatacactatggaatactatgcagccatgaaaaataacaaaatcatgtcttttgcaggaacatggatggagctataggccattatcctcaggaaactaatgcagaaggagaaaaccaaatactgcatgttctcgtttataaatgggagctaaatgacgagaactcatgaacacaaaaaagggaacaaaagacattgcgtctacttaagagtggaggctgggaggagggagaggagtagaaaatcatattaggtactgggcttattaatacttgggtgatgaaataatgtatacaacgaacccctgtgacacagttcaactatataacaaatcttcaaatatacacccaaacctaaaataaaattttaggttttattttatgtgtgtgtatatatatatatatatatatatatatatatatatatatatatatataatcttatatataatttttataaaataaaaattttagaaaagatatttataaaaaataggtgtgatttggcatccagctgatcatgggagataagtaaaagatgacttcaaaaagttgtgtttcgatgtctgaaagataactaatagattcaccttcaatatacaatgtggaagaggatatagtattagtttacaataaaaatgtctacttgagcacactgaggtttgagaaaacagaaagatgtttaaggcaagatgctgagcagacagagatagaaccccagagcccagtgtgtgaaaggggtgagggagagacaagagcagaggtgcaagtgaagccatgggataaatgaggtttccaaaggaaagaggggacatactcagggctggaaggctaaggatctaaccttcaagggcactcagctatgagtcagaaagaacaagatgactatcagtgtctgggaaggccctcgctacagccactaggaatttgcatttagagaggaaaacaataatggaatagtccttgtggctaacattaattgaacacttaccaagtaccatgcactggtctatgcattattcagtttattaactgaacaataaacactcagttatttattcctcacaagtcctaaaagagaagggaagggattttctattaataacacaatttttacagataagacaaagtccagaaaacctttgtcacttctccaagatcacacacttgacaaccagtcaagctgtgactgaatctaagcagcctagcacctcaggtctcattcttaaccactttctatattaagagttctgaggacagagaaaccaaccccagcgtcatacaaacaaccacaagtcacatctcagcattcagtgctcagccaaacatgcatggaacagctattatgttccagaaagaaaaacacacgaatagataagataaggcctactctcaagaattttatattctggagcaaggcagacaaatcaaacaattattgagacgcacataataagaaacttctattaaccacgatgctttgattcaatactccatgggagctcagaggaagaaatgacaaatttttatgaatgaagcccaacagtcattggagaaggcgacacatgttatctgagtattgaagaaaggtggatgtttgccagaaaaataaaagaaacccaaggcacaggtagcaacatgcagttatgaggaaacatatattcagggaatgataacagatcactcatgggtaggagttgaggtaggaaaatcagactgagaacacattggaaaagcagtgaaagctgagctaagaatttagcttttagttaacaagggctttcctatgggttttcacatgcgttttcaggagcagccactccccaggcctcaccaacttccctatcccctactgatacccacagcccctgcagatcccggcatcagcatcacttgctcaggagcctaccctgctttggagattgcaacttagcagactccaatagctttttttttttccttctccttatagtattcaatggtcaccaattttactgtaattatctgtttactgtctgtattcccaactagacaaaaagttccatgattcagagtttttctgatcattcaccactgtatttacaatgtccagaacaactcatagtaattagtaagcactccataaatgtttgatgaaatgaatataaaaataacagttcaaaccctctggcatgaaattcaactcaacaaatattatgtacaaagcctgaacctgccctaaaagagtatgtgagaaggagaaacttttaatatactttccttgtgaaatgcatttcaatcctattgggaaaacaaatgtaattgtgtgacacagttcacaatgacagacacttttcatttatacattacaaaatcgaattatactccagggagatcattaagaaaatgcagatacatttatctccagcacaagattaaacatgcaaccttgaagtaagaattgtatgttttacaagtaaacctgtttaaaagaggatcggagactaagaaactgttggagaattttgccgataaaacacatcaaatttttgagctgtgcagaggaagggtgacaattcagctgggtgtatccaaaaaagaatcttgcagtactatagagaatactatcttcaaggaagtgaaattgactttttttttaaaaagggaattacatttaatgctaagtaaaggacaaagtacagcatgttcagagaaaggggataaaaatggttaaaagtctgaaaagtatggcttatgaggccagcagaaggatctagaaatatttggcctaatatagggaagacttggggatgatatacctctgttttgttgtggaggctccataaagatacctgtagggtctggccagcctaaggggaactggtatctcctcttcttgtctgcctaacacccatctttccagtgagaactgctatttcttcacaccatatgtttttggtaaagctgggagtcatggtgcctgacctctgcccagtaaccaggatgtgtcatctccacaccacagtgactggttaagtgaagagtgtttgacacaagcaaagccaacggaaattcttccatgagaaacagcacttaggtttctcttcctatggactcatgtgttaaggatggtttaagatttgttgactgtgactatttttctttcctggtggaagaacccagcctaagaaaaaaatctaacaagaaaccagagctgatggacagcatagggacaaagagggacagatagaaagagaggaatagacatagggaaacagagagggaagtaaacagggagaacaagaaggcaagatggagacaaagaggagagggaaacagagttagagaggggcaaagttagactaaatgacattgttcaaatccttgtagagagccatgtctgaagccagacttttcagttatttgaacgatcaatttattatctgccgcatgctgctgaaagaaaccttgctaatagatcatccaataagcaagttggtaaaaacattacattcaggcaactcactggcatatatcataaactcaaaatatattcaaataagtctgcttattacatatgaaatcactggcatttacaggcagttgctatttacagtggttacctcaggttatgcagctgtggaagtggatattgaaagaattggggacattatgttctacttgtgaactgatggcattttctacaatgctcaggtattattaatattgtgacttaaaaaatctgtgaggattagaaaagggactgttagaaaaaaatcaaatacaagcttgtgaacagggaggaggttaaccaagaccaatgtaggagtgatgcaccccgtaagagatggtgagggctcccttagagggagatgtgagggtgtttgatgagaaagcagagagaacacactggtcaggaagatttccatgctccctggcttgttctgacctcagagggaactcccagcactgaagcagaatgttctcagagaactgaggaatgtgccattctagcaacattttcagttaaaaggctattgtggatggacttgcatttgagaaggttacgttctagcaaagggaaaattgaagtttaaaatgtgtattacagaaattagtaaaactgaaggcccccaaccccaatttaactgaccatccactctggccagcactacaccgtatgccctacccctcaaataaccacctgttaacgatttggtgaaaattcattcatgatctttctttttcattctcaatctctctctctttctttctctctctctctctttctctctttctctctctctccacctctctttctctctctctccacctctctttctctctctctccacacacactcatgtaaacccagatacatgcatctctatatttattttacaaaaatggaactatgctaaacattagagtctgccagttgctttttttcccccaacataatacaccagtgatatatttctaggacaacacacgtcattatttctcatggttttcaatggctgccttatatttcacttttaaaactagtactctatcatgactacttggttagcttttattcaccacagtactttagatcttaaaaaaatcaactgtactctaaagcttttaaagcagtttttgatctcctatgacccatactatatggtgcatttattttaattatgctttggaaattatttttaaggaggcaataaattcttattaacagaattcaattctgaaagcaccaggaagcacagtgagctgagaatgggagttgggaaaatgcattttgtagtactaaaggagtcctacattttgctttgatccaggagtctgccatctgagaagagttacaaattaaagtgagccctcttgctcaaaggaactaccccttatgattgatcccagaagacttgtagcagctctagagagaaggacatggcatactgccgggaataacatggctaacaaggacatcacacctcattgagacattcactctgtgctttggcccagcccagctgaaccaaactgttaggacgggaaggacacagcaaaaacagagctagatgataaataaaaccatcctcttccaggctaaaacattgccctgtaatgttcaggatggaccctccagcactatgagggaacgctcttgggacagggaaagctggagacaagctggaggcaagatccccaagctccccaaggaaaataaaacaaaagaaaccccatctgatatcttacttatggtattggagtttttgacatacactgtcagagaatgaaatggaattattggcatgactctcacaaagagaacgtgctgaccactccatttgttcaatcgtgtttgtcaaatacctaaataagtatttatgcaatgactgtttaattgtcaacctccccataacaatgcaagttctatgagggcagggatcttgcccttgttcgtagccttgggcttcctcccattggaatagaaagacatttaagaagaaagtatagacttgattttaactataattacactgagttctacaaaggagaaaaatggttttgatggagtcagcgaagacttctgcaaagaagagaagatttagctaaaatctgaaagacatgcaggagaggaggggcagaggaagttttcaggcagagggaaaagccaaggcctcaggtggctgagcagagagccctggagaactagaaagaaggccaaagcaactcgggcctggaggtgaggttaggaagggggtgaagggaagctggggacatggacaggaaacagagggtgaaaaaccttgtatgagtctggtcttgatcttcaatgcaatgaatagccactgaagggttttaagcaaaggagcaacagtattagagcagcattttaaaaggatggcttttgatcttgtgagcgacaagtggatggggagggaataaaacatatttggagggaataattaggaaagtgttgagtgatttcttcaagaaatgatattactttggatgaatgatagagagaaatagactaggatctctttaggaaagaaaatgagcaggacttgtcattatttaaatgtaggaggcaaggaaagactgctatcagaataactacctggtttctagatgatgcaagctgttggagcagctattcactgaggaggtgcaagtttgatgagaaagatcatgagttgtatggctagttacaagaaactgacatgaacaacaacatccactaacatggaatattgtgacaagctgggccaaagtgatgccttaaatggattatccaatttatacctaactgtagtcatataaaataggtgctatctccctaagttttagagacaagaaaggcttagactcagaaaggcttaatcacttattcccattcccagaactaaacattttaaaagctgggatttgaacccaaatctcttcaattctaaagcagatggttcttaatgaccaattcatcctgtttcatgacaactcatacctactcaggaaaagtttcctgatttgaaaagtacgtaggcataaatctgaagccaaacctgtcaaggaaacctctagaccttctctcagggctgcccacagcaaactctccacaatggacagttgattctacactttctcccattttttttcctggctgactggctctttttcttactcctgcttttacacaggccttgaggttacctcagctgcccctatcacccctgcctggtcttctccaaattcctgtagtactttcagtctcactactcattttaacaatgatcatatgcaggttacccagcaggatttccatagattttctacttccttacattgtatttcctataatacaaactttcattcagtgtatcctgactgtctttaaaagtctttcatgtactaaagtcagattgttgtaaacaagctaataaacacaaatttccaactatgccatgccatgggtctggttgcttgccatgagttcaattttaccagagtcattatctctagctatagagtggagtctcattatacatgcatttaacttaagcatattcaactatatgttcttggcagaggaaaagagaaagcaatttaaatacagcaggccattatgactaccattccaatcaatgcacatatgtcccatgaaataggagatgaacctgctgtcccctcagctggtttcagtctctaagtacctcccccagtgtgattaattctctgggaagactatgatgttagtgtttaaaagtgtgtatgttagatataccacaatctctagtttcagtcaactacttttcctagtcctcaatttaaaaaaaacagtgattgtcggtgaaaccccgtctctactaaaaatacaaaaaattagctgggcctggtggcgggcgcttgtagtcccagctactcaggaggctgaggcaggagaatggcgagaacccgggaggtggagcttgcagtgagccgagattgcggcactgcacttcagcctgggtgacagagcaagacttggtctcaaaaaataaaaataaaataaaataaaataaaataaaataaaataaaataaataaataaaaataaatgaaaataaaaataaaaaacagtgattgtctgagcacgatggctcacatctgtagtcccagcactctgggaggctgaaggctgaggataacttgagcacagtagctcgagaccagcctgggtaacatagtgagacttgtccctataaaaaataaataagaataaataaaactaaattttaaaaaagtgatctatcccaagactggaggaaaacttgggtttgttgggttgctcaagacacagtaagaaatcattgtccctggcaattctgattacatgtgatttgcaccccacatttttctgagagctaacccctaagatactactacattgataacagcatgtttgtgtagtcatctgactttagattgcattctacctttatgatgaaatgtaaattagcaggaattggaaaatgaatagtgatggtacaagtgataaatacataaatctgcaacaaatgaggcaaagatgaaaatcattaggtcccctgaagtcaaatatgaagaaagaaaataaaattatgccacaagaatgaaatgctagatctgggtccaaaaatcataaaattattgggaagtttactgtaactttctggaaaagagtctccacaattatatgcacatacataaatatgtatatcaaattattacagaaacatattttcaagaaaaggttatgttcaaacatagggcattttcattctgaaccacccctgctgccctctgggaagatgtactcattcttgatgcttagcttcttcagaattttgttcatgccatcagtataaaatttacagctctatagtaaacttgattgctgacatctattgctatttagattgcaatctccttgcagacaagttataggtcttactaatctgtgcatctacagtgcctcagagagggcctgactaaaaagggggcctctgcaaaggctggagaatgactgtataactgaattatcaaatttacctctctgagattcatttcttctaatgaataagaaaaggcagacactgcccaatatccatcaagtcatgtctccagcatggagctccgctatgcacattgttctgtccttacctatccagagaaatgcagcacaggtgaaaaatcgatgccgttgtgagcaggacgtccagagatgtccgaacaagacaaaacacctccccataaatccagatgtcttgaaccagctcaatggcaccaaagggcatcaccagcaccgaaaccagcagatccgcaaaagcaagagatacaatgaaataatttgtttttattttcctgtgagtgaaaaagtgtaagagaggaggcagggggagggatgaagggaaaaaggggagggagaagagatcaagagaaaaaacagggaaaagggaaacaaagaaagaagaaaagaagggagggggaaagaggaaagaaaaagtcacatgcttagtgtattccgtgagattcaatttccccttctgtaacatggctgagaagacccagcgtggtccagcctctcctgacttctccagacctaccttataccaaaacctcttttttcctcccccttctggccaccctgccctaatctgagtttccctgcacatataggtcccttttgagggccaatgcagatgttctttcttccaacggttgcctggttaatcccacccacccgtcagtccttggtcgggcattctcaggaaactctcccaaggtatgccctgtgactgtagtcacagtccaccattttacactagcagactggctactgtgtactcacatttataacactggtcagaattgcgcttttgcactttatttgcatcatcattagatgtgtggatgtcttacttagagaggaactgcttcgttataccctcttatggcccagaggctctcatcccaggctgtacactagaatcacctgatgcattttaataagtattgatgctgaggtctcaccccagatcagttagttcaggcaccctggggagttaacgcctctcccctcaaagattaccagatacaatacaggatgcctgattagatttgaactttagcaataaatcactttttaaatataactatgtccaaaatactacatgagacatactaataccacacgatgatagtttttcaaagtgcttcaggtggttctaattgcagccagggttgagactgatgaagtagaagtgcaaaaaacacaggtttaatttctagatctgtcccttgtcagccacatcttccctaaaccattaataaaatggggaggttagattatatgtgctctcaacaattgtatatatagtgatcacaactataaacacatttgacaaagaaaaaaatgacaggatggaaatacactgaaatgtttacactggttgtattagagttgtaggattaattgcaatccctttttctccccttttatttttaaaatgttgttcccatgaatgttttctttcttaattacaaattctaatagaaatgttcacacccaactctctagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtaacttcaccatcagctgatgacacatatatttatcatgcgtttaatgtacaccaaaatctgaaccggtcgcttgacattttatcctggttagctcctacataagaggagtatgaggcttagagagctgaattaacaggttattttccatccaagcacttgtggctttccttcagggcatttagttcaactagcattcagacatatgtagttgatgcctgttttgtgcacctactcaactagattgcaaaagctgagtgaatgaatgatagtaactttgcaactgcaggagcagcccaatttggtccaactttgtgtataaaatggtgagttgtgttttagttgccatggacccccaggttgcaagttaaactgaccaggcccagatgaaccaagcatgcaaccacagggtggaacctaagtgcttggaccaaggcatggggaccaaataaagaagtggacgtctcatggcatgatccacgatccaatcatatagagccctagcatcaccttgtggcataatccagtcagatcatacctcttggcattaacttatcacaagatccaatcagatcacaccttattaccctctacctataaaacctgccacagcccccagctcagggggacagatttgagctttgcctcctgcttccttgccgatcaacttacaatgaagcctttttttttttcctcaaaagccagggccatagtattggcttctataaacatcagcaaggagcccactgcttgctcagtagcaacttgaactggttgttactgagcaagttactttgcattcatacagttacttggcctgaatgcaaagccatcttgttacagtgtcccattccagcccatgcagaagcttctgcttacaggtaggttctcccagagagaaaagattgtggtgtgatggttgttcttacatcagttcacctggacaaattgaattcagattctgtgaagtctgttggagagatagtagccaataaataagctcagtggctcctttcaccaccctgatcatttcttttagtgcccacaatatgtcattgttttcccagttcaaatttgtgttcttgtcaagttcagcatctgatttagtctacaaatgttgccttccccatgtaaactcagcattttgttttattaacttgaaaatgaagatcccttttcaatgaaagcatgatatctgcagattaatattcagaagctatagggattttaaaaacttttatagtataataaaatgttctttttaatgaagtttcaaagaatcttaaaactcttagaccagcggtgtccaatcttttggcttccctggtccacattggaagaagaattgtcgtgggtcacacataacatacactaacactaacaatggctgatgagctaaaaaacaaattgcaaaaaaatctcataatgtgttaagaaagtttataaattgggttgggctgcattaaaagctgtcctgggctgcctgtgccccgacaggccatgggttagacaagtttgtcctagacccaaaccccacatttgaatatgggaaaaccagggcccagaaaagaagagctgacttgtcagagcgtgctagtggctggtctgggagaggctgcttgtcctgtgagcccaccactgagaacacacagttccaaaaatcaagaattctctgtctttcctgagctcttttgactgaaaattaaggtgcatgccctctccagatggaagcagcctgcaaagtcatggctttggccttgtccagaacttctgttaagctggcacagaagacaaggggccaaagggaatgaggaaccagtctggcagcagttggagaatgagaaagtccctccattcagctgagaagtatttttataggcagattgatagattgtttatgactgaagttcagatgaaaagaaattccagatatgcttatttaaatcacccttctacacttaagttctaactatcaacagtacaaatatcagatagggaagatttaattcaatgaggaaaactgtacacttagaaaaaagaccttaataggctgatgtggccaccaaaaattcatttgatcttaggtcatgttagttgagttaaagcactaacaaaggaggtgatggtggttctcttccctgtccttcttagagactaacggcccccctgaaactcatctcttccacccccagggcctctgtatttgaggtgccttcttcctggaatgattcttcagtgacagacttcttgtcattcaggcctcagattaaatttaacccccagttagtgtaccacagccaacaaacatttttcattttctttacagcatttactgttatctgaaatgacttctgttattgttttctgtgccccaattccacagattgacttttgttatctttttcactacaatctccagtgtctggcacaatatctagtctagagtatgtattaatgtacatgaaatgctatgtattaatattacatatgtagatgatgcattacatagtaagtgctcaattacttgctgattcagtgaaagagagatatattgtgctcataatggttatatttattattcaatgtctttgaagcctggttgaaagtatagagatttcacctagagaaaagaaggcccagagatgaaatgcaaaagctacttgcagctatctgagcgctgtcatttgaaataagagtagattcacatattcattcatttaacaatttctgagcacctactctgtgttaggcattgttgtatgtcctagggaaacagcaataagcaaaacagagagaaaaacagacaataaacagatgcatgagacagtatgtaaggtgtcagctgatagtacagtccatggcaaaaaaaaatatctaggagggtaaggaggactggatggcctgtggcggattgcagactggctatttaataaaggatgtcagggaaggttcaatgataaggttatcacaggttgtgaggctaactaagaccagtgggtgaactttaagcagtggttcccagccttacctgcatatttaagttacctgaggagccttaaaaaatgctgattctgggaatccaccctcagaggtgctgatttaattggtctgagttgcagcttggatagagaaatttttaaaatctcccaagtgactctgatgtgtaatgaattagagtcactgacagggaggcaagatttagtaccagataataagagccttctaacaattaaagatgatctgcaatagcttcccggtgttgttttgtgttccctggcacagaaagtgtttaagaataccagaatggcaatgagatactaatttgcactcattaggatggcaattataaaaaataaaacaacgaataaaaaataacaagtgttggtgtgaatgtggggaaatggaaacacttgtgcattgctggcgggaatgtaaaatgctacagccactgtgaaaaacaagtttgatggtttctctaaaggttaaatatagaatgcctatgtgatcccccaattcaatcccaggggtacacccgaaagaattgaaagcagggatacaaacagacacttgtataccaacagtctatagcagcattattcacaagagcccaaaggtgaacacagcccaagtttccattaatagataagtgaataaatagaatgtggtatatacatactacaaaattttatttctctataaaaaggaataaagtttgttgttgttgttgttgttgttgtttttgagatggagttttgctcttgttgcccaggctggagtgcaatggcgcgatcttggctcactgcaacctctgcctcccgggttcaagttattcttctgcctcgggcttccaagtagctgggattacaggaatatgccaccatgcctggctaattttgtatttttagtagagacggggtttctccatgttggtcaggctggtctcgaacttctgacctcaggtgatccgcccgcctcggcctcccaaagtgctgggattacaggcatgagccaccgcgcccggccaggaatgaagttttgatacatgctaccacatggatgaaccttaaaaataaatgaaacaaataaataagtgaaataaatcacacacaaaaggagaagtattgtgattccacttacatgaggattctagactcagaaaattcatagggaaattaaatagaaaagtagttatcagggactgggagcacaggtgaatgcggagttattatttaagaattatagagtgtttggaatgatgaaaaaattctggaagtggatagttgtaatggttgcacaccactgtgaatgttctttttttagctttttattttaggtccagaggtacatgtgcaggtttgttatacagggggtttggtgtacagattatttcatcatccatataataagcattgtttgataggtagtttcttgatcctcaccctcctcccaccttccaccctcacgtaggtcccagtgtctgttgttcccttctttgtgtctgtaatgtactcagtgttcagcccccacttgtaagtaagaacatgctgaatttgattttctgttcctctgttagttttcttaggataatggcctccagctccatcgatgttgctgcaaaggacatgacctcattctcttttggggcttaatatcactaaattatatgcttaaaatgcttattttatatattaataataaattttattatttatattttagcattatataaaaaaagaattcctggatgaccacatatcaaggtactgtacagggctcctatattgggggcaggctggcctggctgttttaggtcgcttttttgtctatggactgtgatttaaacatatccttataacatgaattctccatcaacaccaccaccaccataagaataatctttcttatactgtctttactcttgtaaaagaagaaaacagattcagagcgtctgtgatgaacatctctggctccagagaaggtacattttgaaccaagtgggaatgtcagggttagagagcaccaagttcaatgtaatggttcatttgtggcatgccaattaggagttagaaatagcttaactttaaactaggagtgacgagcaaaatttaagcatagaagaagctttttaaattaggcagaactgtccattgaactaaaagtaagtccagtaatgacaattaaaataaattccaaaccacttctgcaaaattcatgttaggtccttgggttgcctctgacaccctcaagcaatcctgtcaaccacaactggacagctttcatctggctgaagagctgtccactccactaaattggttcgttgacagctattcttatgagaaattttactttctcttcttttttgctttctccgtgatcttttgatccattaataaactccacaaacttgtgggctggttttgccattttctctgctcttcatgaaagaaaatataaagacacaaattctgggtaaatttccacataggttagtatatgtgaaaatggactgtgaatgataaagtatgataaataagtgattattgttattaataatgatagagacaatagcaaaggaaatcttaggttatactttgtcacacacacacacacacacacacactctctctctctctctcatactttctggagagtcaagaacattttttgttgttatttatttatttatttttgagacagagtcttgccctgtcccccaagctggagtgcagtggcacaatctcagctcactgcaacctctgcctcctgggttcaagtgattctcctgcctcagcctcccaagtagctgggattacaggcacctgccaccacacccagctaatttttgtatttttagtagggacagggtttcgccatgtgggtcaggctggtcttaaactcctgacctcaggtgatctgcccgcctcggcctcccaacttgctgggattacaggcatgagccaccacgcccagactttattgttattttttgtgggcttttgcactggttttgttcataaacagctgtatgacttcaaaaaattcacttgacttttctgagcctcagtttcttcatggatcaattgagaaagttagattaaatttcttattcatcaaatatgtattgagtgccaactatataccaaggactgtgctgagtactagattcaatagtaaagaaaatggacaaatttcctgacctcatggggttcatagtatggatggaaacagacataagcaaatgcacaattaaataaataaatacagtttgtgatcagttcttcccagttccatttcccaaatgttaatatttatattaatccactgaggatcttgataaaacgcagattctgattttttttaggctgaggcagggtctgggattctgcagttctcacagacccctaggcattgctgatgctgctggttcctgagtcacaggtggagtagcaaagtataaaaggtgtaaacatgacattatgatagaaaacacgctggcttagagagaagtgtgaggtggttgggaaacactggaggtgacagtcaactgagttctgatgtatgcagagaatttggaagtcagaggaaccaggataagtgcattgcattcaaagggaagagcaactgcaaaagccctgagacagaaaagatttttcatgttcactatcacaggggaaatgagcaagggactgagcatctgagatgagctcagacaagtagtcggaagccagaccctgagggcttttttgtgctctagggagaagtttatgttctattggaagatcaatgagaagacacagaagtgatgtaagcagagtaatgacatgggggcaggggtgataatatgccaggggtttctgcaggagtccaggtaaaagaagatggtagttaaaagtagcatggtggctggggagatggagagaagtgggtggaataaaggttttttggggagtaaagagatagataacaaaaatagattccatgagtgagtgggaagaagcacaaataaacgccatattttagaattgcatatctgaataaatgttggtacaatttaatgagatgggtgaaacacattaagtgtgagatacctataggacattcgagtgaagacgtcaagtaggcaattggatgtatgtgtgtctggagctcagagggatgactgggcaggagatacatgcttggaattgccagcacttctatgggatttagagaactgaggaaggatgtgatcacccaagaagagggtcagggtcttgatgaacagcagtactgagatgtgcagtagagaaggtagaaccagcagaggagactgtgaaagactatccaggatgttctggggacatcagatgagagcggtattttggaagccaagaggaacatttcaagtgaatatatgtatgtataatacatatatataatatattatataatatatatattaggaatatataaatatatatattcttgatacttccctggaactacttcaagatcactcctaagaatgacaggaagcaaggaggcagggaaactagagtactttttctctttatatttttatgtatcgaactttgcaataaaattatgttagaccagagggctccaccattgcaccaatgatctccgcagtaagtgtctcctctcccacctgttaggagtgtcatgtacacaagaaatattcttgaaaatatacacagcacatccacaaaagatcccatactccctatctaagtatttttttcacccttcctgcccagccctgcacagtcttttgcaaaggaattacatttaaattaaagaaaataatgtttcattttcttaccaatcaacagttaggagaagagtacaagggcattctgacttacaagagagcctgtctaaaattgaattatttttttctagtgagaattttattaaccttaaatataaggtccctgttggtttctatactgataagagaatgaatattaaccaagagggccttaacgttccactcagcttgattaaactttagacagccttcttcctgactccaggctctgaactcccttttcttagagcatttactttagaaaatttgtaattgcaaattctttctctaacactttgagatgtaaatgaaagatactcaccagttttacaagctaggactgccattctcaagaacttttcctttccctttgaaaggaaatcatcaagaaatatagtgctcctatctctcagtctgtaggatcgaacagcctaacttaggtggacaccttgctccaagttgtaaaaccgtcccttgtcgtgaagatatgagaaagtttacttatcctttgggtaaggctaattaggtagcacattaggtaatcccttccccccactctatttcttaaaaaccctcctgtcctttgttgtagtgaagttgaagtcagattgcattctggtctctctccctattgccatagccttggaaaagaaaaaagtcatctttacctgcttaacttcatccagtgcaatttttgttttgacagtatacatcatttattacaagtacagatgttcctagacttatgatggggttacctcccagtaaacccattgtaagttgaacacattgtaaatggaaaatgcatttaatgcacctaacctatagaacattgtaacagcctagcctaccttaaatgtgctcagaaagcttacatgggcctagagttgggcaaagtcatctggcagcagactactctgtagagcgtaggttgtttaccttcgtgatcacctgactgattgagagttggagctcactgctgctgccaggctaggtaagatggtatcatacagcatattgctatcctgggaaaagatcaaaattcaatattggaaatacagtttccactgaatgcatattgcttttacaccatggtaaagtaaaaaattcttaagtcaaaccatcatgtcggggaccatctgtaattgtatgtgtgtggcttcttcattacctttattactggccatgaacaaaatctgagtttaacatataggagcgataaactcagataataatcacattgctaatatgacttatgtaaattgatttttcaaatacttctttatttaaaatagaaataacagaatccatgagtatgttgtttttccttataacaaataacctgagcaatactatgtaattgttttaaagtatatatcatttcctttaaatatatgcactctttccccctaggtttcttgagagactaaacatacaaatggacaatggccagaccatgtgtaacaataaaactccgatggacaatctctggcagccagcccagaacgatcaggacttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctcttgctttatcatgctctgaataaattgcttgtttgttctcatctgtgtggtcttcatttgtttccatattctaggtgtgttctagatgttacacttatttgaaatcctatattttgacttaagtggaaatcctttctgaggaagaaaatatttcttatgatttggcttatattactttgggttcttgtactaagttctcaggtctcccagttaacgttttttcttttcttttttcttttttacggaaagctttttttttaaaaaaaaaaaaaaaaaaaagaggaggattaaataagatagtttgcatagccttattccataatatgaagcatcagagcagtggtgcttcaaaatcaccagcaaacactaggatcatctggagggctgggttaaaacacagactgctgaacccacccacactttctaacttagtgcatcttgggtgaagaccaaaattttacatttttagcaagttcccaggtaatgctgatgtcgatgctggtcttgggaccatactttgaggaccactgacctagaaccttacaagggatgcccttaatcttaacctccattctgcctttgcaaattattttcttctgcttctcactttgaaatgtcttccttggaagtgggttgattttgacattgatgtactgaacacctaccatatggcaaacaatgcacctggaagatttttcatgttggcgaattcaatcttcataattatcattatcatgtgatgtaatatcatgatgcccccttttcagaagaggctggagctcagcatggttaagagacgtaatattttgtaactattaagtggtgaagctgggatttaaacccacatatttttattgcaagtccagtatttctcctactaaattttaaacatgcttacttagaagtgaatatatttcctttaaaaaaacacatgctaaaattttgctttttgtctagaaacttaagactcaaaatactgatgatgacagcttaatatgtgttgtaaaatgtgctggctatagaaaatggtaggagaaaaaaggaataaaccttgtaggatggaaattatatataatggagtttttatgtaattctaaaataattttatttgattttttttgaaaaccctatagacaaggacacgagggcagggaggtggttggtgcacagctggtgaaggttaggtagttttgaactgcaaacatgcagagtaaaattcttgaggcaaaatcttaatagacttttcaagaacctcaaatatcacacatactgggcatgaaacaaacttcaaagcccaaagaggatctctctgtacagagtataatggagttaaaagctgtaaggaatacaaaggatttcaggatgaaagacactgttttctgaggccatgcctgaatgtaaagccaaggcaggatagataggcaaggtgagatctacatctggagagatacccactgctgcacagcatgttaatcattaaggattcaattcttcttggaaatgaaatgccaaataatagtgctagtcaattagacctcagaggtggtctctctttaagaaaacccattttccaaaagtggaactgagtcaacagctacagagatagatttcttttctttacaagatcattttttctttatatgtgcacagtctagcgtctctggtttgtgttgaaaacattttttttttttttacacacacttgttaaggaatacactcaccaggcacagaaatgtcttcctttggggtaaaacacatgacatgttttcaatattcggctgatcatttcctcaaaattattcctgtgattatgagaaattcagcacagggaaaaaatgtggaccacatatgccctctccactttggtaaatcatttaccctaagcataagcactcaaggaaaagtggactttcccatactctgatagtaacctgctctccattcctttgcaacagatggcctctgtcactaggcccaattgccagtggatacagctctccatattttgccaggatcttggtttgctgttgccaagtactatggtttctcttcttacttctgcctctgataatgcaaaaaatcctttgcccaaaggagagatgaaacagctcaattttatgctgttgcaggagtagtcaaacaatggccattgggccgaatccagcctgctgtctgtttttgtaaataaagtcctagtggaacacagccacactcaatcatttatgtagttcctctagctgagtttacactacaaaagtagagctgagtaattacgagagagatttcatggcccgaagagaaactttactccctttatgaccctttatgaaaaagtgtcatgacccctgctcttttgtaaccagagatgtttggtctaaagaagaacatggcattaagacacaaagacctataagagcctaaaaggagcctatttactgggagtcattcattcctctggattctttcactaagtggaaagcaacacccttccggttgaccacgccagaaactgagcatcttgctcatttttttcttctcctttacctaggtcattatctactctgaggatctcttaaatcccttcacttctctccaatctgctgtcaataccctaggagagggcttcctttcatcttctcctagactatcacaaccacttttatcccactaactactttgtctttgtcttcaaattcttagtatatgagacagcttaaatttaacatgttcaaaattgaactcctgatttccctaacctcaaacctgcttcccatatgaatacatagcaaatctatttctccagttgctcaggttaaaaatttggaagccacttttaccaggtctctacctcttctacctccagtacatcagcaaatcctgatagctctaacttcataacgtttcctgatcccaaccctttaccagccattcaatgtcataccattctagttcctactacatcatgcttcacttggtgactgcaaagtcctctcaactggcatccctgcttccatcatttctcacatacaatccactcttcacccactagacagaatgagctttgaaaaatattgagattggaacatatcacttccatactcactgcccttaagatggcttgtcatctcactaggagtaaacccagaaccctcaccatgacctatgtaaatttacaaagctggccactggctgcttccatcatctcaactctcaccactctctctttcccaggctgctcccgctaaggagacttcctgacttccacactgttcccagatggtgccaatcatgcatccacctccaccatccacctctcacctgatgctaccaccatctggatctctccattcaagtgaccagagaagctcacccttcacttcattcaggtgtctgctcagattcatctctgcagagaggacttatttaaaaaagaacctcccctcactctctattctcttgacttgcattattgattttcacagctgttaccttttacgctcccacacacactagaataacttgaatgtaaaatcactgaaagcaagaacttgggctgttatattcactgaagtattttccagcacctttttggtactgttttacagtacctagcacatagtagtgctgtgaaagtacagttggttctctgtatctgtgggttccacatccgtagattcaaccaactgtgaatcataaatattctttaaaaaatagtgcctgtattgagcatgtacagactttttcttgtcattattacgtaaacaatagatataacaactatttgcatagtatttaccattgcattaggtattgttaagtaaccttgttgaagtatatgagaggatatgcttaagttaaatgcaaatactacatcattctatatcaggtacttgaacatccttagactttggtaccccaaagaggtcctgggacaaatcccctatggataccaagggacaaatgtatctgtggaatgaatgactgactgaatgaatgaatgaatgagctacttcttaattagttattctgccttggcaattactctttcccaacactctcaacactgaagtcaagatatgttcttcccccaaaagaaattagctaatttctccctcttgttcaaaatcttataatgtcttcccattgcaattttgatacaatagcacatcttgacctggtttaaactggtccctacttacctctctagctttatttctgacactgttccataaccaacactaaatgaagtgcccaaattctcactcagtgagatgaggcacgcttgttaaactccttcctctccttcccattctttacctggcaagctctcgcatgtccttcagcactcagcttaaacatcttattgtctgggaagccatcctgacctcaatattgtccctgtcgtatatgcttccattgtaccctataattatatatcatagcttttatcaccctatatttaattgttatttaaagatctgtgcctcccaaccacactaacttactgattttggtatcaacagtgcctagtataacaaatatatgttagacaagtaaactgatatacaaggtagcccttgcttgaaagaagtttaaagtagtgatcaacacaaagggatttcccccttcattcagctcaatagttctgttaatcctgtctctaaaccactcccccagacaagtgcatttgggccaccaatcctcgctttgaattacaagttatagctgttaacatcacatacaaaccactaaagagttaacaagtttctccagagaatatcagaagcctttcccacattgtactctttaggctaataatacttttaagtctattttctagtcatgtcctgggcaccgaagttgttataaagattaataaatttggcccgatgtggtggctcacgcctgtaatcccagcactttgggaggccgaggtgggtggatcataaggtcaggagttcgagaccagcctggccagtatggtgaaaccctgtctctgctaaaaatacaaaaattagccaggcatggtggcaggcacctataataccagctactcgggaggttgaggcaggagaatcacttgaacccaggaggcagaggttgcagtaagccaatatcacaccactgcactccagcctgggcaacagagtgagactccatctaaaaaaaaaaaaaaaaaagattaataaatctaaatctaaaacacttacaatgttgtttggcatgtagtgtctgttatcttaatcctagctattaatattcatcttttctgttcatttcaaatagacacaaatgacattaacactggtcctggtcttctagctcacaatgtagcaagaaactaagcctgatcaatgactgatcattatgagagcatgttgtaatttcaacagctgggggctgttgaaacgacaactataaatagcggccagagaaaagagataatgagtaagaatacactggagtttttccagacacaactggtagaaaacacaatttaatatagcagagaagaaataaaggtgctgaaactcataggagtggagatggggtttagaaggtggtaaacgaatgtgaggggcaagaatttgggaggatttgaggctggcataatcataagagaagcagggagtatccagtatcttgatgggcataaggattttgaaaagaaaggctctgcattctattccacaaccaacatgtatacactcacacctacacgccctgccatgcacccaacatataagagaagatgagggagtgaaggtgatgggagaggcaggtggagaataatggtggggttgcccaaagatagacagactgaagttcagattctctacctggattagaccctctatccactacttctcctcctgcacctggttactagtcatctctagagccaaagacagaatcatgtaaaggaggctcatttggaaaagctggctgtggcattccaacctggcaaatctaagaactgtattgcagtacttgtcaatgcatatccagatgatgcttgtgacaaatgttaaaaaagccttaaaaacattcatgctccaaaaattccaaaagaaataaatccttatagctgttcataaagatttctgtacattattactcacaaccatgttgttcataactggagaacatgaaacatctaaatgtctatatttgggtattggttacataaacaatttattaatacacagccattgaaattcaggtttaaaatatttaatgacaagggacatttctcctaaataccatccaaagttaaaagcaggtataaaacagtaaagcacaagctcaacctttgtaaaaatatgtatttatatatgggtccagatactatagtgaaagattaatttgtgaccttttttaaaaaattacaaaaatactagaagaaatgagtggttaccttcttcctccatctcaagaaaataactaagatttgtataactacaagctttgaagactccagtgtcaagcttgacagggaagcaacagagcctcttgccttcaagggatctgtggacgtggtggtgaccaggacaaagtgaaaagcaaaaggtccagcttaacggagaaagaggaagaggtccacaaaatgtctgagattgaatttaccattgagacccagcttgaggagctcacagaaaagttaactaatttagagattaaaagaaatttggcatttcgtacatctgaatgttgtagagtaacactgaaatgcaaatctggtatatgtatgtgatacacatacacatacatgcttacatatacaaacatatatatgtacaggtaaatgatacatacatggtacctaatatttatacgtatgacatacctgtatttattacatatgactccatatattaatattatctatatccaaaatggttatctctaggtgatattaatctaaaaaaatttgaattatttcttcatttttttttttactttttcccagtatttcccatcaaatgtgtattacattgctaatccacaaaaaattgtgttttttttcaaaatgcattgcctatgtctggttttgctcataacagtgccttaataattatatgaaatccgcacgtattgttcctctcaccagttattaaacttactaattggcgtacttcattttaagaagtttttaattgcaaatgtagctataaactgtggtgtggtgcttaatagatgaaattttcttagtttttgcccatccacctgaagctgctacaaagaaagaataacttcaataattttttttaaacaaagttctctccccttctgtggatgttttggagcttacaactttgtcctgaatctaaccacttctcatcagtggtgccactaatattagtgcaagccactattatctctaacttacttcttacaagtttatttcttgcaataaaatcttgtcttcaatttcctgcccttatagtctatgtgctacacaaaatctagagttatacctctgaaatcaaaggcagacaatgtatgttttccactcaaaattattcaatggcttcccagctcatgcagaatatcccaagtttctaccgagacttggtagaatataccaggatataaggaacctggtaccagctgcccctttgatctcgatttccaccagttcttctcctccctctgctccaggcacaaacacctcctctgtatttctccaatatgtcaagtgcgctctgacctgtgcgcctgttgtgttttcttcctagaatattcacttccaaatatccactaggttccctttttgtcttcacttaggtctctgctcaaaggtgtccccatcaaagagcattttcctgactattctaatgaatgtagcatactttgtcattctcagattcactatgctgctgtatttttcctgatggtatgtatctaacatattgtatatttctttgttttctagtgtctattaactgtctcccaccaatagataagtgccacgaaagcagaggctttgtcagttttcttggcccataataggtacttaacagatacaagttaagcactgaatggtgccactgaagactatgttggaaatacggttgtatcacctactactacaacatgtgattatttatccactttatccaaagtcctgccttcagatacttcaatcttctactgcaaatgaaatactctatcttttcctcaagacgttatatatgttacatccaatagagaccataagtctgtcctctccagttccattatttgtttgttttgttttcagaactcagttgaattgtttctattttaaagtttagggtttttggccacactaatccccattttttgttcttacataagcattgcaattttcattttttacactgattatttctagtttagattaccttatccctttagagaatttttttaaagtatacatagggtctgataattaattaacctataaatcaatcaactaacgaaccaatcaatatttattacttatttaccatgcttggccatggagctatagttgacagggagacagataaggtccctgtcctcatagagcaagtggtaatgaattacatattgtagaatcactcttctttttacaaattgtccatgagcttaactaaagacacacacatttataagtagccaggaaattgtaacttcaaacaataagatacaatttccaccagtcagactcaaaaaacaccaaattgccaatcttttgaattgacaagggtgtgctgaaagcatactctcaggactggttatgggaggacacattagtaaagctttttggatgctaatttggcagtatgttcgaaatttttgaatgcacatttttaacatatctattctagggaaatgccccaacacttgcttaggtgtccagagatgcatgtagaaggttgtgtgttgctatagttttttgtaaaactgaacacttggaaatggtacaaaacttcacaaatctattagtgattaattacatcatggcacactgatacccttaaaaaatactatgcaggtgttaaaaagaatgagaagggatccatatacatataataaaaagtatacagccatgcataaacaatgaaaccagggaagtagttgtagggtcaagacagacagaagagttttttttttttatcagaaggagatctgattttcatcaggaatatatctgatcagcagagagttcagtcatatttgtaatattttatatcttaagctgggtcatggacacacaggtgttcttttatgttttttctcagtaccttttgttatatctaaaatagagccattaacacaggaacagaaaaccaaatacggcatgttctcacttataagtgggaactgaacaatgagaacacatggagacagggagaggagcaacacagactggagcctgtttgggggacggggagaaggggagtatcaggaaaaatagccaatgcatgtgaggcttaatgcctatgtgatgagttgataggtgcagcaaaccaccatggcacatgtttacctatgtaacaaatctgcatgtcctgtgcatgtatcctggaacttaaaataattttttaaatgactttttaaattaaaaaaatcttattttaaatacattttattattttattgtatgtatattatatttatcttatttattattttattgtacagaagttgtgctatacttacaataaaataatataatgtatccaaaacatgagtagattaaaaaattatacatcaatatacattatatgatatcataggagtttgaataaaataaaaactgagaagaagagggagacagaaatgcatatgtatgcatacatatacacatatttaatataagtagatccagaggtcatggccataagaatgcacacccaattgttaatcataaatattttgggcagggtattgaagatgatgggagacttcttcattcagaatattactagaactttaaactacatgaatttgtatgcttatgggttacttgtttaactgaagaataaggaaagacttttccctcacctgtgaatcccatcttttgcactctggccaacacctaagtcttctcactttgcactagaaggataatgtactgctcttgccaaataggtcatacacaagagtattaatttctccaagcagctgggtgtgagcccagctccaagcagaaaacaaacaaactctctgactcaaaaagaggcttggccaaggaatgtcaggttagatataggcatatgtttgtccatttgttcattcaaccattccttcaccaacttaatcatatctagatgcactcaacagagtatttgatagtccactctatttcaggcactgagaagaggaagcaggcagtcccttccctcagggagctcagaggctactgaaggagacagacatgaatccaataactgcatatacataaaattacagctatggtggatattataaagggaggtacacaaggtaacattgaccctgatgggagaacagaaaacactttcttgaggagatgataattgagctgcaacttaaagaggaatagaagttgacagaaaaaaggcagaaaacactggggactgaggctggaaagtgcagccgtgagagctacataacttcgtccagcaactgaaaggagacaaagatcactggagtgcagagaatgaggggatgcctcatgtcagatgcggccagcaagggtcacacatcaggagggggttggaagttgtactaagtatttatgtattatcattaattcggtgattgttttaagaaggttggcactgggggtgacatgattagatttgcattttgacctatctggtgtataaaagagaagggacaagagtattttttgtgttgtttatgtgtgtgtgggtttttgtttttgtttttgttttattttgtttagggtggtcttagtaatttaaaaatattttccttgtatcgataccagtcaacctatctagaacctagttattggtggaagtggcaccatctcctaggggatgtttgagatatctttgggatactgggttgtagttatgattggggagcacaacacaaatctagaggaaggacaggtttcacattacaacatgagggacaatccctcataagaaaattatcattctacaggccacattctccatgattctagaacatcctaccagccacttgtgtaagtgaaaaatttgtttgtaattatctaatctagaacataactccttttacttataaataaaaagaatcttgcatggtaatttccatacactgaataaagggaagggtatgctttcatttggttcagaacaaatattcaccctgtcacctacatacaacatgtctgcgttagactttgttggtagttgtcgtgtccatggtggtgacttaatgtacaaatgcacatatctgactgctttattatgttctgttgtagatgagcctagcatttatacaatgaaatgtatgttattttaccaaaattactctccttttattgcttctttgtatttcagttaagacattatattgataattgttcattgtgtatagatacgttagattactcgtggatttcatttcagtattgtaaaggggtattacaagctatttgtttttaaaaagagagtagcagttgatctggggtgattgagaattactggcctagaaaaatatgactttcaagagctaggctgtttcgatagacaagacacacttcaggtgtcttgtctaaatgaatgcactggagtgttcctgatttatcagtactggatgcatgcagttaaagaagctcagagaatgtcaaaggttggagagagcagcacaggggcagaggtggcacactagttccctatcaagaaaattagaaagatctgctccagcttcaagcttttctcaaagtcctgaaggatttttaacacatcttccataaaaagctgtaatttattatctcatgaatatctaatttgacaatatttgcaaatcaagtttgtggaattttggtgtgttcatttgagtgtgtgttttgttctttctcaaaataattcttaaggtagaaatgtttctatgtgctagaaatgctgagataaaaaaattaattttgtggttagcttgaaaataaatggtgggctctaatatgcaacgtaatgtaatataatataataagggtatccccttagggttgactgtggcagctttccaagattttaggccttgtcagtttctctgctttgataataatggaataaagaacagttattctcattatctgagtgctactatatgccagaaagagtcatatctgttttttatgcattggctgatttttatcgtcacaacagcctatggttatagatattatgactatatccaatttacagatgaagcaactgaggctcagagacttgaactgatgtgcccaaggtcacatggctggtagatagtccagaacaggatatcttaatccctatgatagacaaatgtaataatattttaatttaatcaccagtggcataattatgaagataatctaacagtaaaatacataatatggaatacagatgaatagaaatgtttgcctcttaaaaaaagtctgataactcctttgagaaccaagcctgctctccttcaatgagcttgtgctctgtacttcctcagttactcactccaatgttcagtccatgagttcgtcattaccaatagttgtaactcccaacaatttcagtttaaaatatctcattcttaaaccatcatttcctgtctctagaacccttttctttagtactcttgactccagtaattctttgaccatctcaggatattcaacctattgattctaacatgttttcactgtccctcaccctcctcatgtcagaacatgacaggccacaggcaggctatggattctaaaagatatcgtgaatgctaaaagtgctggaagattaaggataccctgagaattgtcatggataatgataatccagtgatactaaaacatatctagacaattaaccagaataatgaaggtttagaattattccctgtggcacaggtagagcagctgaggaaatggagatctcattcgagagaccaaacagctcagaggttctggagcagctaattccaatctctgaacactgtcatgcagttctaaagagtgtggctggatcctagtcagggaagatactggaaggtagagttcagctcaaactaagagaaaatgaaaggtacttttcttctcatactacaactacaattcaattgtatagctgaaatgctgtattgagaaggtttctgagaatgggttctcagtcaccattgtctcagtcagattgggttagattatactctgggaacaaagaactcttaatcctcagtaatgtaaaacagcaaaggtttatttttcactcactgtacatgtctgtgtgcattgtcaggaggctctgctcatctcattccctctgtgatccagaaagatggagtggtcaccatctcaaatgttcccattttacatgctagagggaaatagaacgtggggggttaaagtgtgtgtgtcacaaactgataatgaaatgttccagcctggaagtgacttatattatatctactcaaaaactcattggccagaactagtcagaaagactcacccaactataaggaggatggggagtgcaaatctacaatgaacaacataatgagcaccagaagcagtggcatgagcagtggttgacctcctgggtctagacaaggcattctagcatttgtcttgctactcctcatccctgccctaatcaccagagctgccctgcaaagccttacaatgtagtgagctccctaacaccagagtgttgcaagcaaaagttaaaggagtgcaggttaatgacaccatagaggctattcctttatctagtagactaatggtctacctggatctacacgagtctcttaccactctgaaataaacagaactaggaattatggaatactttgctaagtgtaccagatatttggagaaaaattaccagttctcaggccagctaaacaaccaagcaatggggtgaattttgctcatttaaaacggagagaaacataggctgaccattatagtcccatcattgctccttttcccgcaggagggcaaagcacattaactctctccccagcaagagacaatgatcagaagaatcaacataaagtgagggaaaggatttttattgaaaaagctgctatagcaaagtttgtggtgctaaatatttctttataaaaaccagcacttgactatcagcctccctattcagctacagacaggacagcaaatggttgggtgagaaaatgcactgctattcacccaagactgttaggctaatcagcaatggaaaaaacatctgaaaacacctgataaaagggcaaatatgctgtaaggctctcgcgcgctctctctctctctctctcactcacacacacacgtgacagattttaaaaatcaacatctgaatgcagccttcagttgtcaaaagctttctttatgattcctatttaatccacaaaattcagggaggttagaattactattataaatgatattttcagataaataaattcagattcaaaaagattaatttgattcactttgtgtccaagtgggtctacatctgtagtacacaggaaagcaccttgaatggatgtgtgacaaaaactgacttcttaatctttcaaagctgacctcatcacaccaccactacttgctggggctggtgacagaacgtcgggcttgagggaccacagttcctgtaatatacggtgcttcttacatgctcagggaaatcatttatcattgacattctacagtaagtgaaatttccacccaccacagaattcattttatttttcatattgtcaaatgacataaaataattttctctggtttctgctgctaaaatgtccttatagtggagcttataataacccaagaggaagcaagcatgataggataactaatgagttttccacataagagtcaacctctaaacacactagaaaatcagccaaaccagctggagataaaatggctgaatggctgattgaatcatgtattcctcactggtccagttgagaagggcttctgggtacatctcctttttactttctgcctgcctttacctcttttctccccaagttaaaatcattagaggctcttctcaacctccaattttgaggctagtgtaatccttaatagaaggagaggtaagcatcccctgatcaattacaagaggtctatacctcaacacggccttcctgtgacgccagttaccctgtccaaacactgaagttgcacattggctcagaaactggattcctttctttttctgttccttatttctttctgctcaccccctcccttctccctttctttctttttaattaaatgagtaaaacatgaacacattcttattgttaacaaaattggattaggaataattactgtctggcatggccatgtgttgacagagatctggaaccattatgaactgctgtgggagcatcaccacattgacagaattttggtactacctagtaaagtagagatgtatacacctgctacccactcctaggcacagaacctaaagaaactcacacatgtacccaagatgacattattatttatggactcattttctataattgcaaaacactggaaattatctaaatattcattaatagaataatcaaaaaataaactatagtcataaaattgactgctacataggagtaaaaaagtttaaataaactaaacatatcaatattgatacatttcgcacatataatgagtttctgaaaagcaagcattctccttgaaaaccggcccaagacaaggatgccttgtctcaccactcccatgcaacataatattggaagtcctagccagagcaatcaggcaagacaaagaaataaagaacatccaaataggaagagagaaagtcaaactatctctatttgtagacaacatgattctatatctagaaaaccccacagtctcagcccaacagctccttcagctgatcaacaacttcagcaaagtttcaggatacaaaatcaatgtaaaaaatcgcgccactgcactccagcctgggcgacagagcgagactccgtctcaaaaaaaaaaaaaaaaaaaaaaacaaaatcaatgtaaaaaatcattaacattcctatataccaacaacagccacgccgagagccaaatcagaaaggctatttcattcacaattgccacaaaaagaataaaataccaggaatattacttaccatggaagtgaaagatctctgcaatgagaattacaaaacacttctcaaagaaatcagagaaggcgtaacaaatgaaaaaacatcccatgtgcgtggatagaaaaaaatcaatataaaaatggctatactgtccaaagcagtttacagattcaatgctctttctatcaaactcccaatgatattcttcacagaactagaaaaaaactattttaaaatttatatggaaccaataaagagctctaatagccaaggcaatcctaagcaaaaaacaacgaagctgaaggcatcatgttacctgacttcaaactccactacagggctacagtaaccaaaacagcatgatactggtacaaaaacaggcacctagaccaatggaatagaatagagagccctgaaataaggctgcacatctgtgaccatctgatctttgacaaagctgacaaaaataagcaatggggaaaagactccctattcaataaagggtgctgggatcactagctagccatatgcagaagattgaagctggactgctttcttgtaccacatacaaaaatcagctcaagatggattagaggcttaaatgtaaaacccaaaactataacaaacatggaagacaagctaggcaataccatcctggacaaaggaatgggcaaagatttcatgacaaagaccaaaagcaaacacaacaaaagcaaaaattgacaactgggatctaattaaacttaagagcttctgcacaacaatgacaaaaaactatcaacagagtaaacagacaacctacagaatgggagaaaataatttgcaaactatgtatctgacagaggtccaatatccaacatttaaaaggaacttaaatttacaagagaaaaacaaccctattaaaaagtgggcaaaggacagggccatccattttccaaaaaaagacatacatgttgccaacatgcatatggaaaagaagctcaatatcactgaccattagggaaatgcaaattaaaaccacaatgatatactatctcacatcagtcacaatggctattagtaaaaaatcaaaaaataacagaggctggtgaggttgcagagaaaggggaacacttgtgcactgttggtgggagtgtaaattagttcaaccattgtggaaagcagtatagtgattccgcaaagagctaaaagcagaactaccattcgacccagcaatcccattactgagtatatgcccaggcgaatataaatcattctaccataaagacacatgcacacgaatgttcattgcagcaccattcataatagcaaagacatggaatcaacctaaatgcccatcaatgacagactggataaagaaaatgtggtacatatacaccatagaatactatgcagcctatataaataataagatcacgtcttttgcaggaaaatggatggagctggaggctattatactcagcaaactaacccagcaacagaaaaccaaatactgcctgttcttacttacaagtgagagctaaatgatgagaacttatgaacacaaagaaggaaacaaaagacactggggtctacttgagggtggagggtgagaggagggaggagagcagaaaagataactattgggtgctgggtttaatttctgggtgatgaaataatctgtacaacaaactcccatgacatgagtttacctatgtaacaaaccttcacatgtacccctgaacctaaaataaaagttaaaaaaagtaaatacgtaaaataaaaaggcaagttgtcaaatgatatatgaagtatgttatttatataaaatatgaaatataaaatatactaaatatcattttgtaatacatgcttaatgtactaaaaagtattaagcaaatgcaacagaatgataagactacaaattctgggagacaattacctctgtgaggcgaagtgaggggatgcacacaaggaggggtaaactgtatttgtcgtgctttgtttcctaaactggatgatgcagatttgttctgttgtgcagtgttattttcttagtctgaactattttgcaataaattataaacactctaggaaaaaaaattcaaatatttcagtaaacttaaacctcattttgaccaccacccagcacctagtcctaggcatcctgaagagttatctactgttagttattagttcttttccactcaatataaatagcattgtttgaacaaaggtatctctttcctttttatataaacgataatctaacatgcatactttcaatgaacatcatgtcttaaccatataaatgcacttccctcttcaacaataacgaattttcctggaacttaagcattttctttttgaggcagacggtataatcgctaaaagcacagtctttagagacaaactgcctgaattcttcaaatcctggagtcaatacaatatttacccagggcaagttattttctgtgcttcgggtgtcttatctataaaactgataatcacaatacctacgtcttaggattgtttgaggattccatgagtaaagtcatgtaaaacactcagagaagtggctggaacatagtaaggccttgataaatattatttgtagctacagtctttgctataacatattggaaagggcccttacaatggtgtccttacaccaagtccaacttatggctactctagaaaaatcaggatgttcttttgcccacttctcctaattatgctgagctttggaaatcagtcatccttcagaaactctatagaacctgtagcaatgcccagtcttttgatttctgcacactaagttctatttgtccaaattccaggcattgttttcttataggagaatttcttcaagtcactcatagctgtcagtttctgccaatttaatttggcaattaaggaactgtacataagtgtttatatgtcaccgttctttctttaagttgagcctgggggcacagccaatgtttcttttttcacattcatgctaataatacgttggttgagttgcacatagcatatgtaaatttttggcaatttatttttctcatagttctcagagtttgcttcaaatttatcacatcatctacgttatacttgcagttagtctacttctcacctaatatcaaattttggatttgcgtaattccctacgttaagagagattaaaaacaaaaattttagagtcagccagacctgagttcaaatcctagctctgccatgggttaggcatgtggcccaagtaaacatattagttttctatagatagataacaatttactgcaaagttagcagtttaatataacacccattcattatctcacagtctgggcatggtgactggattctctgctcaactctaaaattaagatgtaggtagggatcactgctgatctcatctggagctcaggattcccttttcagctcacatgattgtgggcataattcactgtcttgcagttgtaggactaaagaccccattctcttgctgctgtcagctgaggtaacttgcagctccagcagcagcccacattccttgacacatggtctcctccatcttcaaagccagcaagagatttttcccacatatcaaatcactctcaaattcacatcgctgatttctgcatctctttcctctggactcagatttaaagggctcatctgattgggtctggcctacctggataattttcctattttaaggtcagctgattttggaaccttaatattacaagccaaattcctttacatcagtacctaggtgagtgttttattgaataccaaggagaaggagtatgtatgtactccagggagcaggatatcttgggggacagcttacatttttgccactcacaacaagacatattggctttgcaatcctcagctataaaatgggaacaatggtgctcactgcagagaaaaagtcaattagatacagtgaaacaaaaaaagcttccaagtactgattatgctcaggattaggctgcctgttttcattacttcattgtcccagtaatctttttcccccagttttactgagatacaactgatatgcaaaatctctacataattaatgtatacttggtgagtttgaacatgtttacactcatgtcgccatcactataatccaggaaataaatgtatccatcatgccaaaattccccctttttactctaatgagagctatcctattaaccaatgagtaagtgcactgtatcttattgttaactgcaggcactattttgtacagacctctagaacttactcatcttgtataactaacattatatctattgaataacaactcccttggtaaccatcattttattatctacttctatacctttgactgttttagatgcctcatttaaaacgaaacatacaatatttgtctttccgtgaccgacttatgtcgcttaacataatgtcttccaggtttatacatgttgccacaaatgttaggtttttcttctttttcaaggctaaataatattcaactttatgtgtttaacacattttctttgcctattcattcatctgttgatagacatttgggttattttggctactctgaatattgttgccatgaacatgggagtgcggatatctctttgagaccctgatttcaattctttgggttatatagccagaattgagattgctagatcatgtggtaattctatttttgattttttgaggaccctccatactgttttccatggcagcagtaccgttttacattttaaagggttcctgtttctccacaacctcaccaacatttgctgtctttttttttttaataatagccatcctatcaggtgtgaggtgatatctcaatgtttttgatttgcattgccctgatgattagtgatagtaagcatctcttttgtttgtcatttgtatgttttctttggagaagtgtctattcagatcttttctccatttttaaatcaggttatttgatttttttgctattgagttgtaggagttctttatatgttttggaaattaatgcattatcagaaatatggctagcaactattttctctcatttcataggtcgccttttcactctgatgtttcctttgctgttcagaagtgttttcgtttaatgtagctctacttataatttttgcttctgttgccagtttttgggtgccatatccaagaaattattactgagatcaatgacaagaagcttttcccctctgttttcttccaggcattttatggatttagatcttatgttcaaatctgtaattcattttcagttaatttttgtgtatgatgaatgacacaattttattactttggatgtggatatacagttttccccccaaaaaattattgaagagactgtccttcccttattatgtattatcagcatccttattgaagattaattgaccgtatatgtgtgggtttacttatgagcctactattctgttccattgatctatatgtctatttttatgccagtctcaaactgtgtaaattactgtagctttgtaatatattctcaaatcagaaattttggtagctccagctttgttcttactattcaaaattgtcttgactatttaaggtcttttgcagttgcatgaaaatttaagaattgttttatttataattataaaaatgtttttaagatttagctagggattacattgaatctgtaagttactgtgggtagtgtagacattttcacatagaatgtatttttgggaaaagcacacaaaatccacatttttatctaatttctttcatcagtattttataattttaagcattcaaatgagtctttcacctccttagttaggtttattcctaggtattttattctttttgatcctattgtaaatgagactgttttcttgacttttttttggatagtacattgttaaagaatagatatgcaactcactttcgtgtgttggttttgtattcttcagctatactttgtagcctgaattagtttattagttctaaccttttttatatttttagagtctttagggttttatacatataagatcatgtcattccagagtctttttttataatttcaaatttgatttaagatgcaaggggtacatgtgtgggtttgttacgtgggtatattgtgtgatgctgaggtttggggtaggattgatctcattaccctgatattgagcatattacccaatagttagtttttcaaccttgtcctccttcatccccccttcatccctccctcctctagtggtccccagtgtctattgccatcttcatgtccacaagtacccagtgtttaactgccacttagatgtgagaacatgcagttttctgttcctctgttaatttgctttggattatggcctctagcccagcagcccttttaaaatgagcccaatacagagtctcctttggtgactgatgctgattaggtctccaataattattctttatataaaagaatggtgcaattgtgaatgggagttcactcatgatttggctctctgtctgttgttggtgtataagaatacttgtgatttttgtacgttgattttgtatcctgagactttgctgaagttgcttatcagcttaaggagattttgggctgagacaacggggttttatagatatacaatcatgtcgtctgcaaacagggacaatttgacttcctcttttcctaattgaataccctttatttccttctcctgcctaattgccctggccagaacttccaacactatgttgaatagcagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctgttgagataatcatgtggtttttgtctttggttctgtttatatgctggattacatttattgatttgcatatattgaaccagccttgcatcccagggatgaagcccacttgggggaggggggagggatagcattgggagatatacctaatgctagatgatgagttagtgggtgcagcgcactagcatggcacatgtatacatatgtaactaacctgcacattgtgcacatgtaccctaaaacttaaagtataataataataataataaataaagttaatttgatattttgcagaaaaaaaaagaatgatgcaaaggctaataatactcatattttacagatgaagaaactgggacttaaagataatatctaaaagcagttatcatagttacagcctctggcaaatagaaaacactcattaatactaattgccatcatcatcatcatcatcatcatcatcatcatcatcattattatcatcattttatattaaaaagaagaaacacaaaagtgtccagtagcacctaccacacacccactcctaatctgggccatgtaaaaactgtggagatgatgagtcctttgcaaggcatttccggggagctcctgttccctgggaagctgcctggtcatttttcggctgcttttttaataccccaaggagggctgtggttgaagctctagtcctggaactgacaacaccagaatccagaatctcccagtttcttaataccaacttgatggtggaatttgcattgtctagtgcaaaatgcagcccttttaacatttacatttgatctttatcttctggttatacagattacttcatctaattttacctgttatttgttttaaagcttttcaccccatcttacccaacttttagtggagaaaggtaatactcaaaagctctctcaattcttataacagcatataaaacatttcatgctcattaaactaacacccttcattctctcattcttttcaaatgtcaatccttaagtgacataaataaggttagcaaaaccttctaagagattttagactttatctagtacaaacaccttattttactatggagaaactggagctttcccccaaaaaaggattttcttaaggtaatcagctggtggcagagccaggactagacagatggacatcaggagtccagtcacccagtgccacacaccttccaattacatgactccacttggtgcctagtttatgacctccaaagctctgcttagtgactactttcattttctctgtgtatttatatataaaaaaactcaaaggagaaattacaaagtaaaaatagctcattataacttaacagtacccctaagcaatcagacattctgtaacaattcaatggccaggctgtcctattaggtactgcagacactgataactaccttcccaatagccattctctcctacttcctaggtgacagaccccagttttgtttgggggcaccaatatgcccaactccatcaagctactctctttttcaacctccctggctgccaggagcaacaagatatagtttgggccaaggagttacaggcagaagctgagtaagcatttggggaagacttgtttttctgagtaaatgaataaagattgctggcatcacatcttcccttttcttctctttgaaccaaaattgatatctagagcaacagtagccacctggaagccatacacagagacaacaaaatggaaggctagaggtacgggtcattgatatcactggctggctgcaccagacctgaactattaattactgagtatcttttcagtaaaagaaacaataactcagaaagcaacatggtatagaacctaaaagcactgcctgggagtgacagacttgggtgtgagtcctggctagctgcctgaccttgaaaaagttacctaacttcactgaatgccagttttcccaattcacaggattgatttaaacattaaataaaagaatgcatataaaatgcttaaaatggcacattgcaagccctcagtatatggtagcctggttcaatgtaggaatctctctctgcaattatctgattattatccattgtttatccagggaatgtatgcagaattgatctcattggtcagcaaacaacatgtattacactcacaactttatatgtagattggtcatggaaggcacaaattaccaaaataaaactaatgaatattcatcaaagattgccttagaatcctagaacgctaaagctagaaagatagcttaaccttcatccaataaatatttgctgagtgccaaatatatgttcagaaccatgctagtcactgttgatatatgaatatatcattgaagtaagattcctgttctcacgggatttatcttatagtgggggcatttcctaatgtatatctaatatgaccatctcaatcacagctgaagaaactgaagcccagagatgttaaatgacttgcaggcatacctaggtcacacagcagttaatggcagatgttggagtaaaattcaagcctcttgactcctattgggttggtcttttgtctatatcctgaaattcctgatttacatttttgtataccgtcagaaagtattccttgctgtccaccaggatgactgagatagaaaatctgatccctgagtttccttcatttcctaccactctctcatttccctatgctccacgaagtatagtcttggtgtgatttcctcaaacatgtcaaacttgctccttttacaagactcttacttctggttggccttcatccctagttttatttgtatggcattcattcaccatttcagcctcagcttgagggccatttgttttgactgtcccttaaaatgtatcattatcattctctacctcactcaccatttctttcagctcatatatataaccagctgaaattaacttactaactttttttccacatgtttgttgttgggctgcatgagggcagacaccttatctgccttgctcactgctgcattccagaggccagaacaatgcctgcaaccagagctggtacccaataactacttgtcaaaagaacattgggtgatgctgttagctctagaattctaggctcctgagacaatctttgtctgataaatatttgtgagctatacttggcaatctatgttgaacaaatgaatgaataaatcctggagccattttgtatttagctttataagatactagatcctgaaaagatcctgaagcaaagttactcgaaccctttaatgtaaaacaggagtatattagtccattttcacacaaggcacttcttacatggcggcaggagacagagagagagcgaaggggaaactgccacttttaaaccatcagatcttgtgagaattccctcactatcacaagaacagcataggggaaaccacttccaggatcgcatcacctcccatcaggtccctccctcgacatgtgggggttacaattagagatgagatttgggtggggatagagccaaaccatatcaaggaggaaagtgaagttgagtacttgccttgagatctaattgactgaattaactgatgtgtagacagggcgaagttgggggtaaaatctatccatggctacctctctaaaaatctagaataatagtgaatgagatagcaactgatgatttgactatgagatggtccaacttctctcacccactcctttactctctgctgccctaatcctcttaaacctcataggatgcatgcctgaaattccatcacagattttctttttcttttatctggggctgcactctgatggccctgggcagcacagtgtttctgaaacacttgcatgtggatgcctctaggtgaggcagacactctccagctcccctgaacccccactgctccctattgtctcacctctggctgctttagaaacttatcgtacctgctggacctctggaaccacgtttgttttagggctaaagtgcaatttcttcagctgctatcaatagattacatttgaccatgagtaaatgacccagggctaattttgttgcatggaggacaatatcttgaagatatttatagtcgcatagggtatcagaggtaaaagaaatttagacatagtcttttctcacctttttcacttgagaatgaagaaacaggcttaggaaaggtagatgacttgcttaaggtcacacagcaagttagtggcagatctggtactgaaatttagacttggtgaccaaagtggtctggcacagagcaaggatgctttgaagtacttgggcggagggttgggggggtggtgaaagaaagctgggatggctggtggtggaatttagaacatcttcaagattctgcctgggctgagcccacctttctcaggcttttcctcccagtagaactctggaaggtaggatacttgctcctcccatgtaatgatacacttgtgccttcatcctccttcactaatttgtgtctgtatcttttctgtcactttatataactaattactgtttactctttccaagcagggtgtgtggggatccaaactgtgggagagaatggtgttactttggggaagcctttgcagaaacaagacagtctggaagaaagggaaactccagctgcagaattttcttctcttttcttgctgtggccccatcctcccacctggctctaggggaaagtcctatttaaaagtgagagttagtaacttagcatctttcagcagatatcacagttgcctctggcacagcctcttgcaccctcgtacttcctctcctggctgtgcctgcctcagcatggggataactgactgccctcagttttcctcaccctgctactagatttgtagctggatttggggacctctgaaggaattttaaccacatagggaagcggtatgatcaagtggaagaaatgaaaacaccaaggctcgtaagattgagatctaatcctgctctgccaccaaccagctgagtctcccctgctgaaccatcagtcagctctgtggttgcaagaccgatagacttttctcagcactggtctcatttaatctctgcaacacttgcattgttgaccaacctctttaacaatttttaaaacaatttctaattctgaaatgttccaaaaagtacagaaaatattacataatgttgagcaaacaaaccgtacaatcagacctgagcaatgattatgagaaaaagctcaggtggccaaaggttaaattctgggagggtcttagacttggggaatggagaagaaccagggggaagaaaaagcctttactgctttgctccctctccccagaagttatcactacactaaaagtcagtgtatatcattcacagtaggttttaattcttttttttttttttttttttttttgagatggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagggttttaattcttttattataaatgtataataaatatacaaatatgtgtaatatatataaataatacacaaatattatggtcaaaatatactattttaaatgtttttatgttttctgtatgtttacgtttatgtgaatgatggtatccttttgaaagctgcttttttattcaatgccattcttttgagattgtctatagtatatgtatacactgagtccatcttaatcgatactccactatatgaataacccacaatctatttttttctcctataagagatagataatttgcttctactattttgctaccacaagcaatctgcaataaacatacctgtgcacaagttcgagtttttctaggtcaaaaatctagaagggggcttgctaagttattaggtatgtattcattttaaggttcttcagaatagttataccaaaattctgctaaatacttagatgaaaattctgccgaattgctcttcaaaataattataccattgaactctcccttgaataagagtttctgtttcctgacattctgccagcccttgttgtctttgatttataaagttttgccaatatgatgagtatcaaatggcatctcattgtgctagcatttccctattttcttgtgagatcacatagcttttcatttattgtattgaccactcagttttcttcctctaggaattgtcttgtttctcattttctggttgggttgtttggtgttttctcttagtgttttgtaagaaattttatatcttggcttgtaatactttatctgttacatggtttacaaataatttctgtagttggcttttttcactttgttttgggcatattttgccatacagaagatttaattttattttcccccagctttatggagatatactttacaaaaatatataatatatatgtatttatggcatacaatatgtgatattttaatatacatacacatttttaaaaaattaaatcaatctaattaatatgccacctcacaaacatcatctttttggtgttgggaacatatgagatctactctttcagcaatttttaagtatacaatccactattattaatcgtagtcaccatgctgtctagtagaactccagaagtatttatttatcctgtctaacaaactttgtaccctttgcccaacatctctcctttccccagcactccctaatccttggcaaccaccatttcactctctgcttctatgagtttaactttcagaagctttaattttaatatagtcaaagaaaacaatatttcattgttggattacaatttttgtgttttgttgaagatgttctgcctaccataatgccatacgagaaacttctaacacccctgtaattgaaaatggtattcttcctccctcaacccaggattttagttctaccttgtttttattattctaaatgactggtattattattttcttttttcttttcttttttttttttttttttttttttttttgagacagagttttgctcttgttgcccaggctggagtgcaatggcgtgatcttggctcaccacaacctccacctcccggtttcaaggattccctgcctcagcctcccatatagctgggattataggcatgcgccaccatgcttggctaattttggatttttaatagagacggggttggtattatttttattttatttttacagaacagcagagcaaatactttctcagcgctacccacatgttcattaaatttttggggtatatcacttcttgaattatatttctactttctggtttaatttcctttttcctaaactccatccttcatacttaagtgagagactctatgtaaatgctcttagtcttgtttaaaaacgtatttgtttcaacattgatgttgaaatatttttctttatagatgatacgtagtgtacaaatattttctcccattctcccaaaaggttatctgtttattctgtgtatagtttttttttttcctgtgaagaaactcaagtttaattacataccacttgtcaatttttgcttttgttgcatttgcttttggggtctttgtcatgaaatctttgcctgttcctatgtccaggacgtattgcctggcttggcttccagggtttttacagttttgggttttacatttaagtctttaatccatattgagttgatttttgtatatggtgtaaggaaggggtccagcttcaatcttctgcgtatggctagccagttattccagcaccatttgttgaatggggagtcttttacccattgcttgtttttgtcagctttgtcaaatatcatatggtcatagatgtgcagccttatttctgggctctctattatgttccattggtccatgtgcatgtttttgtatcagtactattttgttttggttactgtagccttgtagcatagtttgaagtgagtaacattacgcctccatctttgttctttttgctaagaatttccttggctattagggctcttttttggttccatatgaattttaaaataggtttttttaatacttctataaagaattgtcattagtaatttgacagaaataacattgaatctgtaaatggctttgggcagtatagtcattttagtgatactgattcttcctatccatgagcatgagatgtttttccatttgtttgtgtcatctctgatttctttcagaagtgttttgtaattcttattgcagagatctttcacctccatggttatgtgtatttctaggtattttattctttttgtggcagttgtaaatgggattgcctttatcgcctcattaaaaagtgggcaaagaatgtgaacagacactttacaaaaggagacaaacatgctgccaacaagcatatgaacaatactcagtatcactgataattagagaaatgcaaatcaaaaccacaataagatatcatctcacaccagtcacaatagctattactaaaaagtaaaaaataacagatgctgcaaggttgcagagaaaagggaacacttatacactgctggagggagtgtaaattagttttgccattgtggaaagcagtatggtgattcttcaaagagctaaaagcagaactaccatttgacccagcaatcccattactgcagcactattcacaatagcagaagacatggaaacaactgaaatgtcatcaatggcagattagataaagaaaatgtggtacagatactccatggaatactgtgcagccacgtaaaagaatgagatcgtgtcttctgtgggaacatggataaagctggaggccattatccttagtaaactaacataggaacaaaaaatcaaataacatgttctcactgacaagtgggagctaaatgataactacttatgaatacaaagaaggaaacaacaaacactggaatctacttgagggtggagggtgagaggagggagaggacaagaaaagattactattgggtactgggcttaattactaggtgatgaaataatctgtacaacaaactcccatgccccatatgtttacctatgtaacaaaacttcacatgtacccctgaacctaaaataagagttaaaaaaagaaatttttttttactgagaatagatgcctaaactaataattatatcctctcagctctctaaggataaaagccccatgtcttctagtctgtactgttgctgaaaatttgctgttgctctgcaaataagcagactcttccctctaataatattttgtcttctatgtctttgatatcatgcagcttcaccaatatttttatatatgaatttactttcattttttctacttaggactcattgttattattatatattaatattcatgtacttcatttattctgaaaaaattccagccatcattttttgaatattgcctttccccaattcatcctatttgatttttgtgtctcatacgaaatataaactaatttattttcctctgtgccctatgtcctttaaaatttcagatattatttatctctgtactaccactttgctaatttcctcacttcagtcttttagttcattaattctgccttcaactattgtttacgtaatgttttattttcctttgacaattttaaattttgattactatgtttttctctttagaagctgtatttggctacattggtttattcttcatcataatgtctcatggctgtcttatggtttcaatttattctattgtttattaattttaaacaattatgttgtaatctctcaaactggtatgcaatctgaagtacttatagttaaaatttttctgcttttgggtcctctgattctgactcaaagcagcttttactcccatatagttttccatttttggttgtgagttcctctttcatgggacttttcctgtgagaattctggacaactttggttcagtgtgtgtcccttcagaggagtatcaagttttcttccggcaggagacctgccagggcaaatttcatgatattttcttggcttgtgagttctcagatcaatgacagtagtataaatttgaaccacacatattcattacaaaatggaacttttcatcatttgttctcaaagctactctttctctgattttgttccagtcagctaaccaagaaggaaacacagcatcatcattaatgtctcatattttcttactccctaatccaaatatgtgactcctgtggcttctatctcattactttttctgaaatgcctcaatttctctccacctttaatgtaattaacttaattctttgatctcatacctgaaataaaccttctaattactgcttctgccacaagacttaaccttccctgattcattacaccacagctgaattgatattttaaaaattcaaatctaatcctgtcattctatggcttaaaaattattactgcacctccatcactttcaaaataaaaataaaaccttgaattctaagatgaaattcaagtttattggcaatctgagctctgtttttggcttttatctcttgcaaatttctcttgaatgcctttatacaaatgaccaatgcttcaaccatactaaattttcaatgtgttcaaattcccagaatatttttatatgctagagaaatcaatgtgttgatccataaaatccagatgaaagcttctcagcatgaattattgtcacatcttttctgatgacaaaaattgttattctttattatacgtcattatactaagcatatttactatgcttcgtagtgaaagtatattaaattgtagtcagcaacaatattcttctttttaggaattgcattcatttgtttatatttcagtagcagtataacatatattcctaataatatgacagtgtatgcgtttaaacatattgtcaatgacaaatataataatagaattctcacagacaggtaaatgcttgtcttaagtgagttcttaaaggcgaactgagttgttagataatacggttagaaattataagaataaaaagttgagatcaataagttcttttctggctcataattttacaattctgggtttcgtgtgtgtgtgtgtgtgtgtgtgtgtgtaaagttacctaattgacattacagtaagtgtaattcattgggaaaagcaataaaataataaaatattatagctgaaagtgaccttaaagataatttagttcaatagtttctgaaatatgttactagccagaacattgcttccaaagaaaaattttgaaatccaacatgtgagacaggtacatgtgggcctcccctgacttcatttagagactttaatactgcagccctatgcacaagtaatccttccttctcctatctacccgcaacaccgaggttacacagaactaagtttaaaaatcactgatctaccgcaacccagtcactgttcaaatgaaaaactggaagcccagagacccaatgatgtattcaaggtcaattagccatggacaaggctggctttaaccctaatcttgtaagtctccatgaagttctatggctatgactcttattttttacaataagttcaacccaatctcagaaagccaatagaatttctcatttctcatatcccataaatagattaatgttttaatgtaacaagttttcccatgtatttactccctagaagctttgacataagaaatagttgctcattgcagaaaatttcaaaaataaagaaaaacaaacacataaaagatagaaatcttcagaaatctctgctggaagaaataaccattgttatacttttttctctgaaaacagtttttttttttttaaccaaatgggattatacaaggtgtatcagtgagcatttctaactgcaaatagcaaaatcctctttagctaatacagacagaaaagacatgtattaaaggatattaggcagttctagaatctctagcaagatcagagagtcagtgttgaagtcaatccaaccagaaaataatactcaaacattacaggacttctccagagaaaattctagcaccaccacgaccaatggacacagatgccccagctcacactctagaatgtggtgtaggcccaagatccaacaccagcccaaagtgagattctccactgcctcccaaaaattacaaaagaaattttcccatgtcatctgcttcatcccattttcctctcttcttgacgagactgatagcacccaggacacaggacacatctacccaccaggagcaaatcatgccccaaacatgagaagggtgtgcaaagatcccacaatgcaatgacataacatttgtaacaggaaaagtcttcatatatttgtgttcttttaatttatatattatattaattattggcctgacaagattgatacattgaccattatatgcaaatcatcttgccgtaagcaatttgtattgattccaaatataatgaataattcaatttatcctttcctttttcttgtcctccaaaaaagtattttaaaaatcttttccaatttaaatgatataaattataaaaatgatgcaacccatttataaggacaaaaatccataaaattttgggccgcatgaggagttagtgtagtgacacacttatttactccaatgactaataattattgcaacatcatgtttttatctctccaacttagttaaaagtatcgtacagatgatcagttgcttcagacaccaatcagcatcccacggacttccgatcaaagactgtggctgcaaatcaattgcagcatatggcgtttgtgcttctattacccagagcagtagctgaggacatagtaattaagcaaatgctaatgagaagtctaaaatattcacaaatgtatgaatgtatggattatagttatttggcaccaattttaagtaacaagcacaatctgtgtcaaaatgcacttgtgaaagtcttagtatgtgccgataatatcttactactagtctctgaatgtgtccaggaaatctatttttacaaatttaaatgttgcaattatcactacctcactaataaataatcctgattcatcttccagaagcaaacctcaaatttggttactctccaacttcaactctggataggctctcattgtttattctttaaagttcacagttcttacccaagcattcaaagctctctattaactcacctcaagcaactttttcatgtattatccccccattcccgttgtctctagctcagcgtttcccaatgctggcattttgggggctggggctggctttttttggagagctgatcagtgcatattagaatgtttcacagcatcctgacctctaaccattaaatgtcagaagcatcaccacccccttctgctgcgacaaccaaaaacatctctagacattgccaaatgtcccctggtggtggagggaggggggtgggaggtgccccagttgagaagtactgctctagcaaaactgaattactcattcttcctacacaaactctgatttttcctgcctccatgtccatctttcattcattctgcatatattttactgaacattgactctatgaaaagcactctaccaggtgctaaaagttcagtagtgaacaagatggctatggccctgactttgtgtagctaatagccttatgaaataagccagatcaagtgtaataagccaagaaggcagagagttgagtaagcagcccctgaagaggtagagtgaaaagtgctgagagcagaagcctccactcacctgagtaggacatcctttccagaactcagtgtatacaaattctacccaccccctgaagcccagctcagatgctggctttattcagccttctctgatagcttcatatagaagtaatctcctatcctctgcatagccagagcagacattctctatggtacttggcaccctgctctgtattggttattattcatggccccattattgcatacatctctgactacatgaacctcttatgtataggatgcatgtcatattcatttctgatttatccacaagaaactcagttctttacacaaaaagaaaagctaaattcacatctactacaggctccaaccagggtcttttccaaagggcagtgagggtaatgtgtttaaaatgccatacatcaccttagaacccaagttgaaacagtttctcatcactcttgggattaagaacaaagccttgaatgtagctaccaaagtccctaatgcctgtctcattcttcttcttactccttacctcttaccactgtgccctttactgtctgtgttccagccatattcactccttttcaattgcttcaaggtgccatgatctctcctaaagcagggcctttgcactgctcttttcactgcctagaatgctccccaaccactgtctagcctctgcatcgcacctttcaactgtcactttcctacatagccttatctgaccctccagccaacatgtggttttttggaaacatgttaaagaatcaatttcttttcctgcataagttatttagcctatattatatccttgcctctatgattgataaaggcttatcgccttcactatatcaccagatcagtgagaacaagtacctcctacactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacttaagtagccatcagtgaactctgagggaagattctgggattaagaggaaagagtaggaccataaaaagggtatgtgcacaggagagtcagaagaaatgaggaggagctgagggaaggacagactgatttgggggaggttggtggtaaagaaatgagacagaaaagtgatgctcagaaggccagtagttgaggccaggcacagtggctcatgcctgtaatcacagtacttcaggaggctgaggcaggcagatcacctgaggtcaggagtttgagaccagccttgtcaacatggtcaaaccccatctctactaaaaatacaaaaattagccaggtgtgatggcacacgcctgagtcccaggtactaaggagtctaaggtactaaggcaagagaaacacttgaacccgggagatggaggttgcagtgagccaagatcttaccactgcactccagcctgggtgacagagtgagactctgtctaaaaaaaaaataaaaaaagccagtagttgagatcagaaaaagtaaaatcagtgaaggttagtggtcagtaagaaagaccttcaagccatgaagtctagcactttaaaaagtgtcttggaacacagtaggtactaaataaatatttattgagtaaattctgaccaaataatcttctacttaaagtaaatctactttttagtattgtgtcagacttatttgtaattgcctgactactagccttccttccgctaacaaaattcatgttgaaagaatggctggtgagctatctggagttgtaagacacagactttaaaataactagttaacatgttcaagaaaatagacgataagatggacagaatttcacaagtagattttaaaatattttaaaatcaatgtaaattctagaattttaaaatacaattattgaaattaagtaagttaattgattaatgtaacagcaggatatgaattacaggacatagataaagagaacattaaaaaacaggaagatagtcaagtagaaaaacacactgactagataatagagataaaaaagaatggaatacaacaaaaggaaagtatagccgatagatgagatacattgaaatggtgcaaggtatatgcaattggtagtccacaagatgcagagaaggaaagggcaaaagcagagtttgaagaaatttctgaaattgctgaaacacatcaaatcacaaatcaagaaatattatgaccgcaaccaagatcaatacaaagtaaaagtaagcctaggcacaaaataaaaagaaaaatctgcttaaaactccaatgtaaatagaaaattttaaaagcagcttgggaggtggggaggaaatagacacatttcttcaaagaaaagacatctgacttttcagcagtaagtatggaagtcaaacacaatggaatgaacaattcacaatactgaaagaaaacaatactgtcaacctggacattttatatccattgaaattatccttcaaaagtgaaaaaaaatgaaaacactttaaggcaaataaaaacagaatttgtcatcatatctagtactggtaaattttaagagttctctttacgaagaaaaatgatcccagagaaaaacatgggaatgcaaacagaaatgaaaaacaatggaaagggaaaatatataagtaaattcaaattatttattactatacaaacaatatattatgttttttgcagtttaaaacatacctagatttaatatgcaaaacatctaagaaaggaaggagataaatggagtcagagtgtttccttagcattgtctgagaaatggtaaaagtaaaaagttatattaagctaataacataagcatattttaatctctataataaccattaaggaatatacttctaacaaatcaataaaggagaaaaagcaataataaaagacaaattggaatgtacttctaacaaatcaataaaggagaaaaagcaataataaaagacaaatttttagtccaaaatatggtgggaaggcttataaaataattataaaaaaggacaactagaaaataaaaattaccatactagacatacattcaaatatatttgaatgtaaatattttaaataaactcatgaaaaagaaagcattgttaactgggttccaaaagtgtgtgctgctttaataaagttagtttaaatataaggacaaataaaatatgaatatatcttcatatatatacatatataacatatatacatatataaacacatatatattatattatatattttaatatatgtatattatttatatatatatatttttttttcacacatgactgggggcctaatcagcaccagtcactaaaggaagctcttaactaggcttatttcaacaggactgatagggatgacatattcctatatgtagaaaaccctaaatactccagaaaaaaaatgttggagctaagaaaggaattcaggatacaaagtaaagtttcaaaatacaagatcaacacacaaaaagcagttgcagttttatacactagtaagaaactatccagaaaaaacaaattaagaaaacaatcccatttacaataatttcaaaagaataaaatatttagaaataaatttaaccagtgaggcaaaagatccgtacgctgacaacaaaaaccagtaatggaagaaattcgagaaggagaaatggaaaagatctttgactttagttctggcaataattttttttaggtatgacaccaaaagcagaggcgacaaaagcaaaaatgaacaagtggcattgtatgaaactaaaaagctcctccatagcaaaataaatagccaaataaatgaaaatgcaacccacagaataagagaaaatacatgcaaaccacatatttgataaacggttaatattcaaaatatatgaggaactcccacaactcaatagcaaaaaaaaaaaaaaaaaaaaaaaaaaacaaataatgcaattaaacattggctaaaggatttaaagagacatttttccaaagaagacataagaatggccaagaagcatatgaaaaggtgttcagcatcagtaatcatcaggaacatgcaaatcaaaaccacaatgagataacacctcacatcacagaattgctattattaaaaaaaataaagataagtattagcaagaatatggagaaaaggaacccctactacactggtgatggaactgtaaattggcacaagcattatggaagacagtgtagaggttcctcgaaatagtaaaaatataactaccatatgagacagcaatcctacttctgtgtatttatccaaggaattgaaatcagagtctcgaagaaatacctgcactgtcatgttcaccgcagcatttttcataatagccaagatggaaaaagctgcctaaatgtctattaatggatggataaataaagaaaatgtgataaatatatgcagtggaataacatttagcctttaaaaagagggccaggtgtggtggctcactcctgtaatcccagcactttgggaggctgagaggggtggatatcttgagctcaggagttagagaccagcctgggcaacacagtgaaaccttctctttgctaaaaacacaaaaattagctgggcacagtggcatgcatctgtagtcccagctacctgggaggctgaggtgggaggatcattggagcttggaaggcggaggttgcagtgaactaaggtggtgcggccacactccggcctgggagacacagcaagaccctatctcaataaataaataaataggaattctaccatttgtgacaagataggtggactcacaggatgttatgctaagtgaaataagccagacacagaaatacaaacactgtgtgatctcacttctatatgggatctaaatcaatcaaactcagatgtagaaagataatttttcagaagctgggggttggaaagatgaggagataatagtcaaatggtgcaaagtttcaattatacaaggtaagtaagttctggaaatctacacacagcatagtgcctacagctagaaatactccattatatacttaaaatttgctaagagagtagctcttatgttaagtgttcttaccacaaaataataataataataaatcgggttggggaaaagtttgggaggtaaaggtcgtgtctatggccttgagtgtggtgatggtttcacgggtgtatacttactcccacactcatcaagttatggaccataaacatatacagctttttacatgtcaatgatacctcaataaagtagtttaaaaaataactggggaattttttaatatttggaaattatgcaatatccttctaaataaaccatgggtcacagaagaaatcaaaatgggaattttaaaatgtttcaaactaggtgataattaaattatgatgtgttaatatttatgggatgcagataaggcaaggcttagtgggaaatttataaccttaaatgtatacgttataagaaaaattgttaagaatataattttttcaaaacagcttaaattacataaataatcaactaagaagctagaaattgaaaagcaaattaatcccaaaaaatagaatgaaggaaatagaaaaggctaagcagatgttaattaaattaaaaccaacaacacagaaaataagcaatgccaatacttgattccttgaaaagagtaattcaattgaccctagacaggcttattaaaaaatgtttaaagagagaaataaggcacaagttatcagtatctggaatgacaaatggcacataccagagattctacaaacatcacaaaagtaataaacatgtaagcaactgaatatccataaatttaaaatttagatgaaatggagaaattcccagaaaatcataatttaccaaatgtactcaataagaaaaacaaaatctgtaagtaaaagcctttctacaaaatcttcaggcccagataacttactggtgaattcttccaaacacttaagaaataaataacaccaacttacacaaaaacttttaaagaaaaaagggcagaatgaccttgataccaaaatccaaaagggcattacaagaaggataaatatatgcatatttatctcataaatattgatctaaaaattgtaagcaaaacatgaacaaattgaataaaaccgcatctaaagcaacaaataatagttatttcatcattgtgaggttagtttaacaaatataaatcaatgcaattctccatgttaataaaggagaatattcataccaccacctcaaaaaaagcatttgaaaaaatgttataattacgatttacaaagaaaaaactcagcaaactaaggatagagggaaatttttgtaatcccaaagaacaccttataaagatattttacacaaaatactatacttaatagggaaatgctaaaagctttttcataatatcaaaaatgggcaaagatgtccactttcactacttctattcaacagtgtgctggaggtcctagccagtatgatgaggtaagaaaacaaagtacaaagtttgaaatgaaagaagcaaaactgccattatttacaaaacgcatggctctatacatgaaaaatttcaaataatctgaaaacaaagtgttagcattaataaactaatttagaaaatatactagatacaaggttaatttccaaattaattttattttgacataacatcaacaaataattagtaagttaaattgaaagtgatgccatttatagacatacagtaacacatgaaatgtcctaaactacaggaaataagatagggtgatattggtataagagttgactaacaaaccaaagggacaaataggatttggaaatagccccacccgtaatcatcacggacttaagatacagagtgcagtggagaaaaaagacttttcaatgaatggccctaggtcaatctgatatctatatatatatttaaaaactcatcataacccttaccatataccatgtaaaaactcaaattcaaatgaatcataaatctaaatgtgaaagataaagtaatatagtttctagagaaaaacttatgggttttctcttcacgaccttgaggtaaccaaagatttcttaaataagatgcaaaaaggcactaaccataatagaaaccattgataaattagactacattttgaagagcttctgttaatcaaaagtcaccttcaaaagagtgggagaatatatttgcaacatgcgtatctgaaaaataaatggctttattcagaatacagaaagaggtcataacaatatgaagagaagcaatcaattcaacagtaaaatgaacaaaagacttgaacaaaatcttcataaaaaaaaagatatcaataccagcatttgccaggatggggagaatttagatctcttatactgttgctggaaaactgagagtatcttgcaaagctgaatatacacatagcctgtgatctaagcaaacctgctactaactcaatgtacagtagaaatgggtacacatatgcaagaaaaataaaaagcaaaaaaacttgtatagcactcagtgtaagagtgtaaaaatcaaaacaattcaaaggtccactattaaaatgaactttaaaactgtgttgcattcatccaatggaatagttagccatgaaaatgaattaatcacttttgcaagcaatgaaatggataaatctcaaagatataatgatgaatgaaagaggccagacactaaacaatatagaatgtatgattcaatgtatatgaaattcagaactgatatatggtaattacctttgcagggtagaggtagggactaagcacttcaggtattggaaatgttattatttcttgacacagttgttccaataaaaacatttttttcaccacctacctggaccagtggggtaggaacacagtggagaagatggctggctacctatatactaaatgagataataaagggaaaacattttgtacactgtaagccactacgtaaaataaggtatctctgtatacctattgcatttgatggctcagacagtataggaactgactgctatatctcacataagcacagtacagctcgtgttggctcagctggtaccagggtcaactggaagcagggatgctactgtggccgggacattcccctgcttggtctcttgggtctctgcttttttcagtatgttcaattctttctatgttaccacagattgcattttcttttcttttcttttctttttttttttttttttttgagatggagtctcactcttgtcgcccaggctagagtgcaatggcgtgatctcggctcactgcaacctccgcctcccaggttcaagcgattctcctgcctcagtctcccaagtagctgggattacaggtgtctgccaccacacccggctaatttttgtatttttgtagagatggggtttcaccatgttggccaggctggtctcgaactcctgacctcaggtgatccacccgcctcggcctctgaaactgctgggattacaggtgtcagccaccatgcccggcctcacagattgcattttcatgaggaaagcatgctctagatcttcacgttccgcagttactacctatattgaaggacagagcgggccagggatccccttcaggacaaattatctatggccctgaagtcaggatcatgtaacagatttttatcaccattgtatagatgaagaaactaaatgtttctgtgatttaaaaaaaaaaaaaatcggaaaacaaatcaacccagactgttacagctgagatctttaaacctacagagtgtagcagtctcttctttctgaatggcctgtacaacacttggtatattaactgctaccaagaagcatgcaaaatctttgatgcggattaattaacacaactcaattctacagatcctactatatgtcaggatctgtgctatgcttagtgggggataatttgataaataaggcatggccattgccctctgggtctcagaatctggtagaagagaagttcaacagataaatgattttaatatatatggaattttaaaaaatattcaaaatacaaacagaaagaaactaacagattaatttggaattgcagagactggagggaaaaaggagtgtagagcaggtgtcctttcaaatgaatttgaaatatgagaagtactttgaaaggcagtgatagggaatgaggacattattgggaaagggtagaaaatgagcaaaattagagctgagagaatgcaggaaggatttgaggaactgtagtttacatgatacagctaggacacctggcatacaggcaggtgtaaatatgaggtataacaagactgcagataggctgacacacttggaatgtcaatgtgagaaatctgaattttcatgtgaacacagttgaaggtgttaatgcaacatcacattggtttcaaaaaaaaatggagctatgtacatatttaaattgtatttactagctctctgaccttaggcaagtggcttaactccaccaaaactgactccttagatgaggtaatagtgcatgtagaacatttagcactattatatattcagtatataatatgtgctttgtaaatgttagctgccattattattgtttctatgaaggagagagaatcatacatattcaactctgtatgatggttaaaaaccagcttctgagttattttaaattttatttagatttacgtttgtgatgctgtggcttaaatccatacaaaatatttggtgataggtcccattgttctttgatatataaaataggtctataactgatttgtcacttctatgaattagcctcctgtcaaaaataacactttattggaagttgtctgcaacatttaaaagatttggattctttaccgtgaaacagcaatgtttcaaatcactataggtacaaggtttaattggtaattgttttatgtccctctaacttaagcaatattactgtagattatttctggagataaaggcaatccttttttcagttaaaccttaatcataatggtggaagtaaaaaggtattgtggggaagcactggctttggcattggcttgatctaggtaagagtcttaattctattccttcctctttgtcttcagagaaattgtttaacttcccaggaacccaattcctcacttgtaaaatgagataaagatatttatgttcttaacacaatgcttagacacatgataattccttcttttccatgctcccagatcacagcacaagtactgcttaggggggaaaaatgtagtgggcacagactggaccagagttcagatacttcggtcaaaaagttgagatacttttcaagcttcaatgttggcctagcctgcccatgctgtgattcgggcagcagtgatgcatgctgtacagggctcatgaattgactgaagatacttgaaggaaataaaattagtcattttttatgggtctttgttgtttttatacccatcctcccaacatcatttccactttcttttcctaagaaggccccaactcaactttgatgagcctctccattcccacttgcagttcaagtgccctgggtgggcaccatgtgcctccagagatggagcatgtgacccagtcccagccaattggagcactaagtttctctgaccacagtaattagttcatcacaggaaacatgatccaagttggtccaatcataagaataaagagatatgtgtagtagctatcagaatattctatttttctgtctgtcccactggatttcaatagttggagcctaaaacataaatgtcccatggactaagccccacaatactcactggctagagtttttagggaagtcaactttagggaagtcaaaatggagaaaccatgaaagttatttatttatactttcaaatttaatttggcaatgtcgtatactgccaaatcattgatccctagagaatcccaatcagaatactggagggcgacggctaagatgaggaatggtgcaggagcttagaaccttgctctggactatctaactgcaactgtaaacttaggcggaatgaactataccccaaatctatccaaaaatacattcttgtctggatgaagagctggtttatcaagcgataactaaggctactttggagccaacagtgtaaaccgtgcttactttcacattcactcaacaaatatttattgagtgtataccgttctaagaaactgggtaaaataagcagtgcctgccttcatgtatcttaaagtcttgcaggggaaacaaacaaacaggcaattatcatataatatcataaatattataatgagaagagtatataaaatattaaggggacattttagagaagcagctaatctaggctttggtggtccacaaaagcttctgagagattgtgccataactagccaaatgaagtggtgaagaagaatgctctcagtagcaagagaatgccatttatggaaaaatggaagtaatgcattagaactggaatacgggccgtaaagtagaaagtggtatgatacaatatagatggaacaggggccaaatcacaaaagcctttaacagccatgttaaaaagtctggattttaatcaattgaaagcaatggggaactactgaaggcttttaagcagaaaagcagcataacaagattgacattttagaagcatcactccaaatgcagcatgcagaatggattggagggagacaagagaagaacatttctattagccccttagtgtgaccaacaaggaggatattgcagtaacccaggtgagagatgatactgttctaaatcaagccattgtcagagagatgtaaaagaatttcagagggattaaggaggtcgaagcagtagggtttattattttattggttctgaagcttgcctgatcttcggccatcaactcccagatggccagtcaggatgctacatattctatcaggagtgttaatagaagagattcttacaacagacaagggactggttcatctcacttaggatccttttcaagtttgcagtactttgattctgtgctgaagatagggaataagaatgaataattacttaattaatgatttattgaatgataggagtggggaccccctcgttgcctaaaaattggtaagatattggaaataaaaagaaagcactacttataatggcattgcattgcacacacagctaacctattctgagagagaaagagaggacccaattgaatattaccggcaattttgttcagtgttccactgattgatcacatgcccccaaataaacatgagacaagagctgggtatcttctcttccttcagtcaactcagttcccactgtccttcactggggacaaactctggcattcttcttctaattctggtgatcaaggatatgaatttttgaattttcaaacatcatggctccccaaaatataaggcaaatacttattacagttctcaagataatgtgttccaatactagaaaaatggtgatgtggatttattgagaaagggcatattaggccccacttttgtataatgtgcttgtgtataaggaatttttaagggtttttttttttttttgagactccgcccaggctggagtgcagtggcgcgatctaggctcactgcacgctctgcctccagggttcatgccattctcctgcctcagcctcccgagtagctgggactacaggcgcccaccaccatgcccggctaattttttgcattttttagtagagacggggtttcaccgtgttagccaggatgttcgcaatctcctgaactcgtgatccacccacctcagcctcccaaagtactgggattacaggcgtgagccaccacgcccggcccatgagccactgtgcccagctggtatttttttttaactgtgaaaattcaccttaaatattaatcttagaaacttttgagtgagatttgactccagagaagaataaattaatggaaattacactatcccagaagttgcagaacttgaaaatacaaattttataagttccagaaggatcattggaagccagggcatttcagaacaattctaatatgatgttgtccttccaataaaacattgctcatcacaactatctgagaaaaagagtgagtggaggccttcttcagccctcatagtcttgtggatagaaagctcctaaaggtggtggaggagccaagatggccaaataggaacagctccggtctacagctcccagcctgagcgacacagaagatgcgtgatttctgcatttccatctgagctttgaagagagcagtggttctcccagtacgcagctggagatctgagaacgggcagactgcctcctcaagtgggtccctgacccgtgacccccgagcagcctaactgggaggcaccctccagcaggggcacactgacacctcacactgcagggtactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagtgcctctcctcctccaaaggaacgcagctcctcaccagcaacggaacaaagctggacggagaatgactttgatgagctgagagaagaaggctttagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactatgtgaagaatgcagaagcctcaggagccgatgcgatcaactggaagaaagggtatcagcaatggaagatgaaatgaatgaaatgaagcaagaaggaaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttactctcaaagggaagcccatcagactaacagcggatctgtcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatgtaaaggaacaaccggtaccagccactgcaaaatcatgccaaaatgtaaagaccatcgagactaggaagaaactgcatcaactaacgagcaaaatcaccagctaacatcataatgacaggatcaaattcacacataacactattaactttaaatgtaaatggactaaatgctccaattaaaagacacagactggcaaattgggtaaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactattctaaatatatatgcacccaatacaggagcacccagattcataaagcaagtcctgagtgacctacaaagagacttagactcccacgcattaataatgggagaatttaacaccccactgtcaacattagacagatcaacgagacagaaagtcaacaaggatacccaggaattaaactcagctctgcaccaagcggacctaatagacatctacagaactctccaccacaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaacgagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgatatcaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaattaataaatgtaatccagcatataaacagagccaaagacaaaaaccacatgattatctcaatagatgcaggaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcacaagacagggttgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatataccaacaacagacaaacagagagccaaaccatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattctatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacttgagaaaaacaagcaatggggaaggattccctatttaataaatggtgctgggaaaactggctagccatatgtagaaagctgaaactggatcccttccttacaccttatacaaaaattaattcaaggtggattaaagacttaaacgttagacctaaaaccataaaaaccctagaagaaaacctaggcattaccattcaggacataggcatgtgcaaggacttcatgtctaagacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaattcaaacaaatttacaagaaaaagcaaacaaccccatcaaaaagtgggcaaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcagcattattcacaatagcaaagacttggaaccaacccaaatgtccaacattgatagactggattaagcaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaacatcacactctggggactgttgtggggtggggggaggggggagggatagcattgggagatatacctaatgctagatgacgagttagtgggtgtagcacaccagcatggcacatgtatacgtatgtaactaacctgcacaatgtgcacatgtaccctaaaacttaaagtataataattaaaaaaataaagaaagaaagaaagaaataaaataaaataaaataaaataaaataaaataaagctcctaaaggtatgttaagtggttaagtttctggatcctcttcttgcagactgctcaggtaaaatgctgattcaggactttcacttgtcaatcaatttctccagcgggagccaaaatacttttttgaaaaatgttgtcctgtctaaattgacccagatgctgtgatttaatctgcaactggaagatacagttcgggcagtctctttttccctttggtttccataagctttctctccttttctatttttcaatataaaataaaggacaagactttacagtgattaagaagcacacatagtaattccacaaatgttgctaggcaacaagggccacgtattagctcaatgaatggattctgggcatctgcacgaaggagaaatatgaggagcttgtgagtgaactgtcttgataaccacaagggttagtgctttttgacacacatgctgttggatatgcctgagaaagggaaaaggcacacttattttaaacctttctgatggtttatttttccaaaatgtgtttagaattctctttgatggaaatttgacacagtgtgttataatgatcattatctcaagcgggaaagtaggtaaaaatggcctgtttctatttctctagttcagggctgcacctatagcctgagttattttaacatcttccctcctgatcctaataggcatgctttttccccctcccataccagtccattcactcagctgataaattacaagggcatgttctatctgctagtgagcaactcctctcccttgtgatcagtatttaccctcttcagttgctgtgataatataatattattgactctaagaagtctgctttattttgttcctattacaaagcaatacatgatcattaacaaaaaagcagaaaaatatagacacatgaatgaacattagtatctgtgttcatcttcaccagaaagaataatataatataaattaaggcaatgtaaataccttggtgcatatcattctagatttttttctgtacatacacagacagatttttttcttctatcacccatataaaaaagttataacttaccttataaactccacaatagccaacatagtttttaatgacttctgcactacaccaggatcatttaagtattttaatgaaacttggaagagtaattaacagggtaaatgatcagctattagataactctactaatcttattgcattttcctgttaatcacctaaacccaaccatagttagctttattaattacagaatcttatatcattatttcctttccattttgatatggtttggatatttgtcccctctaaatcttatgttgaactataatcctcattgtcggaggtaggacctggtaggaggtggctggatcatgaggatagatttctcataaatggtttaatgccatgtttgtgctgttctcacaatagtgagtgatttctcacgagatctggttgtttacaagtgtgtggtccttcccacttccctctctcttgctcctgctttggtgcctgcttctgcttcaccttctgccatgagtaaaggcaccctggggtgccaggcagatgctagtgccttgcttgtacagactacccaaccatgagccaactaaacctcttttgtttataaattacccaatctcaggtatttacagcaatgcaagcacagcctaacacacacttcttataatattaccctagtcaagtctctctcttttgtttttttttgttttttttgagatggagtcttgccctgtcacacaggctagaatgcagtggcgcgatcctggctcactgcaacccccacctcccaggttcaagtgattctcctgcctcaacctcctgagtagctgggattacaggtgcacgccaccacacccagctaatttttgtatttttagtaaagagagggtttcaccatgttggccaggctggtctcaaactcctgactttgtgatctgcctgtctcggcctctcaaagtgctgggattacaggcatgagccacggcgcccagcctaacctagtcaagtctcttacctggttcttacagtaatgaattaatcaggactctggtttcaaatttcagaaacttcaactcaaagggactcaagcaaaaggcaaagtatggctgcgatgctaaaagttgcagtaggagaggctagctgaatgcatagtggaagtcacagactcaagtaagtcagcaaggcttagcttcactcccactgtctctcagcaattccctcttcggcaacagcttcattcctgggccagctctctccaaaacgtgaggagatggccatcagcatctctaggcttctatgttctcaagaactctaggggaaaaacagtcctctgatttagtcccaggagtcactctgattgtacccttctgaaccaatcactgtagccaggggtcaggtgctctgagtggggccagacctggagaacatgcccactctgaagcctgatgacacagttcaccccacccaaaactcaagaacccaagagtcaaggagcagtcattccccaaaagcaaaatcagggttctatccgcaaggatactgtgcagtcaaaagcagcaaccaacttttcctgtgtgttccatctactctttctgatccattctacactcttctccaaccaggctcagcttatggaccgtatcaaccagcttctttccctctggcttcaattgggcttactcaacaggatgcattagcaggagagtgaaatcaccatatttcttcatctcctgccttggtgggttacaggttggcagcagctgtgttcctgatctctttgtgggatctgataataactctctcccctcggcccttcaggcacaaggatgataacagctcactgctgtgctaagctccaaggtattccaccatcctttgttgattttaaccttgcacacacctttaactcatttgtgcctgctttccctttcctatgggacctcctatcaggctgctcaacctatcactgttccttcatgtcaaccacaaatttggttagccgttaaagtcttcattcaagaaatggatgtgaatatttaaagttcaaagctaagggccactgtcaatttaatccaaattgcctgttattatgacctaggctttggtgaccacagaagtatactgaggattgtgacacatacagccgattccaatcactttcattttgggttgatttagtagggtatatctggaatatattctgtgaaggttatattttagtggagatgatcttgattctctaggaggattgaaaagaaagtgaatgaagaaaggaaagaagaaagtaagaaaagaattgagggaggaaagaaggaagagagagaaaaaagaaaaaggacctaggaataaggagttttgatcttggagtaaagaaaccttagaattcagtccagctttgtttttgaccattgtaggtggccttgggacatctttccttttcaccggacctctctctcctggcttgtaaacactaggattgggccagaccatttttaaggtcccttccagttttaataatctatgaagttctaatgaactacaattaatgatgcttgcaagaaaaaaatgcccttacaaacactgcctgttcaaagaaaattaagatactttattaaattagataaatatatttttttctgaccaagaaagcaaaatctttttgaaaactaggcaatcatttaagttaattatggaatgaaaacccaaggtagtgcctgccctcaattcaaaacaaacttgtttttgttcagattcttgctacagaccaaattttatgtacagacaacgtggggctatcaatagggatctgcagtgaagcccaaggaaaacactaatgaagccagcaggagcccacacagcctagccatcgacacaatgcaaaattgaaaacacgactgaaaatccacagaggaggatgtccccacacttctttgtgtgtgatttgcctggtccagccaagattgtagaagctgtaggaggaagataaaaaaatttttaaaaaagaaagggccaaagcaggaaatgagctgtaacttgacagagtcacaaaagaaaacagaaaagcatgaaacatatcaggtccaaagaaggaatttggaaaatatagcctgtttattttgaaatgaggcaattgataatataaaaaaggataccaaaataaattaaaagctctgaggtattttatgctaaaaatactcattataaatagccagggtacaagaacagacaatagacaagccgagtttgagaaactaaatgtgttgatattttaggggaaaagaggtaatgtaagcaaaagagagactccatccttgagggctggatgttcacctggggcaaggtcagacaagggcagagcacctgcaccagacccagtgagagcttcacagcctcgacaaagaaggtaggagaaaagggaagaaaagtcagaggttgaaccatctgtgctgacaaaatggttttaagttgcttgccaagaaactgatcagtctgtaatggcagccttaaacattgtgttgaaaaggaaggtgaagtcatagcagaaccaggcacaggaataaagaatgatagattggcagtgtttccagtggggatggcagtaggaagggaaggtggtgacccacttgagtaatttgctgaccttggaatgtatgttctagaactatactgtccgatatggtagccactagccacgtttagttatttaacacctgtaatgtggctggacagaattcagctgggctgtaagtggaaaatgcacaatggattttgaaaactaagtacaaaaatatatactactttaataatttgcatattgattataggcagaaataatactttagatatgttaagttaaattgaataaattattaaaattggcttcacccatctctttttgcttatttttaacatagttgttacaaaatttaaaatcacatatgtggctagcatctgtggtctgcattatatttctattggacaacctgctctgtaaagtcccttttctgtctctccaggcttctgtgatatgatgatattcaggaagccttgacttagccctcactatcttctccatctcaagcagagccttgtctcagactaaccaaaaggaaaccacattgagactcaacagatgctgtaaccacacaactcacacccacgtgagaatatacacttacttagaagaacagtcactgccacctcctcacgtgtacaccccattcatcacatatgtacacaagcatatttgtatgtgtcagaaaaatatccataaataggaaaggaatattagcagaatcattgtcacagtgaaaattacatttcaactgtaattatttgtttgagttagggagactcattagtgcttgttaataagaaaaggttctttgaaattcaagaatatttaacttcatgtcttccaattcctaacaagaaatcaatttactgagaggggattccagaatcatgcttctatgtataaccaagacatcagggctgcccacgcatgacagagagtcaaaagtaagctttggccttgacataaaaacctccagtgtgatcgccaaccagcacaattggattctactctcttagctgtcttctctggacttctgctcttttccaaccctatgagccacctggtcttccagtcctgtcttccactagaatctaccacctagcacacctagcagtacctgccagttgcatcaaactcctggtccagactctgctagtcagtccatggtagcatagagagaccaattctaacgactgttttgaggctgtggtccagcaagtttgtgttcttgaacttttcaattaggtgagctagtaaattctcactgttgctgaagccactttgaatttagtttatcttgcttaaaactgtaaaaatcctaacagcactcttcaaatatttgaagagcgattccatggataatctattttttctgtacttcaaggggtggcttctagtgaagtctctcctgatgatgtactttcaccctgaaatttccttttcatttatccttttcaaaaaatggtctacaggtcatgattatcatttttagaacttgccttggtgatctggtccatccataataaagggaattcaaaggtcatttcaatacttcattctgagttactgacaatactcaacatcaagtcattcttgctgcttatttggatcccagctctgggctcttggcttctgtgtggatcctgagacccagatgccaatttgcattccagctttgaccggtatccaaatgcatcctgatgtttctgactgcctcttgtaataattgctccaaaccccagtggcttcaggatcaggagtctgtctacctgatcattcctcccaatctaagaactgcaaatgggtccctagtacattttgagaaacttctgtaagtaaactaagcatcttctctgtggtttaaaattgtcaacttccagattactcattgctatggtctaaatattaccatttactggatttgcctgatgctaactgtgtgttataaaactgctttgtggactaatctttcctcatgtacctgttatgtttctctgtaaccagccctatcctgatgggtaactttgtcttcaaatcccagccacatctcaccaaactttacttaacctttccacatgtcccaacctacaagaaacactgtataaaaccaccatgcctctctaccaatagtttatcatattgtgatgtcattcttgtcaggctgatatccttctgatactcctgtgtttacttactgacacatggatagtaagaaaacattgaacttaagcaaaacttacagattcaaaacttggttctgttatttactagcggtgtgtctttaagtgcaaaagaaaatatcttttatacctctcaaattttcattttccttatctataagttgggttaatgatacttgcccttattttgctagatattgtgagacttagataacaatgtatgtgaaagcacgttgtaaattttttgaaggactatataaataaatcattaatataaggttttattactagccagaattgttatctcacactcctttttaaccacaaacagccatacatattattaatagttggtgaatatttgtcatttcataaatatgtacgcaagtacccctaaaaacctatttgtaaagcaaaatggaaatgtatgtccaatgaactaagtgagggagggactagggggataaagctgttgaggaaaaagaaggggtagaaaatatgagttgtaaatgtgaatgagaaaaagagtgttgggcagagtgcaaatgcaagagagaaagagaaacagggaagacaaggcaagtagaatgcaatacaggagaggaagaggaggaaaagacagcagggaatgagaaaagacaacagaacagaaaaggcaccagacattcctaaaccacaattacctgcttggaaaatgttcagagactgcaatggaagcaagctccttgcccccaggtccttcaggaaaaatgggcctttgaacttatcttaaggaaatcttaggcagcccagtgaggaaaaccggtagccaaggcctctccacagagacagacaatgcctgctctgtgggaagagacaagagatggggacaaaaattggacaaatgaaatactcggatgtttaacaacagcacagaaaatgaggggagtaaaggggcagaggatgagcttaacatcctgtaaaacaaaacctgttgtcagacctattaaaatattgcataatttgacacgatctcactgttgttgcttttcttcactgatatatgtaataatctgggtttagttgactgctaagtcaaatttaaccaattatctggacatacttaaaaacaggacaggaattttcaagcccaagcagagttgctgctttctaggatcctgaagtgggaatggaattctgatacacaggagggacttcaaccctcttttggagtgttcccgtgctaacgttctaggtcctcagctgatgtcagtcacctctgaggatggcaaaaataaataaataaataaataaagaggtaacagcaactgcagatttctgattagagatgagaaagaattcctagagaatgagtcagtcaaagagaaacagaaaggttattaaaagggcgttccccctcccggattttcttggagggttcctgaatcacagagcacatggcctcacctatctgggatgatatagacgttccttcttagagtgggctatttgtattgctgactcagtgacctaaggtacggtcagctttagcacagcacctggaacaaagaaagtcttaggggtttatggttatcgtagtagagacagtagaaataaaatgaatagtaacagctgcagtagtagtagcagcacttgtagaagaggagtaatgctgatcttaggaattggtgtaataataccagtatctgtaaattctacaaatagctgtaatgtggtagtcagggatctgagcactgcaataagacctcctaggtttggctggttggttccatcccttactattagttgtataaatttgggcaagctaattaacttttctgcacctcaatatgaaatgcagataataagagcaccccttcatagagtggtcatatggagcgcatgagaaaatacttgtgaagagttgagctcagcacttacactcattgagcattcagtgcctgttagctagtagtagcagggatggtggtgagggtggcagcctgagcaagggaatagatcccacctaagggatacaaaataaaaggcatgttgtccctgtcattagcaatcacatgccaggaaatctgcaaacagcaccacaggagaagccttttcaacctcaaatagagaacttgtgttcttttcactctcccgtctcttctccaaatcccgtagcctcagattccaggctgcaagtgaaattcagtgtgttgtgggtgaagtttcaggggcatagagtggagatgggtaatggttattaatatccactgggcacaaaactttctatgatgggccttcaatgatgtggagatattgcctaaagagttaaaaaataaaataaaggctttatcaatgttttttaaattcttccaacattataagatgtcagactaaataccaggcatacgaagtccagcagaggaggcaggcatgttaaaccactaattacaaacaacaatgacaattataaataattgataacagcaatttgtatagagaggtctgggagcatagaggggaggtcaggaggcttgggggtcaggagatgataaatgacttcatactttgaggtgcaagtaggaaattggtgaaagaaagaggggacatgaaggctgggattaggctatagaaagatggccagtcgtctggctgaaaaatgaattggagttagggagtcaaaaaggtgtttggagatgatgccaatcatgcagaaaagaggtgaagccttaagacagcaatgacaggaagggtagagagagggtggcagagtcaaggttacataattctaaataaaacactgctaaaattaagctggtataaaaagggtactagttattattttcagagtaaaacctcatcagttcaacataattggatagaagcatgtcaaaattaatcaaatatgatttgtagctttaaaaaatacatgactaatagcttaggaatttttgactagatgagatattttaaatacttttcaacttccccactcttaattagaagcatcaatgttcctgcaaacaaaatgaggttcttagaagtaaagttctttttgtttgtttgtttggggtttttttgtttgtttttttagacagagtcttgccttgtcgccaggctggagtgcagcggcatgatctctgctcactgcaacctctgcctcccgggttcaagcgattcgcctgccccagcctcctgagtagctgggaccacaggtgcacgccataacacccagctaatttttgtatttttagtagagatggggtttcaccatgttggccaggatggtcttgatctcttgacctcgtgatccacccaccttggcctcccaaagtgctgggattacaggtgtgagccaccgcgcctggctgcaaagcctttttttttttttgaagtggatcgaacccttttgttttttcattttgttcacacagatgcacttcatgaattccaaggctggtctctactcatagcctattcccctcttactagtgtagaaagtcacaaccctcaggcttgactgtccagagaactggtctgagtctctcagtcatagaagactggttggctgatatgccccaccctcagttaggggtgtcatctgggtgattctaggccatcagtaatgcaaccaaagaaaataacatttgaagttacaaatagaaatcagacacaatttttctgattctcaggactctgtggcgtgactcaatttgttttgcaaaacttctgtcagtggtgcgatgataaaattcagttcaattcaaggacaagccatcagaacattccctttcagggaggggattttatcttatcctctactaaagtactaaattagttgaaactcttaattatcatagcttgtctaaaagtcacactaactcaatgcactatttattttccaaatacctgcacatttcttacatcataaccctaatgagtcataaagaatgtatttactatgaaaaatattagactcgattctcacatgttgactagaaatgaaaatacaaagaaaataagtcagtatgtcccactttaccaatgaatacacaacaggtgatttgctctcataagcttcctgagttcagatcagaaaggtgacagttttaacctttggatacttcctaattatgcaaaatgcttgtagtccttgcaaatgagagaataaaatgatccctttggtcagaagaaggcagagcttccacaaaaaggtagttttctggatgttaatatttggagagaggtttaccttttggtggtctagaaattgggagtcaatttattttatatttaattgaccatagagcagatatgattagaatcctccccaaaatatttcccaactgagattcacactaagttagccagctttctatagacatttttttacctgaatgttccacagttatctccatctcaatcaacatcaaactaagtcctcattccctatgcaccacacttcttctccaaggtcactttaaaaacatcttcctcttcctcctcatgcaattcatcatgatctaccggaaatgctacttcataaatttctctaggatctgtgttttttcctttactctcactctgttcttcctcctggtccttatcctgcctcccctggactactgtcaccgtttcctcaggcccctcctcttgtcaaccctgtaaccctatttgcattcagtgtcagtcatgcttcctacatgcctaacagaacttttctgtcttccgtgcagactgatagatcgtatttctgaacttccatatttagttgtctacagtgcctctgtattttctattaccaacattttttgaatgctaagaagtttgtcgatttttttaacatttaaaaaatgactctaatgtatccatttccacatacgctttttctggcattcatcttttgaggatttgaactgcagtaattacatacaatgaacagtggtggcatttgagataaggtgaggctagaaacgtcagttacactgttgatagagaaagttgagaataaatacgcatctatatttgatatgcacaaaggtatgattagtattgaacattcaaagatgagtatgttgtataaaaccttttgaaattaaatgaagtcattacaagctaaggagtaagtgagtgggcagagaagggggaaaaaagattcttcttacattctttaaaaatgcaaataagaacattgcctgaacattattacctgactgataaaatggtaatcacttagcagatatttatttagaaatctgttccaattgaaaaaatgtctgaaatttaacacaaccctatttgctaaatggtaataaaacagaattcctgggagaaaatagcaggtactaaaagtcataatatggttctacaaagttgaggataatttttaccactgttttcaaaatgtaagtgataaggtggaaagccctccagggccaggcaggcagattgcacactgaacaactgtacgctgtggctatgaaaggtaatgtgatagttcaagatggcttcctttcagacaacagggactcacagttacgactctggtaaattccagagtgcccagcttccctaaaaggattttaatccatttttaaaaccctggacaggccaaatgaacatatctgctaggccttcagtttgagaacccaagtctaaaatatcaaatgatagaccttttgccacatagaaatctttagaaaagcaaaccattgaagttcaaaggataggctctgatatcacaaaaatttgggtgaaaatactagcttcacctctttctagaaatgtgcctttgggcaaaataatgattcttctctgcctcggttacttcatatgtaatgctggggccactatcagtgagatcagataggtcacatgtttggagaaatgtctgaaccatagcaagtccttcttatcaaatgttcaaggcatcaaacaacagtgatttgatattttccttttattgtcgaaatccattttcatagatattgtcatggttgagtgacattttaatctaaattatatataccttaggagatagtttgtctttggagagttgggagataatttgaaaaaatcagtgattccggaagcaaagacttggattttagtctcaggttaatcacttattagctgtgtaggctgaggaaaaatcacttaatcctctgaaactctttttatttcttttgtaaataaagatatttatttctttatttacaaaaattgtgctttgtaggactgcaagaagctacaagtcataggcaaggctccaaattatagaaaggagcttctaagaaattgtaaataattcacagcttcaatcacgtttcttgaatctcatcacagcctgtgcttgcaaagtgagacaaaaagacacagtcttacaggaatccaagtgacccttccatctagaccatgctgtaatcctattaggtacagaggtaattctgactgggcttgagctgagagtcataaagatcttgcaattttttttttaattaggcaatatctctacccttgccaagctatttgcatccgctgatttgcacaagtcctaataaactatgtaaaaaatctcattaaaatgtgacatttaaataaagattggtaataaaagaagcaaactgcagggaggaataacaaggtgtcataagaaaagaagccagatacaccagggttgactgagcaacagacccagaacgatgcaggtcaataataattctgagaacatgtaactgttgatactaaaattcatcataacactaccctctgtgtgttccagggaacaagattaggtctgagaatttgaaatgctacaatgcttgcttctgaaatacttctatctcaagcaattttagtatggggcccactttgatcaagcatgacatggaaggcatactcttctcacttcacaggtgaaatgatgtggattttcattatcaaggagcttctgctttactaaagtccagggggaagctttgaggcctacagactgctcatttagcaggctgtaattcaaagtatgcctcagtggaactgatagagctggaggctgcagaggttcagcttggcaagcaaaacaaagtcaggacacttgggagcacccctttcagtaataaccaaattctctaaaacaggtggacaaggtaaactgcacaaaagactgagcttcctgcagtcaagcagattgagactcagatgcttatattaatgccgtcacatctgcaccctcaggtttctgaagccgggtgaagcagcctccacagcagtaagttccagaagaaaccaagcttatatagtggggaagctgtatctgttatttgccacagtttttatgcacttatatcaatcaatgagagccagaagcctgaaaactatatttttcagactttcttgcccactggcttcaggttatgttttccaaatgagagattcaacatggaaatttgggcgatgaggtgagaaagaggagtatatttcttctctatttggaggtgctttaagcagtaagagcaacagcaaatggttccagaaatgtggcaatggttgtgcctccagcagacccataacagcaaggaggatcatgaggcttcttgacctctttaacatctccttctccctgctctgccatggagctctgtgacctgcactaaatctccgtttgcttaaaatatatacaacagtttccattttcctgcctggacactgacaaatacaatagcagaaagaaataagtcaggggtattttcttgtaaacaggggtcaccaatcaagggaatgattgcatataaaggagagctggctgtatggaatccagcacaagaccaggagtcaaagagacacaagatcttaacccagatgctccaattcccaaacagaactgtgtccaagtccatggaagctgcagagaaaagagaaaatggtgctaaataggtatagaagaccagtggtttcattccaactaagccacttattagctccaatattgaaggttttctgtcatctttgggagcctttgtttcctcaccagagaatgggtacagtcagggataaatattcaaacaatttaataactgatcattaaggtcaaccaggtaagtagatggatactaaattgaaacaatcaagaaacttatagcttatagtaattaattatcagtttttgggtaataaatatctacctctcatgatactcgtgatgactaaagacacatttatcatttactctatgcatactatgtgcaaaatactatgttaagaattttacctatgtttttctgaagattacctgtaatcttaagaaaaatcccattttcagacaccaaaactgaaggctcagagagattacataaattcttcaaagtaatacagccagtaaatgggaaagtcaagacttgaacttatattattctgtttccataaaccctacttttccagcatcccatggtgttggtagttgaagttctgttaggaacgcttcagaagatgtataggatcacgtatatgtagaagattactagcttaattccataaccagaaaatttcacacattgcaagaggccattgctttcaaaatataaatgtatcttcttccttctagtagtttgtgatgcctctagcttgaggttccccataaccccaagtggcacaggggttttcaacacaagatgagtcccagctcatattcactgtattcctgatctaatcaaagtactaactgaatagtcaccattttgtcagtcaagcagtgaagttgagtattattctcatttacatttctaaagcaacataaaaataaccccttttaaatggtacccactcactttctccttatatgctaacgaatgtcacaatttccgagcctgaagagagatttcctgcaaaacacctaaatgccttaaagttgcacatgttcacaattctgactgccaggttacaaacatgaattgactccagttccaaatcaattccacatcgataagtctttagggcaaacaactaacacacattgattttttaaattctataaattatttcaaggctttagaatattcagcattaaaaattaccatttcatttcaggctttagtgaagcataatgtgtatttttaccagtattaatcaaccccaaaatcaacttttctgtttaaaaaatttctatctttttctgtttgctaagattggaaaatttcaattcattcttgtagttacattgatatccaatacatttaatttcttgatctaaagtaatgaattgtgacttggtgtcatgacagaattaaggcaactaggtaattaatttgaagccaactactcactttgttatggtttttaattaatgttgttgcatgtgtatagcaggagactgcttttatataaatattatgtattttatatttaaattattcaacttttggtatttactcagattttctgtgttgtgtataaaagcttgccagtttgatcttcagttaaaaaatatttagtggctccctagtaccgtcatcaagcctaccaaaggaatcaaaaagaaagattctttccctggaaaattcttctttcttggatttctttctcactttcctccttcttcctttacatccttaaagtggcttacaaaaatgatcaatacattatttaaaaagcaaaggaaacaagacgaagcgattaaaagggttggaaaatatagtaaaggcttgttagagccattgtacacacctagagatcttctacacttattagtggtgattataaatttgtctctcagtttcctagaaaccctagcaaagggcggaaaatgctaccatttatatgattcataatcctataagatgcttttctggttgctaatgagaaacattaataagaaagcacaacagtcatttcgtggagaagaagccgatccttaaatgaggttgttcttattaaagaaggaagaagccccagggactgcagggtcagtgaagcaagaggatagagagctcatggggcagggaggtgagtcaagggtaggcagaagctaccgttaaaaagaaccaagacataaaataaactttttctctgctcaaagcctggaggcattgtcttgagaaacctccaagtgcaagtttatatacaaatggactttccttcacctgtttatctcctgtctgaacattgtactctctggaacttaaaaagaaattgattgaaaaaatttcttagaaagcagaaactttcaaattataataaacagccagaaaaaagagacagaaacctgaactgcatttagcgatcacacttgaactgaggaaaaccacgtgtcagccgggagaatctggtagttaaacaacatcaaaagcatagctgtttctgaagtcaggcattaagtgttttagggctgaattaagtagggtgaggcaccagcaaggctcattccccaaatacaagccaaagatgttctacagggtatctgctgcaaaatcatcaaagccagtgtttccatttttctttcttcaacccttcaaaaaaaaatgcagctgcctcctccggagccttgaggaggaaaaaacagaccaataaaacagatcaggtgggtgtcagattgtctggaaagagctgcctgttgactgctaagttggctgacactatttaccaagggacaggactcatcaggaacttgcctccccaaccagggcctgattcactgccagcttttcatcatgattcaatccatcctgcatcaactgctttctctgctatggagactcttaagaggaaaatgcttataatgcttctcatattgctaaaatcaagacctagtatgacttttcttaattttaccttatagttcacagagaacatagcgcattgtatgtatcttactattagaattcttttttttttattatactttaagttttagggtacatgtgcacaatgtgcaggttagttacatatgtatacatgtgccatgctggtgtgcgcacccattaactcatcatctagcattaggtatatctcctaatgctatccctcccccctcccccaaccccacaacagtccccagactgtgatgttccccttcctgtgtccatgtgttctcattgttcaattcccatctatgagtgagaacatgcggtgtttggttttcttttatcaccgtattaaatactttagttcagtgattgtcatctagctacacagtgagatccttaagcccaggaaattgtctccctctttctgacacaaagtgtaggtgcttaattattttatagtaaagaaataaaggcaatctactgacaatttcttcctgtggttggccatgattgcattttctaactttcctggaactcccaaagttcttttttatgtctaatcctggtcctccagcatttttcatagtaattctttgagcttgtacactgtaactactcccaaattacctttgattatgttagccagagttagtttctgatgtttttagtcaaggatgctgacagacacattgtagcaaggaccaagctgaattagaaaactcaattaaatgacgccaaacaaacaaaaatgaagtgagcagtatggccggacaaaacacttaactgtaagacattttatttaatagaaaatgtcaactaggaccactctgtctcttgacatctggggaaaattgactggagcccctcaattctagagcttgtggaagtctaaagccttctctgagatttctgaaatctctctagggcatttgcagtctcctgccatcctgttccttttgggtgtccattctcacataggcatcctctcttccaaaccccatttaccaacacaggaatgtcagacatctcagcaatgtatacatagacccacacacaaacattcacatgcacatatgtattgaaataaaatatcatataaaagaaggcaatgcagttttatgaccttgaacaagttattcaacctccttatgtctcagttgacacacatggtaaaatagggataataatgatatggagcttgtaggactgctttaaaaattaaatgggataatactagtttatagcccatgctgagctcacacattcaacaaaagaaacattcaacatgaattcatagccaagctagaaaattttcctgaaggactgagtcctcggagaagtcagcacacacattaaagaaaaaaaacaaaaagatatgcaactgtactctcaaagtcccttacaactaatgttttgccccttcccaaacagagcccagattctccttctctgaatcatgtctcctccaaactcctcccttttccattcattttcttctatcttcagagcaagtaaaaggattcttttcctgggctagaaacccaggcttttcaattctcaccttatgtaggcacttttccaagtggggacatcccttatcaaagaagaatttctggttcatgcttttaaaataataaaatttcttcttgctaattacacctagaaaaagggtgtctagactttagtcatttgcataatacccttgtgatttttttaacattcccttattaattaatataaaaatgcataatatttttaaaaataaacctacatttacattttaaataaattaatcatataaggaaatatttttcactattataagtggcaaaatattattactcatcctaaggaggtaacctcaaaataaacatttgattttaaaataaaaatattgttggcataccacctaaattcattatgtattcctaacaattcatgcatcacaatttggtaaatgtgagcctaaaaacatcttttattatggacattcaaaggctgtactgagaggacatgagggaaagtctgtggcatttgcctgttattaatattgtggatagagagggggagtgggtgaggagaaacatatgttgatgggatctggttagaaaactgacagagaagatggtccagagacaagattctggggcgtgatatcatcttgtatcctgcactattgttccacagcacccaggagaatggctaatgtccatttaatcaaattgtattctgctgttagaatctaatgctgctataaataaatgtttaaaagctagaaatgttacagctcataatatctgaattattcccccaaaagtacattttaaccaactgatccagtttgatacagtgtctgaaatttaaaacaatattataatgtgtcaccattgatattgctcactctggccttttaattaacaaaaataaaattgagattctctgcatttcactctgctttctctgggcaaataatttcacaaactttagaggaaaattaaagacctggcaccaggtctggcaccagcctaaataatctatgttaatgtcctaagactctgaaccaagtcagtacatctgggaaataacaaagtccacacacttttattgagagtgtaaaatgttttattgctaaaaatacagtctctttgtatatctatatgtattagaacacaaccttatttgaaatatatatattacaacaatgacaaactgatcaacatctctttattaaatacccaccatgtaccagggattttgccagggatcatgaaacacattctaccctcaagaaattccctggttggggtgacagtacatcttggcaactcaagtcatattacactagagtttctgtcaagatatttgacagctccttttgtgatagttttctactatgtcaaatgcagaggcacaaggcccctgatctatacctgaaatatacttttctagaggtctcaagtgaatgaaaaacagttcttgtgattacagcaagaatgtattttttaggatgtattccagctactgatatctatggataattctcagcctcaaatgccaattcataacattgaggccttattgaatacacttttctttgtactatttgattgtgccaaataaagcaatcttttcgaaaagaaaatcttccctaggagtcagactactatttcatctccaaggcttgcagaaaattacaggaaaacaaatcaaaacgaaacaaaaaccatttagctttatgtaactataccatgcaaccattatgtcacataatataataacctagttgagaaaagaagtggacaaactagaacctgctataaaaagcaacgtgaatttgtctcaagtttagatatacagatagatattcttaagctatttttacccctacttaaatacatctttcttcctattacagagatgaatatctattttcaaacatcatctccataatgcagacttttagtataggaagctggaaatgtttacagtcatattacgtttttcatttaaacagaaatgacaaaacactaataatcaaacagtactgtgaacatgattatatatgaaacatcaaagaaaatccacatccattaactttataactctacaacaacagatttttagagtcttcatagcagaaatgttctcagtttacaacacaatatgtacagaaaggtaacatacctcacattagcatcaagtttgtccattacaggaaataagcatgagtgagttggatttcaatgcccacagggtc

SEQ ID NO: 1245 - DNA, 160426 bp, Homo sapiens
tacatccaatgaatttatttgataacttcagtgtacaaaaacctgtgttgggcactaagaaaaaaaaatgagcaataagaattggccacagtcctcaaggagctcaaaatctggtaggagagatcaaaaagaacgtaattaatgaaccacactgaaaagcatatcaaaatgtcacaggagaagaacaaataaaatgtttggggattggaataggtcaaaaacctcatgcagtcctggaggctggaaaagacttcaggtaggaggtggtatttgaaatacactatgtaagaggtgccaggggaatcatgcccagtggaaagaacggcaggagtagtagctgaatgtgcaaatccgaagagttgagcatattctggaagaaaaactctaacagtggacttacagaaagtattggtaggctatgaggagtccttgagggattttgattggggaaatggcatgctgaaacttatgttttagagcctaattccccaatccagatgaaagataatgtcagttgtagaaaggatgatgtcagtaaggatagagataaggaaatgcatgagaaagtctactgattacatagccagattgatttccactcatttctgataaaataatttttatcaagaatcactttctggctggccaataattggcttttccttccaattagatgctatttggaactagctaaattgaaatcaatgaagacctactgtataaatgcatctttgtttgcagacagccaaaactccacggagaaacaaaggggcaaaggggaaaagtgcacaagaagagaatccatccatttcaaggattgttcttgctgctaacaagaacgggcctcaggtggatcaagtccccttagatttggtggaacctgggctccatttccagctgcaggtaatttctgcatccttggaaaaattccacattaacttctctgacgtacagcctggttttctgatccctgtgataggaaaatgatacttaccttaacagggttaaatgaggtgtctcatgtaaaatgctttcaccaaggctgacatgtagtaactggtaaatggcaccaaagctactgaattatgatcagcctttacttatttctctgatcccatctcctaccacttttttttcgcattaattaggctgtactggctatgtcaagcacattcctgccctagtgcatttgtatttgcttttcccttcgcctgacttgatattccctcagatcaaatatatgcctgactccttagaatgcttgtcccctgtcacagagctcacctcctccatctaaccttccctaactacttcatctaaaacacccccttgcccatctctattttttattctctttatagcacatatcagtatctaaacttgccttattcatgtacatgtgtctccttgtttattttctagtttctgacaagagagagtagagaccttgtccggtttctttattagtagacttctggcaagagaccctgcctcatagtcggtgttcagaaaatctctttttctctgaatgccatagtgctgttgagagaattaaactatagcaaatagaaatcacctagcgcacagtaagtgctaaatcaatactagtctcttccccttaaatgaatctagagatgctccaacatggaactaggcgatttgtaaagaaatcaagaaagaggacattctcccaagggtaggttagtttggaggtggattctgcaggaggttctggggtctggtagcaggtacttcacagccggtgaaggcttaggtcttcattctaggaaggaagtttcaggagacagtgtgctttctgaatggaggaagagattttctaacggggaggtgtgattctgaggaaatgattgtcacctggaaaaaatagttcatggcagtattatgaacaccgcctcagaaaagctaaggacaggaggtaaacaagcaccagcacagagggtattccctggtccagcgattgggctttaggctcccaagaacattccatccagggcatagattataataaccagagatgggagatccagacctacctattccccgtcctgcttgaatcttttatgtgatggaattccaggtagatttgtgtatgaagaaaggattctgatgtgtaaacctaattcttgtccacccctggcattttatatgtgagaagataggtcccaagaggtaaacaaaagagctaagtctattttactctggacattactctgtctcctgactgctgacagggttcattccattgttccacactcagaagagatgggacctagatttcatcacacataacctgggcctaaaggagatgaactccaggctcttggatggctcgtgacatgccccctccagttttttttttctaaaggcttcagcagggatgcacatgcttaacctcaatccaagacctccagatatacattgtcacactgccttaaatgcctcctcgtggtttgtgctctgagagtagctggacaggatccccatcctctgctcattaggtgaccatgtcatagaggtttgtcttattgctggaggccttgatgaaggtgacagacaggcagacaggtagaatctggtaaaatcacattatctaggggcccggggctactagctttcctttgagaggaacctggtactggagtcagaaaattctctagcttcaaacgacatagctactggagaatgccctgggatcttggaggttaccgagaagctccacaagactgaggcatgggagttgactttggcattttattgcatattcaaaattcagttattagttttcagacgcatttttccttgaatatataatttatataaacatgtacagaatgcactcatataaacatatgtataatttatcaataaatataatttatcaattaaaaaatctatgtaggctccaattttttccataacacatttctgggaactgcatcaaaaagtagatgatcataaagccaaagatgctttccatgtaaacaaagttagaatcaaggattctaggaccttcaaagccttagcttcaaataaatcatagctataactaacaatctcataaaccaaaaacacaaccatcattacaatttgtaatcctttgaaattagagaattaagtttcatgttctatgtggtgggcacacatgtactttatatgttgatcacacaagggatctcagtgcattataaactgtataagtggcccctttgtaattctactttattaaaaatgtaaataaaattaagttgttagctaaaatagcattaaaccacaattaacaatcatatacatagactatcagatcaggaaaattttcaaaagttatcaggttcaatatcttagttgactctttatgtagtattcatgctatctggtcatagtctggtccacgtttgatttttttcataggatttgtatatatataatttatagcatggggatgattttgatggtccaagtattttcttcttcaaatacattttttcatagtgaacaaacatttgaatcttattccatgttactttgaagttatatgagaagttacgctcattattatcaaaattagcctgtagtcccttactttgtgaataaccaaatccttttaaatgagtttctgtgattcataaattcgtgtgttgggcaacctgaaatgaccaaattaggatgggtggatttggaagaattaatatccaaagggtgcttctacaattcctagaattttatttatttgtttatttagtgagatggagtctcactctattgcccaggctgaagtgcagtggtgcaatctcagcttaatgcagcctctgcctcatggatttaagcaattctcctgcctcagtctcccaagtagttgggactacaggcagatgccaccatactcggctaatttttgtagctttagtagagatcaaatttcaccatgttggccaggctcgaactcctgacctcaagtgattctcccacctgggcctcccaaagtgctgggaatacaggaagaattaatacccaaggggtgctcctagaatattatttttttaacaaggctctggtttggcatttaccttcctgcgaactttgccctgggcatttctttctctgtttctttatcaacatagaaacttactctcttaagttggtttacctcccggtaaataaattcatagtcctcgagtgctcaggcacatccacagtaatccaaaacgcccaaagtaatgataaatatgtggaatggcattttatgatttacagaatgttttcacaaaaaaattatcttatatctccacaacaactttgtgaagtaggcaagagagattctctctgaggtctgagacattcaggaattagttcaatttgcttaataagtcagcaatggacccagtgcacgtgctgcctctgtgctgtactcctcccaccaatgtgctcatgcaggcaatgggtgggtgtgtgggcagccacagcagattggttgggtctcatcatcaggtccagagccatggagcccagaagctggctgctcccttcttcatattagaaaagcacctcaaaatggtgcttgcctcctaatggtggttgctgagcctagtgatggcaggggaacaatgacttgaaaaatcaaaggggattggtccagccacagagtcagagtcagggtgtaagttagaatttaaataaactttcttcatatgtgacaagaatggttccctggttcaatctgcttcattgatcagggagaatcccagtctacacaaagagcatttcagcatggagagatatttctcacgaattctgaatagcatttctctttcagaggctattttccttccctaaaacatgactttctccccaacagaattaagtcttcataggacagagaggcttttttttttctttttctttttggcatttggatggtttggtcaatcttctcttccttattccaaagtttcttcctgtcggtttcagttccagaactaaagtaaacaacaatggaaacaataactgacaccttataagcaataagaaaaaaagagaatatgataaataatcctgagatgctattaaaccacagccaagatcaaagtcagaatctcacatggctctgggtttggcatttaccttcccgggacttctgctatggggcattcgcaagagccactgactcagctttgaataaaagacatccagattaatctgaaggacaaagctggaaaggtcaggggtctaaaaggcccaaatgaggagggtcgttcctttgaaacaaagccaaaaggcaggcaggccatggcttctcgaggtagcagacggctatagcagcatactgttgtcttagaaacagaaagaaaacttaaaggtcctctagtccaagcttgagtgcacagatgtggaaagtggggtccagagatgaaagaacactattcaagatctcacagcttgtttgcagcacagccagggcggcaatttgggtcctctggcttcaagtacagcattgcctcggcatccccagtgctgctggatcctgccctcctgcaccttgggggagctgcaggggaaaatgagtttccccagtgtgaacttccaacagttatctcctttggcagcaacaaagccagattgaagggtttcaaaatgatatcacaagttcatgggaaagatcctgaagcctaataaacacctacgatgttgctagccctgcccaaggctttttagaagacgtcccgttctagcccagcaggagagcgagcatctcagggcagacacgccagcggccaggacaccaggaggaagctatctgtcttcagcttccctccagagttgctgtggagaccattttcctctgacagatctctgaccctgtgtcttccatggaaaataaatggagcatgtcctgaagaggaggacagacattggacataaggaagagcaagtggacgtctgggactgacaagggggccaaccaagaggatgcacgtttggacccagacacagggagaaaagtgtgttagcgtctggcacagaacagggcgaagaagaggcaggggatagcttgaacatggctgtgacggacgtgaccaagcaagtaagcaagacaggagcgacgcctctggctaagacaggaacagagagggagtattttgttgatatctggaagcccacacagcaaagaaggcgtatttggagacatcagtgaccgagataggacgcagcaagctatcgtgcttagaacgtgagtgagacagatcagacacagtgagtgacgggaacatgtcagagacaccagagaccacgcggcaaaagcagagaatctgggaagagggagtgttgggaaataaaaagtgaacaaggaggccattatgtcccctgactccctccagcgccacctgctggaatctcagaggaaaagcccagcgagcaccgggttcctgcactggcggacggaaagcctcaggtgaagagaataccgggtgcagtcgcgcacaagcagcagcttaggacctggccctctttcggaggcatggctgtcttctgggtcattgtcccaggggcctaagtgtcactgggctgagcagccaccaaaggagaagttgctggcgggtgacactgactctcccactggccaccacactccactgcatccctagagagaggagaagattacagaacctcagaattggaaaggatgttgcagatcatctcctgaaagagcccacctgcatggcaggaacactctgtgccatgcagatgagtagctatttggcttctacttaggaatttccattgacaggccagtccatattaatttttggcaataataactattagaaatagcccattaatgttcagccaaaatcggtgtccatatggcttctacctgatggacctattacgcctatcaggccccctcaacattgtgccctctaccgattatatcctccaagttttctctactccaagctacacattccgattttctttaatagttcattatatattatagtttccagattattccccataatgggcactgtcctttgaacacctctcttgaattatggtactaggaaagtgcacaaattttcgcagggagcctgacttacatcatgtgcttttcatcatcaattgggtttatttctattaatgtagtcaaattcagttcatttctaaaaatggtaataagttattggcgtatattgagcttgctgccaactttgatcgtttttgatacaacaactgtcaattcctgaggttctttattacattgctgcctagttgattttattatttatttatttatttatttatttatttatttatttatttatttgagccaaaatataaaccatcacattttactcagttaaactttgttatatcggtttggtatcactttagtcagctgagatcattctaaatcatagcaattttaacattcaagatatgattatttagcacccactcaaactagaccttaagttttttgcaagcacataggaagatcaaataatctacaatggtagatatttcagtttagtgtcatctgccttttagtttttcaggcaaggtaaaaaatgttgagcaagataaaacagagaatcatagttaccccaagacaggcttccttgcagtcaaacatctaatgctcaatgtgcctgagaatggacccgctctggcaggctttgtccaataccttgctaaaatgtctctgtcaaacagaaaatctgtcctagcagataaagaaattatttggcatgaattattatacaacagtgaatcttacttacacaagctatgagtctatggtttctggagattagctttagtgtttcttgaaaaattggggcaatatttactatctccaggcttccacctattccccagtcctagaagaagttcattcggacttgttagcaacaagttttttttaagcccctgagatatgacacatcttggctcagagagagttaaatgctttccatcaatcctggacagcaactttctccctaaaatgttctcttctttccagttggaagtctattcttattatagcagaatatgcaagatttcttccctaaataatgaaatctaactatttctgggttagatctgaacatagctctgaacatagcttttgttcatccttgattcatccttggttatatgttccttcctccagattttccacatgccattttaaagtgtaaactctctagataactcaagatgtgccctcaggcctttacatactcccttacatttttatctgtctgattcattgaatatatctatttagagaaaaaacaatgaatgaaaaagaaggaatgaaggttaaaaaggaaggaaggagagaaggaagaaagggaaggaggaaggaaggaagaaggaaaggaaggaaagaaggaagggaaagagggagagagggaagaaagaaaataagaatttctcatctctcattggccaaatcccctttgtatcatatttgttattattgtcattattagcaacgataaaaacaaccacctattagtgcagcactggtgtgccaggcattgggctgaatgcagtatgtgccttaattcatgtattacacccatttaacaggcaaggaaactgagcttcagggagcataagtaatttgcccaagtatacacagttaataaatgacagggtcagaccttacatttaagtcatttttgacaccagcacctgtgctagtaactgttctactgtattgtcattcatcattttgacaactaccactatggatacagtatttaggtctcgctgtctctagcatttctttgtcccactatggcagactcctgggtgaaatgaatatgtagaggggtgcatgttataaatgttccacctgtgagaaacctgcagtgtgatgtggcatttccatttattgcaacacaatatgactgtgacactaacatgagactctttcctgctaactccatctgaccattaaagaagagtcattgccaagtggaaccccatgttttctgtgacgtagaactagggagactaggtgtaaagggggaaaaaatcctgtgaaggtaggaggaaagtccggaagacaaagagaggggccacatgaataaacataataaagaatgaggggtgaggataaaagacaaggcgaaaagatcagagctaaagaaagccatgtggttgggcatgtggaaggctccagagcaattggagagaggaagaggttctttgagaaatgtttccgaagggctacattggctctctctttctctccctctctatctatctttgacattggcaaactcagcttcaatatattggctctcttgtacaattcttttagagatttaaataaagattgaaaatactctagtattgctatttgatgtctaatgccaggttacatcaatatagctctggccatggagaaaggacaatggcccagcatctaactccatgaaggactcacaacgtctctctctcagcaggacgaatgggaatgtgagaataatgacagagtgatcttatggtcagttggctcatagccgcagttctcattgttatatttacataattgttcacagttagcagtttagtgtcatctgccttttaggccttcatgcatgataaaaaaaaatgtggtacattatactgcaccataagagacctccttcctgtgcaataagatcatcctcagtgcacatggctttaacactcaggaagcccctttcactcccagctagaaggtcaccttactaattcagagaagaaagcagcagagtgtagcaaccagaagacagggacctgggttctaatgcctttggagcctccagttgagtgactggatgactttgtccctttcctgtgcctcacttttcccatttgttaaatgaaggggaggataatctgtaagatcatttgcagctctgacattctgattctatgagtagcagggatggtgggtgacagagacaggccttctgattgggcaccagctgtgtgtgggactgttctccaaagctgtgggtaattgcttcaaatctggcttttaatattctattgttagtatctgatactttatattccatgtggagggaagaggtttcgctggaaacacagggagggtaattttggatttgtattaaagaatctgaaagacctcaatttcggaatctgtgaaattacattgcaaagctgttaaacgtatttgggtaggataggatagggtggggctgagatgccacaacttaaaatgcagcgagatcacaactgtctctcctcaaacatatgtttgatcaaaaacattggcagagccactcaaaatccctgatgcaaaacatcatttaaaaagaatctttctccaatattttaacggatgagtttttaaaatgcagtttcttgttgtaatcattttggtaaaatccctgacaatttacaaagcattgtcatatctttttttcacatttaatcttcaatgcaaatctgtaaggcaagaaggtacagagtcttgtttccatgttagaggaagaggaaagtgtaatgtagaggcatggattgatcgatgggtaatggtggatctagtgctataacttgggtattctgccctccaaatcaagaattctgcccatttggaaacatggaaatcatttatgtggtgggaagttttataacaaagttattagcagttaatgaaacagacttacaattacttgttctgtggaagaaagaataggaggaggaagaaggagaagaggaggaagaagaaaaggaggaggaggaggaggaggagaatcacttgctaagtcatctttctcaaaggtccagaggctatgtgcatgagaactatattgggtacttttataaaatacagattcccaggatccataccagacctttgacagcgagggtaggagggcaggagtgagccagagagagcagcaatctgcattttaaaaaactgctctcagctgattcttacgcacacaggtgtatgagatttccctccagccattctattcataccagagagcgagcttagagatagagacagtagagagagcgagcttagagatagagacagtagagagagcgagcttagagatagagacagtagagagagcgagcttagagataggcagtagagagaaatcacaggcaggtcagaggggccagagatagaagtccctgctcccaaagggaaaggaatggaaacaataaaataaaacatacatttcagcaaagtggacaaggaagtatttattggttgtcatcacattgaagataaacagatgagaaaagacttggtgattatgaaaatgagaaagcaaaaaatgtaaagagatgcacagagcaatgtttttttaggtgcttttcatgtgatgagaaatagaattcttgggtattgttagctgataaaaaccgagttgtctataaaccgtgaggcacatagatttgtaataagttatcagcaagtttgcttattaaaagtccatttcttaaattgtctgtagatacactatcaaccagaattctactaaggctagaagatcaagtgtttcccaaacataggatgtgttctgtgagtgacatctcagagaatgggcacagcattaaataatctgaatgacagcaaggggattcaaattattcattcagtcattctgactcagtgtggtcctgctctggtttaacaagtctctaatacctaacaaacacagtgcaggcgtcaggctcaaagcctttggcaaaaaaacaggataaagctaaattttaataactttgttttactttcattgcatttgtattaaaaatcatcttctctatatagttttgcatttaaggtcacaatacagagtttcctttacaaatatgtttatttagatttaaaacgtatttaaagaaaaatagtaaataaataatagcatggcatgggtagagtggtgatatgataaaaaaaaatcatgaaagtagcatgcaagttacaaaagcccctatcagacagatgagaaaactaaattgcagaaagcatagtgtcttggcaaggacataaagcaatgcatctgcagggcatgacatctaggatctttctttctactgtcttttgaagcttgcagaaagctgagctttcatagtttgggatgttaacattgtggcctctggacaaaatgtattcccaagggccctttaatctcatcaccagtctcagatatgtccatgtttcaatacaccaaagtgcgagatcaaatcaggtgtggctgattctaatccctatgtacttctttccctatttcccaatatgtgcatagaactaagaggtcaaatcaatatcctttcatgacttttttccattgtttaccacagttcctaaatggcaaataaaaggattgaaactctgaatctttgggagtcagactatctacctgctttttctatagtattccaatataaaaggacctaaaatatctaggagaaaataccttaaaagtacgttttaaacacagccaatatttactgaatgtttattatgtgtcaactactgtgctaagaaattcatggattatttcatataaacttcacaataatcctatcacatgggttttattatttgcaggctctggctgagtggaatgaatcctagtaactttccccaggtagagtatctagagagtggtggggtcaggatctgaactcagagcctgattgaaacaacatcactaaatttgcaccttcatggaacaggcattctcaacccctaaacagtgctcttgagaagctgcccataggagtgacagtgagtcaggtacataaagaatacttaagatactgagggataagctgagcttcctaaagaagggcaagtgggtggtaagatagcccagagactgaggagaaagtggggcaggaaagtttagagaactcctattggaactgtgcctagaagaatgagtagtcttgtgccaggctggaaagtgagacagcattcaaggcagcagagatgatccagagacaatataattcgctatttgtttgggaaaagctgaccaatcttgtatgtttattgcacgaagagttaggtcaggggagctgggctgcagcggggagagttgagggaaatgagctggaacaccagattggatcaggccaagaagggtttcatatacccttccctctctgcccactgcaagtcctactgtactgctcaaggttatcctattacaacccaatccagctggcatttgcagtttaaaatcccacatgtctgaatggcctttccatcttcctgagtgataaacacgaagcagcttctccctttatggctatattatatacatagtcccaaaagaaaaccagaggcagagaaaataatttataatttgcaactctgtcaaggaaagagcatcctaaaatcaccaaaatgtgtgaatagcctttcagttcaattctagaactcacccttttggaaagtcatgcaaatgtatatatacatatacatgtatatatataatatataatatacatatacatatatatgtatgtgtgtgtgtatatatatacatatatatatgtatatatatcctgatcagtaaatatatccaatattttttccaaatgcaatctcaggcatcaaattagctgtttaccactaagcatctatggagatatttctcctttggaaatgtctacattttctaccaaccccagattgccaaagattcagtaaaggaaagcagaatggccccctaaaattgacagtatcatttctgacatatgtcttctcattagtaatatttccagaaattctccagcttcaaccaaacaaaatgttacactggctgaaatagagtttgctgtcccctacacttaactgcactgtgggacgatgcttatgattttgtaactcacagaatcacaaaaaaaggggctgagaacgtgttattcaatctactcacctcttccccagaaatgttgactaatgaacattcagttcttccagttactgatattcggtcaatcaacacttttaattgactgatggtcatccaattgtctccttcaactttactaggaactccctagtaaggcaatccattccattttgtgctgaaatacatgttcttataacctcaatcctttgtttcttacctctctccctcacattatgcagaagaagtcgaattcctgtttcctctaacagccctttaaatatataaaaacaataattatgacctaaaacctctttgctctaagctcagcatccccagttccttctactgttatttatatgtcataaattctgtagagaaaatcatggcatttaccctcttctgaacatactccggcttgtcaattcccggtataagatgaagcttttatcatttccatggaccaggtacctgcacattgcaccatggactaaacacacatttacatgggaatatggttttccaatgggtatctcagtgtgctttggaggagatttcttcctgaacagctgctctgactaaattggaaggtctgtgtcctcgccaagtacatgctgtaagagaacaagctcctagagcctgcctagtggaaagggcttatctgcaaggttactgccggtactctaaccacagaagttcaggacccttcctcctagaaaccgtatcagtcgccttctacggcgctatatatttttttttttttggtcttgccttaagaatgtatgaggattaaaaggagccaaatggtgcaggggctgaacctcctggtactgttgaaagacctctcctgctgtccttggcagtggcaaggaagttctctgttgtaaagctcagaggactagtttgaagcagggtttcttaacctcggcactatctggaaatctggggccaggaaattctttgctctggggtgttccatgcattgtcggatgattagcagcgtccctggcctccacccactatataccaatagtattcccacgttgtgacaaccaaaaatgccaccagatattgccaaatgttctctggtaaacaagatcattcctgataaagaactactggtttaaacccacacaatctcagtgatctaagacatgcagctagatctaaacttaaagcattatctaattcaacttcctcattttattggtgttgggagaggtaatgacttcctgatgatcactaagggattagaagacaggcctcctgctctttccaggacaccagcggttgttaaccctgctgcgcactcaagctcctaaaataaatggatttctgcttcccaaccagacccaattaaaatggaatctctacaagcagagctcaggctcaggtattgcttaagaggccccaggtggctgtaatgtgcagccagggttgaaggccagggcaccacatcacactgcctctatctttgacctcaaataaaccacgttgggcatttctggagctgagtgttgtttgggggcttgccctgcagggtggcatgcataatccctttttactgcgagcgctgatctctgagggctggtacacagaacctcgacaccctgacagtgggtgcacctacggagcaaaagggggaaaacaaacacacacggaatgtgctcaacttgtttgacatggctagtatattttatgttgggtcaaagaaatgcctacaggtaatttaaaatccagaaggcatattcaaaataacagccccaactgttcagcacagggtatgatgtacccaggaaacaagtcttgtctcatgttgcttaaacaattgtttataaacagtgtgattaatttatttctggcttttcttctagtagaggagccctgcatcccttgtttcaggagaagtgtttagaacatggagatttctattgactcatttcttaagaaattcttatcaggaagctgagaaaataactggagacctggaggaagatgttttaccaagatatgaatgatgctatgcaaatacttatgataacaatgtagcagtttccattgattgagtgctttctgtgtaataggaactggcatatccctgaacggatgttatcaatttaaccttaacaaaagccccatgaaatgggttctaatattatgtccattttacagatgaagaaaaaagcttggagatgtttggtcaaacacttaaggtcatattgacactaaatggtagatctcagacaggactgaaacccaggtgggccagattccagcacctgcagccatggcactgtgctgggtgggatggccctttgattacataccagtggtcgccttccaccaagccagaagctggaacttttcctgaacagtaagtctcaatggaagggataatgtttcagcctcaacacattagcctagaagtgggcatcctggaaagaagcttaggccacccgattaacacatttctgaaaagcaggtacattttgcaaaaagcactaacttttctaatcctgagtatttgatgagaccattggtgttcttttaaagtttttattcttgctattttcctggtgtgatctcaacaagaacagtgttttctgaaagattacttcacgttgtgatggggaccaaggccggctttgtgggtatgtgaccagtgcatatacaggaatccagacctaggtttaatgctctgctgttgccatcttgaaattcttaataactttattcttgaatttgtgaatattagtagaatgtgtatgtatcaaaaagtgaaataaaagcagttgagttagttttctgcactactctggtaaaaacaaaatacttaagtgtgtatgaactacctaccatgatctgtataattttgataattccacatacaagttaaatgctcttttatttacattcgaagttggcattgcacaatgtaaaagtgaatgataaattgattcatgtatcaacgataaatgaatgataaatttattcatgtatcaatgatgaatgataaattggtgctaataattttaaaaatttcttaactaaaacaaaggtaattagcaagtaaaaaaacaccaagacaagttgggagggagtgaatgaaaaaaaaagaaaggctttaaattttaatacctttaagaacactttttcctgccattcgaacaagttgcttgtatttttattttgcatttggccagcaaattatgtagtctgccctggtaggggttaatggagacaaaggaaggtcatcctcattcatctttgatttacccagattaagtctgttttggctcaaaacaatgaggtaaacgttgaatacaattgtaacctctaaagttcaaggtaaaggccataagatggcttttaaatgtcaaacaactttccgacattagcagaaacctctgaggatccaaagtaagtcaactctaaatcatttcctcatccatgggtaaaaatcttccaattcacagtgtgaaaacctttatttaaaaggggaattctgatgtgctgaagtcaaaatttaacaagtggtttcactgtgaacaaacaactgtttcagctgtggaattaatacatattttttaaagtggtggaagcttattctggcatgcacagtccagatgaacagtgaagtataagaacatgtgtttatttaacaaatatattaattgagcaatttctgcaccatggggaaattttagggaataaaattgacatggtacctgccctcatagactggcagtctggctggacagacagataataaacaagttaacaacaacaaaaaatatatggtaagttatcatagttgttatttataaaggaaataacaaggggctgtaacccggattattttttcttctgctgtgttttgcctctcactcattctctttgcctcttactcattttcactttttttctatgtttacattttctccgctattgatttcatatagaaatctgaatacactaatgtcgtacatggaaatgttaaagatttgtatagcacatccaatagaattggttgattagtttttgagcgttgctgataacaagagttagtgagtctgagagaaagttgtattgcctccttccagagagaaggcacatatagctctggagatgcttggtcaaacaaactttttacaatcatgagaattttctacatttatatctaagccaagagccactcaccacatgtggctaatgaacacttggaatataactagtgtgattaaaaaactgagtttttagttgtgtttcattttggttaaattaaaatttaaatagtcatgtgtggctagtggttaccctattggacaacacagatctagagatctcaagtcaatggacagcctgtttatcacagggattaacagtggatgatggaggatgatagccaagaaccaagttagataggcaataagttctttggaaagtgcttgcaaaagttctcagacttctcaggaattgggtaagtgtcctaggtttgagtaagatctgaacctggaaactggggaagaatctaagcctggtgagagagcagggaaacccatctccaaagctaaagtttgcatacaatctctgctgtgttgcctaatttataaatagtctgttcttaaaattatcactctcatgtggacagagctttgcagttagcaaagcaaattcacatcaattattttgttattttgacaatgaaggagtgaaataggaggatggggattatctaccaaagaagtcaaaactggaatctttagcagattttgtacagggaaattctctgctctaaggttacagtcagcaccgctagtcccttttctgccctcagttatctgaactaataatcatggagacagttaaacagaagagagggtaagccagtagactagagacagagcattttttcatcctcttgtcaagtcctacaatgttccaggcactttactaggctctgaggatacaacaggctgcaagactggcaaggtccttggtatttgtccaatggacaaagaaccccattagcaagtccccaaagaacctcaaatcaaattaatatgacttgttcctaccacctgccaccttgttgtggtcacaagactatgtagtcataccatgtcttccaagtggggagagaggcttaaagcatgactgaactgaagcaggcttccaaaaggaattttctgataattatattttaccagttaagttagataaagttattatcttttaagagattctggcctgggtgcggtggctcaagcctgtaatcccagcaccttgggaggctgaggcgggtgaatcacgaggtcaggagttcgagaccaggctggccaacatggggaaaccctgtctctattaaaaatacaaaaaattagccgggtttggtggctggcgcctgtaaccagctacttgggaggctgaggcaagggaatcgcttgaactcaggaggcggaggttgcagtaagccgaaatcgcgccactgcactccagcctgggtgacagtgtgagactccgcctcaaaaaaaattttataagaacctaataattctaatatgtgtcataacttgaagccctgaatcacaatcaatgctagcacaccttggacaattctgatccacaaaagtctaggaccatggctctaaaccgttaatatgcataacagtcatgttagtaaaaatgtcatttacaagccctgcactgattcaatgagtgggacccaggaatctgtgtttttactaagctgccagatgattctaatgtgagtgatctgcagatcatgctttgatggaaaaacgatcaagaaaaataaaaataaaagttgcaaataagggaatatatttgcactccccaaatttccaacaataatatatacacagagagcgctaaaagaaattgggatatttattaagaaaaacaaaagcctcagaaagaacctatggccaaatatgcctaaagtgctgtcctaacgtaaaagatgtaacctgtttttctctttctcaaggcagaacgagggttagtgagtagaagccacagggatggaaacgtcaactcaatatcaggaaaacctttcaagctctagagctgcccaaactttgagcagactgctcagatgggaagcttctctcattgcaggagttcaagcagagatgggatgcccatcaccagtgatgacaaggaaactgttgatttgttagcaattccctcagctcctgataaaccttgtgtacacctgcagtgatgttcaccgtactgtaatatcttgctagtgtatcccttgcttcagtggttcatgtttatatctgctgcatgctgccttctgcattaaatgctcaatacatagttcccgtgaatcaaacttcagaacctaataaattgagttccagaatctgcaaacctggagttctgatgggcttcctataacctcaaaaggaaaatctgggttttacagccacctcttctactatccacaatgaacctttagcaatttatctgctcttcttcagtaaagttttaaagtttccttcaataaaggtcttatacttttcaaaaaaaaccattttttttaaggaactttagttattgcttctgtggatggtgttttatttttatttttatttttattttgagacagggtctggctctgtcacccaagctggagtggagtgcagtggcacagtagtatttttcttaattcacatactaattggttttttctcatgtgtaggaaagtcactgaggattgagtgttatctcatatcgtccatccttatgaaatatcttattacttttcacagtttacagtggattttcctggaagatgattataatagatcatacagatggttaataaataatggaagctttgctctctttttccagtttttttatatttcttctttctgttctttggattttgtatgtacaatgttgaccacaagagatgataagacatcattgtcttattcctcactttagtgggaatgcagctaatgttttatcattaggttatttcttttcttctctgccactatgtgcactatgggtttcctagagtgggaaaagtgatttctataaaaccaagacagatattggtgggtggggaaaacacagctgcagaacaagattaaggatgagacaaggacaaagaggctggctccaaattcactgagaatctgagtttgcacatttgatgaacctcttagaattccacacactggcattatgcctctttctaatacatgcatgcagacaaattaaaattgccctcaaaatatttatatgaaaataattcatgtttagaagctatatttagaagactatgtaacctatatgtctagacaaatggtgtcatcattcaaccaaatgctgtcttcacttctattttgatcacgggttgcatatttccaaagacacttcttgtccaacagaaaatagtcaaacacaattgcagacatctctgctactgtgtacactagttagtacaattttagcaatcaaaaccctctaagaatgtctttcaaaagcatattttatttcattggctacccatttgcttatttaataataaaatttcatgtaagtaaaagggccataaggataggaccaagcttgggagacctatgattctaaaccattgaggccaggcttggctgtttctaattcaacttggaaaagtaaaattccattttgtcaaaaagactttaaaggaaggaggccccacaatatcagagtgttgtcatgaactgggtcttctcaatgtgaatcttgtagactaagttctctataccttttaggatctcagggaagatttaacaaacaaaacctaattttcaattttgagtattttaatccttcataaatctgaagagaatcaggaacacctttcatcagcaaaaatgatcaatcaattgatcatctactgttatacagatactatgttagagactatacagttcctagagaagaggaagccatagtttctcccctcaaggaatacttgatataacaggaattaaataaggaattgtatactctaaagcagtatgaatgtcatgagaaatagtgctgtaaacaggccactgctatccagcagaaatagagaacaaatgcccaagttgaagaaatgtgaaaaaggtatgttctgaaaaccataggaagaagagtttgatcccaatcctgagatgaacttcttttaaattgattctttgtttgaataatcaacgggtacccaaagatagaagtcaacaggtggttaataagaataggtccatctgatctaaacttacttcctttaaaaaaaatgagtatgaaaatgccttcatttgaagaaggaatgttttccatggtttgtaggcaaactagagaaatatgaacaaaatggtagagttgatagattaaaaaatgactcatcaactttatccaaaaagtcaaggtgatcatggaaagttgtaatcttaactctgactctaagtggctggacaaggctgagttttgaagtcagaaacagttgggtctgaattccagctttgttgtttactacttgtgtgactttgggcatgttacttaccctaacactcaattttctcatctttaaaatgacaatgatcataataccttacttctttgagttataaaaattagatgcaaatgatggacttagggctctcaaatatagtaacaaacattcttttctggaataatgttaggtttcataatcataatcattattattaataaaatggaaggaggtctctagtgacctgtccagtactttttaaatgtttgccttgggtgaggaaaatgaaggtatgcctataaaattgtaaattttatacatgcagctagaaatttatcttacatttttatgatttatattttgcccccatggttgaattttacagttatttttatttagctccatctcttcaataccagctgattggtttctttttaaatccttaagcctgccctctaatatgttagttctccctcagagccacagaaaaagtgtcttgatttagtaacatgatacaagattattccatttatggagatagggatgactcagaaaacttgtggttggagggtgagatagtttggatgttcatccccttcaaatcccatgttgaagtgtaatctccagagttggaggttgggcctagtgtgaggtgtctgggttatgggggtggaggccacatgaatggcttggtgccctccttgcagtaacaagcgaattgtcactctactagttattgtgagatctggttgttaaaaagagtctagcatctccctcctctctttctctctcttgctccccttcttgccttgagacatgtatgaaccccccttcatcttctgccatgagtaaaagcttcctgaggcctcaccagaagctgagccaatgctgatgccatgctcgtacagcctgtagagccattagacaaataaacctcttttccttgtaaattacccagcctcaagtattcatttatagcaacacaaaatgggccaatacagggggtaagtgtatagagctaagaattctgttttggttgcatcacatttcatttaagatttccaagagacacctatatggggttgtcaaggaagcaaattggatcttctctctggatctcagaggagtgttatgccctggagatattgatcaaagagtgaggtgacagcatgaagactgtatttaaagttatagatggtgaatgtataaagtaagagcatagtctgagaagagtatcaagagccaagtcctgaagaactccaacagtttgaggccagagagaggggaagagcctctaaaagagactgggaaaaagttgctggtgagttagcaagaaaaccaggaaagtatggtgttaaggaaaattaaggtaggaagtattttaagaaggaagctaggccaactctaagaggtcaagtaaggataccttttcaaaatttgaaacttctgtaagtcaaaagttaaccaaagttaaaaagcaagcaggagatggggaggtgtatttgccaattctatgacaccagatgaatatacagaatataacaaagaacacccagaaattaataagaaaaatacaacaaagttgtcacaaaaagggccaaacacataaagatgcactttatataagaataaatataaatagtatataactaatttaaaagaggttcaatctgacaaaccgctaagtaatgcaaattaaatgatacagcaattacttttacactaacctaatattttttaattaagaaaatatgaaagattgataatattcaatgttggtgaggagaactcacactcacagatgagaatgcaaattgttacagtgtgttaggatgccaatattatagtaaacataaacattttaaatgagcatacctgtcaatacagcaatttcatttttggtagctatctgaaagaaatactagcacatgcaccaagaaatgtgttcaagggcattacaaacagtacagtttgcaatgacaaataattggaaatacttacatgcccactaacagcaaataattaaataaattttaatatgtatttttagtacagaagattatggaacagctgaaacaagtgagttagagctatattttccccagtgaaaagatcttcaaaatgtattgttaaaggataaaaaaacaagatgtagaaaagtacatataaaatgatcccatttacatagagtgagaaaaagttatatttctatggtttttatgaatgtctgtaaatacattgaaatgatcagcagactaatgttaactattgcctctgggaacaggggtaggattagcaggataaaagctgatactgattttcattgttttggttttatatttcttcaattcatctgaatttgctaatgatctacttgtgggatttttaagaaaaatgcaaaaattgtcttagttgtgttaagttaaaacaattgatcagaagaattaattttagaatttgttaattcatcaagagtttaagttcctattacatatcagacaatatgtagagtatttggtatacggcagtgaataaaataggcagaattcctgtcctttgtaagatttaacctctagcagatgcaggtttcaactattctgtataggctacccttactcttataagattctccactcccacagtaaaacatcacagaccaacttcctgcacttttcatgaactcatgaagaaacttatggaagactgtaatcccagcactttgggaggctgaggtgggtggatcacagggtcaggagatcgagaccatcctggctaacatggtgaaaccctgtctctactaaaaatacaaaaaaattagccaggcatggtggcaggtgcctgtagtcccagctactggggaggatgaggaaagagaatggcgtgaacctgggaggcagagcttgcagtgagcccagatcacaccattgcactccagcctgggcgacagagcgaaactctgtctcaaaaagaaaaaaaaaaaaaagactgaacaaaaagcagcagaaaactctgcagacttaaatgtccctgtctgacaactttgaagagagtagtggttctcctagcacagagtttgagatctgagaatggacagactgcctcctcaagtgggtccctgacccccaagtagcctaactgggaggcacctccaagtgggggcagactgatacctcacacagccagttacctctcagagatgaagcttccagaggaacgatcaggcagcaacatttgctgttcagcaatactcgctattctgcagcctctgctgctgatacccaggctaacaggttctggagtgttaactccagcaaactccaacagaccagcatctgaaggtcctgactgttagaaggaaaactgaaaaacagaaaggacatccacaccaaaaccccatctgtacgtcactatgatcaaagacaaaggtagataaaaccacaaagatggggaaaaaacagagcagaaaagccgaaagttctaaaaatcagagcacctctccccctacaaaggagtgcagctcctcaccagaaatggaacaaaactggatggagaatgactttgacaagttgagagaaggcctcagatgatcaaacttctctgagctaaaggagaagtttaaacccatcgcaaagaagctaaaaaccttgcagaaagattagaccaatggctaactagaataaccagtgtggagtagtccttaaatgacctaatggagctgaaaaccaaggcacgagaactacgtgacaaatgcacaagcctcagtagccgattcgatcaactggaagaaagggtatcagtgattgaagatcaaatgaatgaaatgaagtgagaagagaagtttagagacaaagagtaaaaacaaacaaacaaagcctccaaggaatatgggactatgggaaaagaccaaatctacgtctgattggtgtacctgaaagtgacggggagaatggaaccaagttggaaaacactctgcaggatattatccaggagaacttccccaacctagcaaggcaggccaacatttgaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaagggaagcccatcagactaacaatggatctctccgcagaaactctacaagccagaagagggtgggggccaatattcaacattcttagagaaaagaattttcaacccagaatttcatatccagccaaactaagcttcataagtgaaggagaaataaaatactttacagacaagcaaatgctgagagattttgtcaccaccaggccagccctaaaagagctccttaaggaagcactaaacatggaaaggaacaatcagtaccagccactgcaaaaacatgccaaattgtaaagactatcaaggctaggaagaaactgcatcaactaacgagcaaaataaccagctaacatcataatgacaggatcaaattcacacataacaatattaaccttaaatgtaaatcggctaaatgcgccaattaaaagacacagactggcaaattggataaagagtcaagacccatcagtgtgcggtgttcaggagacccatctcacatgcagagacacacataggctcaaaataaagggatggaggaagatctaccaagcaactggaaaacaaaaaaaaggcagggcttgcaatcctagtctctgataaaacaaactttaaaccaacaaagatcaaaagagacaaagaaggccattaaataatggtaaagggatcaattcaacaaggagagctaactatcctaaatagatatgcacccaatacaggcggacccagattcaaaaagcaagtccttagagacctacaaagagacttagattcccacacaataataatgggagactttaacaccccactgtcaacattagacagatcaatgagacagaaagttaacaaggatatccaagaattaaactcagctctgcatcaagcagacctaatagacgtctacagaactctccaccccaaatcaacagaatatacattcgtctcagcaccacatcacacttattccaaaattgtccacatagttggaagtaaaacactcttcagcaaacgtaaaagaaagaaattataacaaactgtctctcagaccacagtgcaatcaaactagaactcaggattaagaaacccactcaaaactgctcaactgcatggaaacagaacaacctgctcctgaatgactactgggtacataacgaaatgaaggcagaaataaagatattctttgaaaccagtgagaacaaagacatgacataccagaatctctgggacacatttaaagcagtgtgtagagggaaatttatagcactaaatgcccacaagagaaagcaggaaagatctaaaattgacaccctaacatcacaattaaaagaactagagcagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgattaaggggatatcactaccgatcccacagaaatacaaactaccatcagagaatactataaacacctctacgcaaataaactagaaaacctacaagaaatggataaattcctggacacatacaccctcccaagactaaaccaggaagaagttgaatccctggatagaccaataacaggttctgaaattgaggcagtaattaatagcctaccaaccaaaaaaatccaggatcagatggattcacagtcgaattctaccagaggtacaaggaggagctggtaccattccaatatccctgatgaacactgatgcaaaaatcctcaataaaatactggcaaaccaaatccagcagcacatcaaaaagcttatccaccataatcaagtgggcttcatccctgggatgcaaggctggttcaacatatgcaaatcaataaacgtaatccagcatataaacagaaccaaagacaaaaaccacatgattatctcaatagatgcagaaaaggcctttgacaaaattcaacagcccttcatggtaaaaactctcaataagttaggtattgatgggacatatatcaaaataataagagctatttatgacaaacccacagccaatatcacactgaatgggcaaaaactggaagcattccctttgaaaactggcacaagacaggaatgccctctctcaccactcctattcaacatagtgttggaagttctggccagggcaatcaggcaggagaaagaaataaagggtattcaattaggaaaagaggaagtcaaattgtccctgtttgcagatgacatgactgtatatttagaaaaccccatcgtctcagcccaaaatctccttaagctgataggcaacttcagcaaagtctcaggatacaaaatcaatgtgcaaaaatcacaagcattcttatacaccaataacagacaaacagagggccaaatcatgagtgaactcccaatcacaattgcttcaaagagaataaaatacctaggaatccaactcacaagggatgtgaaggacctcttcaaggagaactacaaaccactgctcaacgaaataaaagaggacacaaacaaatggaaggacattccatgctcatggataggaagaatcaatatcgcgaaaatggccatactgcccaaggtaatttataaattcaatgccatccccatcaagctaccaatgactttctccagagaattggaaaaaactactttaaaattcatatggaaccaaaaaagagcccgcattgccaagtcaaccctaagccaaaagaacaaagctggaggcatcatgctacctgacttcaaactatactacaaggctacagtcagcaaaacagcatggtactgggactaaaacagagatatagactaatggaatacaacagagccctcagaaataataccacacatctacaaccatctgatctttgacaaacctgacaaaaacaagaaatgcggaaaggattccctatataataaatggtgctgggaaaactggctagccataggtagaaagctgaaactggatccctttcttacaccttataaaaaattaattcaagatggattaaagacttaaatgtcagacctaaaaccataaaaaccctagaagaaaacctgggcaataccattcgggacataggaatgggcaaggactacatgtctaaaacaccaaaaacaacggcaacagaagctaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaactcaaacaaatttacaagaaaaaaacaaacaaccccatcaacaagtgggtgaaggatatgaacagacacttctcaaaagaagacatttatgcagcaaacaggcacatgaaaaaatgctcatcatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagacagtgtggcgattcctcaaggatctagaactagaaataccatttgacccagccatcctgttactgggtatatacccaaaggactataaatcatgctgctataaagacacatgcacacgtatgtttattgcggcactattcacaatagcaaacacttggaaccaacccaaatgtccatcaatgatagacaggattaagaaaatgtggcacatatgcaccatggaatactatgcagccataaaaaaggatgagttcacgtcctttgtagggacatggatgaagctggaaaccatcattctcagcaaactatcgcaaggagaaaaaaccaaacgccgcatattctctctcataggtgggaattgaacaataagaacatttggacacaggaaggggaacatcacactctggggcctgtcgtggggtggggggaggggggagggataacattaggagatatacctaatgtaaatgacgagttaatgggtgcagcacaccaacatggcacatgtatacatatgtaagaaacctgcacgttgtggacatgtaccctagaacttaaagtataataaaaaaataaataaaataaaatggtaattgtactcataccatataagtttcttcaaaaaaaaaaaagaaatttatggaagaaaatatggagtgtacatccatatgccatctctaaattgtctctttgctttacaatgatcctgcagattaccagacgcagcaggattttaacaatacatcttatttagtaaaataggctttcttgggctgccctggaaactcccaaactctctatgaaaaaaaccatcaactgctaaacaactgacttagcaaatgtattaccagagcatacgctgtttgtaagttgtcaacagcctgtacttaggcaactgctagattaaatagctaaaaactatttggcacccacacagaagttcttgtacacacactttatggttgaattctttctatgacactcctgaaggcataataattaagagagaatgtcggtttctaggagtatcctttggggtctttccaccagctgaaaccacaacaccatgctaggctttagctacaaatctgcctacacttgtagcaaaaaatggaattcatgctctgagcagcctctgaggcacaggatttatattttatagcaattcttatttttcttttcttcttttcttacacatgcaaatgaaaatatcccccaattttcagccgccagaacagctgaatactaatcatcatcagaaaaattaaatgcttgtttcaaagaaggaactactccttagaaattcctgcgcatctcagggcaaagaaaaaaatgtcactggcaatcctgttttgctacaggatgaatgtatttatcacacatagctttgcatagctgagaacaattctagcccagggtgaccagaaaagtctcagggtttggaaagaggtaccataactagacactgaacatttaactccaaagtcacttccacctccatccacttatgtgaccttggggaaaaaaaatcgctggacctgtcggtattctcttatatttcatttccttccttgtactgttctatctgcctgaaatggcttccctgccttctcctccatgtctcaaattcttaggaaatactgttctgtgttctgtaaagccttccctgagcttcttaagccaaatcagcttcctttcctttctaccccaattctagattgcccatacatccattatatcacatggtattactgttgtatatttattatggtatttattttagtttatcatgttatttatggccatattaggttctcaggcactacgttattactattggtcctaatattaaataaaacttctagtaccattgtgagtgcttactgtatgtcatgccctatatgaatatattatctctactcatcagaaaacacacatgagatgagaattaacattctcatctgttttaaaggtgaggaaagtaaaaccaagagagagtatgcagatggctagtaggagcaccgagaatcaagacaaaacctattttactttaaaatccatgcttttaaccactactctaaagtaacacctttaaataataatagataacatttactaaatacttgttaagtgtcaggctctgtaccgtgcactccacatatactagctaatttgattctcataaaaactctgtgatgtagatatagtgattattatcttaagtttttaaaaaatgaaattgaggttaataatgtttaaacgacctgcccaaggtcacagaactatggggacttgattagaattcaagtcaatctccctccagagcctgagttcttaaccattgctgtattccatgaccagatagtagaatcttttataatctttgcaaactctatgcaggtttcagggataacccctttggaaacagaaaactggagcattaccccttctgagtaatacaaatcaaccaaatcaatgaactcccttagtatactcaccttagtacatgtgtggatccattaatggttgtggttgaacaagggacagtctggcccagaatggaaggtcttcggtagcgctcatcatcacagcagaggatgatgaggaaggcacgtctaaaagacttattcaagaaggcgtagagaaaagggttcaacccggaattgatatagccgagccagaggaaagcagtccacacctgcccagggacagtgtagtctatgaaaggatccacaatattggtgacaaagaatggtgcccagcagaggcagaagcaacccatgatgatgcacagggtcttggctgctttggtctctgtcctcatgcgatgagtgctatgctggtctgccgactgaggcctgctctcggaggaggctcctgcccgttgtaacatctggatctgatgggcatgctccttagctgtgacatagatgcggtaataggccagcaccatgaggagaaatgggatgtagaaggccaccacagagcaggtgatggcgtagggcttgttgaccatgaagacacagtacgtagagttagagttctggttgaacttcctcttttctatctgagagttggagggagagaggaaatgaggaaaggaggtaaaaaggaaagaaaaagtgaaaaagaagtgggaaaaatggggaagagtgtgagaaaagaaaaagggaaaaggaagaaagtggaggattggaagataaaaagaaggggaagagaacaaggaaagaaaatgggagaataaaagagtaaaggggaaaggaaagaaaagaaagtttatcagcaaagctttggttttcttataagcctacaatacaaagaaccttgatgacagaaaaggaacatgatcatatcccagggcccagagaacttatctgtacaagaggaactgaaggctccaggacagaagagaaataaaatagagacagaatcatttattacatttacccaaccagaagtgaaattctgcctctgttctcccttccctgtctgcttgcacataacagatcagtctcttaacagaatgtctgcagatcagtaacattagagtcacctgcagtacatattataagtgcagattcctgcccactccctgctgccacccctccactctcatccctgaaagatctactaattctaaatctctgggcaatgaagctcagatatatgcattttaagcaagttttttccaataactctaaagctcattaatatttgagaaccattgctctatactgtgctaaacttagctctttgggggatgccatggggcacttttctagagtcatttctctacgtattgagttccctgatgaaggtttgtctcatttagataacacagagtaacacagagtaacagcctgtgttatagtgtaacagcttgtgttttagtgtaacagccaagaggggccttagggcttgggggaaagaaagggtagatattttaatggaagaaaagaatataaagattgggtagggcaaggtcatgagggactttggaacccaaccagagttagaacctagacaacactcaatgcttcaacttactctcctcccagtctctcctgaacccactccatttaggtgttcaccctaatcactccattgaaaatgctctggtcaaggctatcaatgacctctgtgttgccattcctccttttaaatgagccatctacacctttgacatagctgaaccttccatccttcttcttttttcgaatattttattgaaccaaaatacgtataaagtacataaagtgtatatacagatgaatcaattattacatagtaaatatgcctgtgtaattattattcaaatcaaactatagaatattatcaacaacccagcagcctcccaaatgccttctcctagtcattaatatgcccaaacatagccactcatctacatcatcataatgtaattttatttgttttccaactaagtatcaatataataataaaacacacaatctgtatcttctttaatattgtatcactcacattattgcatgtacaggcagtttattctttttcattgtagtataatattgcattataggaataaactacaatattacatattccaatattgacagacatttgagtcatttttgggtttgtgctattttgcataaaactgttatgaatattcttgtggaagtttgtgtgtgtgtgtgtgtgtgtgtgtgtgtgtgtgtgtgtattttcatctctcttaggtatatacccaggactgaaattgctgtatcatagcttgggtatatacagccaaacagttcccaaagggactgtatcaatttatatttccaccacgagagcaggagagttccagttactccacatgctcgccaacatttggaatttattgtcagtatgtagtggtatctcattgtggatttgttgatgatgttggtaaagtttatttgattacataagtaaaatactccatgtgtttttgactctttccattggtttagattaggatttgtcttatgttttgttactgaaaagtgtcctgggcatccatatccacataattatagtacattgacatcactccttttggaaagcatgtgagactgagtttctgcatctgtttcctgattagcactctggttccttcaatgggacgagagcattgccttcagaatggtaaaatattgcctagatcttgtcagtcccaattcttgcagctgtatcttcagtttcaatctgagtaagtcacctcaaactctcagtgtgccctggtttctgcatctttgttccctgtttactatgtcctggctatttcattgtaattttgaattaaatccaataaacttgaatcaaatctaagtttattacaacccttcagtttcttattgcagttttactgtgcatctcctgagaactaataatgttaatcactgttttgccctttcgatatcctgtcttttgaattgattattcaggtattttcccattttaaaaattaagttgtaactctctttcttattgatttttaatataatagttcttttatattctagatgtcttttgtcagatttatgtgttgcacatatatcactctgtggcatggcttttcactctagtatcttgtgatagaaagaagctctgaaagaacctatacttttggttagtacttgtatcttgtttatgaaatctttgtttactcctaagtataaagatactggccgggcgcggtgacttacatctgtaatcccagcaccttgtgaggccgaggtaggcaaatcacttgaggccaggagtttaagaccagcctggccaacacggcaaaacactgtctctataaaaaaatacaaaaattagccaggcgtggtggcaggcacctgaattctagctcctagggtggctgaggcactagaatcgcttgaacccgggaggcagaggttgcagtgagctaagatcacgccactgcactccagcctgggtgacagagtgagactcagtctcaaagatattgtcaagagatgtaaagacattcttttacatgatcagttagcatatctttattgtgttaatttttatgtcttttttttttacagggtcatgctctgtcacccaggctggagtgcagttgtgctcactacaacctctgactcccaggctctagcaattctcccacctcagcctccctagtagctgggactacaggtgtgagccaccacccctagttaatttttaaatattttttgtaaagacagggtttcattgtgtggctcagactggtctcaaactctaggctcaagctatcagcccatctcagcttcccaaagtgctgggattacaggcctgagccactgtgcctgaccagtttttacatttaatgcttctacccaccagaaattagtttttctgtatggtatgatgtacaagatatggatattgaattgacccctgcagcatgtattgaaaggattatcttttcctagttgcactgcagtgtaaacttggtcataaatcaggggactgtatatgcatatggctccacgtttggatttcctatttgttctcttgagttgtctctctctgcatgtactgctttaacttctataacttcatacatcttagacatctagttataaaagtctttgaattgtggtttcttttcttgaagactcttggataatgttttatctcagtatttccatataaaatttaaattaatatctcaatttctataaaaatcttctaggattttgattggaatgagagtaaaatgattaagggaaactgacatctttacaatgttaagtctttgaattaattaacatggtaattccttccctttgtctttttaagtatatttcaataatactttttaattttataattttctttgtgtcttgcacatcttttgttagatttgtttctaagtattttatgcttttactctgttgtaaatggtaccatgttaaaatcctgattcctaattgttgctaatatgtagaacttggtgaggatttttattgtaagctggctatgtattcagcaactttgctaagttagatatcaactaaaattcatctttacattcttttgaattttctccaggaaatactcatatgatctgcaaataatggcagttacatttttttctctttccaatcctaatatcactttctcttgctttattgagcttgatagggcctcccatctaattttgaataaaaatgagagtagttgacaccttgtttcactcccagttttaggggatgagccttcaataatttactaagtatgatatttgctataaattgtatgtcaatgccctctacttggttaaggaaactacattctattcttggtttgatgagatttttaaaaaatcgtgaatgggtattgaattttgtcaaagcatttttggcagtaacaaaatgaacatgtgggttttctcccctttttttattgatgcaatgaattacattgattgcattacaattcctggaatgtcttatttgtactggaccctgtgacacactagtatttttcttaaggattgaaggacatttccaccaactataaacactgcctgctgacaggtcttagtcatcaaccttctctagaaatagctcttgactgaagagaactgcttaacccaatgtcacttacccttcttgggatcaatctgcatccagtgtgaatatacacatgcatgaagatatgaagaatagacacctatatgatatactcacaaacatgctattttattcctgtacatattcagtatcttgttttatagactattataaggttatcatgtatcatcctcttgaattgatatttttatcattatgaaatatttctacctcaagaaatattattttccttaaattttattctatcactaataatagtagagtaacaccaactttccttgacttatcacttgcatagtgtatgtatttctatttttttattttcaatttttctgccactttatatttaatggtcctctcttacaagcagcatatatttgtattttgttttgatgcagtctgacaactttgtcttttagcatctattctttaaataatttaatatttactaaaattgcaaattgatttacatttgtctataatcttactgttatctattaatcttttctgtttcttggttccttgtttccatatttattgcttattttcagaataatacctgtttgtattaacacattacctctctccctattagcttattggatatatattcttttattatctttattttaggggctacaactcattacagtctttttcatacatttgccatttccttggcaatgcaaagatcccaaacagcccatgccccacgcctgccttttatgctattgttttcatgcattttaatcctacatatatttgaaaacccacaagacattaatattattgttattttaatagtcaacgttctcttacactatccacatatttatcatttccagtgctctgcactctgtcctgcattatggtgtttcaatctgggattattttctttttgactgaaaaattcccataaaagtcacaatacaaaaacctgatgtggaaaaattcccttcgtttttgtttgcctgaaaacgtcttaatatcatcttaatgtttaaagcatattttcattgggtatagaattctaagttgtagattttcaacatgtcattccattgtcttctcacttctttcattttattgcatggtcagctgtaagtcttattttccctgttaagtttaatttgtcatttttctctaattacttttgagatttatcaacttgtctttgattttcagcaattttttaaatgaattttctagatatagttttcttctttatttaacctgctggggttttgtagagtttcttgaatctctgactgatggcttttatctttttggaaaattcttaggcactatttctacaaatattacatctgccccattctctctctctgaattcaaatagaatactgattacatggatgttagaacttttttgtattatatatatatgtaacatatatatatatacacatatacatatatgtatggacacacacacatatattctgatatgatacatatatatacatatatatcagaatggtctgtaataaaattttatccatttatctctatgtgcttcaatcaatattttattacaaggttatggtataacatcctcttgaattgatattgttatcattatgaaaaaatgatattacctaaattccagtttactacaggtgttctcagatatgtcaaatctactattaaatttatcattatacttatttatttcagtgtatttattagttgcagtatttccattcaattcccccctctttttttttttttttttttttttttgagactaggtcttgctgtgtcacccaggctggagtgcaatggcacaatctcggctcactgcaacctccacctcatgggttcaagcgattcttctgcctcggtctcctgagtagctgggattaaaggcacattccaccatgcctggctaatttttgtattattagtagagatggggttttaccatattggccaggctggtcttgaactcctgacctcatgatctgcccgccttggcctcccaaagtgctgggattacaggcgtgagccaccgcacctggccaaaaattccctttttttttttgtagatgctccttatctaattactccattatctagattgcctatgagactgtttctcttgtctttctgtgttcatggtttttggccatttagtcttgcttcctacagggtctggtgacttaattaaaggacacacattgtgtataaaaaagtacagttgctctggatggtagtagcctattccagaaataatttaattttcttctggcaagcagatagaatatgaaaagaacacctcaatcatgtttaggttatgtttaatgcattactttcaatggcaaaaaccacaattacttttacacagaccttatatgactcagtaaaggccccaaaggaaatagtagaggtcttctttttctttttgagagtgtagctactaagtcttatttgtcttggttactttccaatctttcaaagaatattttacttaatcttcatattttgtatttaattcagtatgttttatttagctttgatagtcatgcttatgacagttcccgccttatctagaacccaattctctctccttccttataatatgttttaaggcatatttgcttccaagacaattttctctttctttgttttcttcctcactggctgttccttccaactgtcctttactgcccttcgttccttagacctcttctattctgtatctacctgcattcctcaggtgatttcatctagtcatatggatttaaatggcatctaatctttgagaatggtccacttttttttttctttctgatcgggacctcctaggaactgcagaatttgatatcaagctccttactggacatctccaattgcatatctaataggtatctcaaataagtaaaaaagccaagtgtttgactctccacaccctataaacttacacacagtattctcatctcgattgatggttactcactctaatcttctagttgctctgtccaaaattttgggtcatgtttggcttaggttttcctttcacattcctcttctaatttttcaaaaaaaaaaaaaaatcctgttggttaaatcctcaaaatagatccagattctaaattacaatctcgattgttatcactgaggttggagtaccattgtctctcacctgtcagattacttcaatagactcccttacagtctgctttttaacagaaaaaccagaaagattctttaacaatataattcaggtcatgttactcatttgctcaatactctgcaatggcttcccattttcctcatagtaaaagtcaatggtcttaaaataacctgaaaagtcctacacgatctttctcctatatatttttttttacttcctctcctacatttccctccctcatttactctgcaacagccaccctaaccttgatatgttaggaatattctaccatagcactttgcacttgctatttttctggcctggtatattctccaagatatccacaagtacaactccccaacctccttaaagttgtaactgaaacatcaccttctcaataaagcctagtttaacaccctatttaatattacaatctgctatccggttcacctgctttttcatagtacttaccatctcctaacatcctagatatctgcttatttttaatctcctctacttattttcatctcatcacttattgtctgcctctctttgttagaatataaactttacaaggatgtgggtcattgtctatactgttcaataatgtaccctaagcgcctgaattagattctcaaatatggttggggctcgataaataattaattatagagcaaaagaatatgtaaaatctgacaatttctcaccacctcaaattgctatcatcctagtccaagttagcgttagcatcatcacttgccaggataattgtaattccttcccaaaagttttcactattttctgccattccacagtcattctctatagagtagccagaatgattcttttaaaacatagggcaaataatgtcattcctctcacccaaaccctcaaaagcttcttctatcactctgagtagccacagtctgactccaggctacctctctgacctctacttttcttaccaatttcctccttgctcactgctgtctgtaatcttctaggccattccttgaactacccaagcatgctcccactccagggcctttatgattattgcaattttgttccaaaacactttttttcttagtgcttacatgacttacttttcctcttcctgcaggactctgctccagcaatattttattaaggaaggtgaatgtcatgtgtaaatcactcactttttacttgtttttgtgtgtgtttttttaaataaaatgtaacacctgaaatatatcgtactttctcctcactagattttaaatgccatatgaactgaaattttttttaccattaatttctcaattgcctatggaacatagtgggcattcaattatttcttgaatgaataaataaataaatagtgcagccattacgagcttagactttgaagtcgtataattccctttataaaatgaatattaaacatagtaatattgtgttggttagatgatattgaaacatgtgaagaatttagtatattgtctataaatatttaataaatggtagtgatgatggaaagagaaagcagggtctaggtttgggaacataaatgagaaaattattatgtgaaccctttgaatttttaggtggtttctttcccattatgttaacaaccctgcattgggttggtgtggttaccaatttgtaaaatttggggatggattaggacatttctagcaagcttagctttaaaagcacagctgattccattgagcaaaggaagaaagtccctggagtaggtttctgccttgggcatctgtacttgcatgtatgtgtaggtttatatgtgtgggtatatagctggtcatcattaggcatagattccatatttgtgagttaatctactcattagaatttatttgtaacctcctaaatcccccaaatcaatacttgagttgctttcacagtgtttttatggtcatttgtagacatgcatgtgcacaaagcagtggaagcattgtttcctgataggtgtgtttccagctgaagtcaaacaaggcaatgctctatcatcttgtttcacttcaacaagtgtcctttttgctatttgccggcacatattttgcattgtgtgctttttgatggtgatttcatggtttaaaatggaccctaagtgtactgctgaagtgctgtctggtgtttgtaattgcaagaaggctgtgatgtgctttacagagaaaatacatgttttagataagcttcattcaggcatgagttatagtgtcttgtccatgactgcaatgctaacgagtcaacatataaattaaataggtgtttttaagcacaaacacacatcaaacaaggttatgcattgattggctgatgaaaatgttgtgaccagagactcacaggaacctaatcctgtgttttccctggaagcaaagattcagtatttaccaattcagtgtttgcaatgactttatagaatttaattgccgccaacaacatgaccatgtggattgtgctagcttctctctaggcaggttcagtgtgcaaatgagtggacagatatgaatattagccatgttaacaataaacagatgctccatttcccatttaggtgaattagggtccattttaaaccgtgattaaaattaaataggcaatccctttggctcattctaagtgaacaaaaactttctgggttgttttctttagaaattctactcaggaggtagaagtgctgatccctcatcagaagttcccaatgcacagaagcatacacttccaaagatcttctccattagggaataagtttagcatataaattaagagcacagactctggaatccaaagcccgggctcagatacagtccccactacttcctaccaatgactttagtgaataatctccctgatcctctgttcgctgatctataaaatgaggataatgataggatctacttcataatgttgttgtgaagcctaagtgaggttcccaggaataatgattaacagggggcttcatacatacatagtaagtgttcaacattcactggccattattattcttggagtaataataatggttgaaaatttggatttcatttcctccaggaatggtgaaactgacagtttaaaataaattggataggattcaaaaaatgtccatgcagttacacttctaattcactcttctgcctccggcatttctttcagaatcctaaggaatacttgttctgacataccgcatgaaaatcctggcccaggccttggtttagactcctttccttgaaaaagaacaaggcaggactaagggctaagaatgcggtgaaaagaggaaagggcagctccctgtcttgagggtcctgttgctcttaatctctcctctccactccacttcccacatctcgatgtatccggggaccacttctacagcaagtgcctgacaacttccttatggaatatatatccctgctaaagaatccagatcatagattttgatcttcattgtaagtttagtatgtcaaagctggaggactcttaaaggttagtatctagacagaatgagatggttaattttatgtgttaacttgaccaggcatggggtacctacacatttagtcaagcattattctgggtgtgtcttcgaggaaatttttggatgagattaacatttgaatcagtagactgcctttcccaatgcaggtgaacctcatgcaatccattgaaggcttgaataggagggaactcatgctgccttactgccttcaagctgtgatatcagtttttcctgcctttggactcaaactaaaacattgactctcctgggctctagtgtgccggcatttggacaggaactacactattggctctcctgggagtctagcttgctgactgtagatcttgttactggtaaacatccataatcacatgaaccaattccttacagtatccctttctctctctctacacaaacacacacacccattagttatgtttatctggagaaccaatacacagggatcggaataatgcctggcatatgttgcatgccctcctagatccctggtagaccttcttctccattgagaaccaatggatcttctcatcacagtgcttcaggaaatgagacagttcagagctgggctcagggcttagttctctcaacttctagcctggagctgtcttcattccccagcagcctctacccacatgacatattttcttcagctccatgtcagctgatacagtttggctgtgtccccacccaaatctcatcttgaactgtagctcctcccataattctcacttgttataggagggacctggtgggagataactgaattatgggggtggtttcccccatacttttctcgtggtagtgaatatgtctcatgagatctgatggttttataaaggggaaacccccttcgcttggctcccattctctcttgcctgcagccacgtaagatgtgccttttgcctcctgccatgattgtgaggcctccccaggcatgtggaactgtgagtccattaagcctccttttctttataaattacccaatctggggtttgtctttatcagcagtgtaaaaatggactagtacatcagccttatagactctccacataaaatggaataaagaccttttggggcaaatgacatgcctcaggcatgtctaagcaaagtctaagctttgaatatttgttcgcttatctacaagctgtgtgacattgggcatgttacttaaccttaacctacataagcttgtgagcctgggttttctcatctgagaaatgggggaaataactatactttccccataatgaggttttcaagattatatataaagtatttagcatactctctggcatacaggcatgttaaagaaaaaaattattcatgacatttgttaaagcagtaaagcagactttattcaggactatcaacataggttatagggactactgtgatggggttttgtagtagaagagagagattgaaatgcaacaagggaaagtggaaatttatagccaaacagcatggtgagtgggggttagtggatggaaaattaccaatagaaaacatcaggagtaagagaggattctggctaaacaaacctagcagggctcttgctgaagacaggccaaggtgatcatacatcacctgggagatggtggagggtgaagaacctaatcaaatatcaagggtgggggattctggctataccaacttagcaagattcttgctaaaattgggtgatgcaaaaacagacatagaagtccaaaagtcaagacctagatgggacaaggattcagaaaagtctaactaaagttgggttaaggagaggagttttgtcagtaagcattcaaaagtgttagctttaaaaaaaaaaattatcacccagaccactatcagattcttagaatactcaatctaatattatttattcatttaggaaccccatgcaaagttgatcagacagtaaaccagtgaggtctgtgtggatactcaccaaatcaattatgccaatgttattccagccttgcattatagggagaaaagaaataaacgtggggatgacccagcagcctcccagcattaatgcgatgcgcagaggggtcatcttgttcctatagaccaaaggctggcagcagatggcgtaatacctggagagagaatagagggcagagcataggcatgggcaaggaggaatgggagggagagaaaagagaatatatgagagagaaaaggggaggaagaggggatggagcaagggatagagaacagcaaacattgaggagaagagtcggaggggaagcagagaataaaaataaggaaataaaagaaagaatacagggtaaaaagaggagagcaagtggcagaggaagggaaaaagaaggaagagagagaaaagaacagaggaaaggaaaagtgattatataatacaacatgatatactggcctgtgagtttctgttaatataaatattaatatatactttggatcacatctgagaatcattgcctgcagttggccccacagtcctctccatctcccaatatctggaggagctccacacacaccagaaggtcttttctatttctggcactgttccaacactatcccgatgcctgtgcattgaggagcctctgcccagccctctgggcctcagtatccaggcaactgtaatctatttgattacaacttgaggtgacccaggcatagctctacatctgggctctaaccactgtgtctcagatttgtccccttacccttgatcacctgcctacatggaagtggagctctaagtccgtgtttttttttttgaattgtggttcaaggattcccctccatccccccatccctgccatgctgaatcaaactcacctgaggaagcctttttaaaatgcagatcccaaggatctcctgaatcagagcctgttggtgaacaacctggagcttgcatgttgacaagtgtgagttattactaagtgtgagttattgttaaggatactcagtttcctccttccaaacacgtacacttcttggcatccttacggctggataggaccaagggactagtcctgaccaatgaatcatgaacagaattgacatgcatcacttctgggacaaaccatttaactgtttctgggatactaagaatgtaaaattttgaatatttcctgctccatcatttcctgtctactggatgagaccaccccacttccatttattagagtctgacctctctcatgggacacagtgctcactatcttttgattccatgttctgcctatgatactaactttcttcctgcctccagaaagaggtacaatctgcccattcaacagtctggcctctaacttctagaccgttcctgcatgttactctggccttggagatcacctcttccatgcccaggcatggcatggaatttcacaacaggcagaatgctacagtagatctatcattcatttctctttgggagagtacaaaatagaaatgcaaaaagagcctggaggctgtctattctttaaggttttataccatttaatgatgaaccaccctcatacacccctcattttatgcagttcactttgttaatttttcccacctcttcttttcttttcttaattcaaagcctaactaacaaaacaatggctatattctttgaagaggtggtagtaggatgggttgagagagagggtggaatgaggagagccccgtgttggagcacgaggagcaggtgcctcaggagcagggagaggagaaatacccgctttcctacaaggcactgaggagcagctgacgacattgtgccaaaagctccttgtagctggcaagcttggtggggtgtcctgatctgggccagagtgcaagaaacaacaaatcaaagaatgggagactgtcttgctccgaaaaaccattgtctccattataattctgacatggctgcaaaatcaaactaaagataactcagtcattgaaagaatcatgattagctggattccctccacactgttggcttacaagaaagacaaattatatctgagtagcaaatttttctgaatggtgatattcataatcatcagaggtttattattaacatagaattaatgatgaatttgaagtggatgaaatatactctttttttttcaaattttgtttccttcttgatttcctgttagggggcaagtttctttccatttagcatccttcttcctttctcttgttaatagcacttcaaatccttcgggagttatctctttgctgttgctatagtgctgttgggaaaacaaatgatggggctttgacttttctagcctaggggtgacccgatcagactttctcctaggactcaatgtcctgcagagggatgcaaggtgggcaagtcagcagagggctttttatctcagcagcagccccctggtagggctggggattcattcctgctccttggatcttttgcagcatgctcttacccatcaagtcctcactccttagctctctctttaaataaaccacctcatatatttccaataaattctctttttgcttaagctggtgtcatgggttgaattgtgtccttcctcttccaaaagatatgttgaattcccaactctcagtaaccttggaatgtgaccttatttagacataggattttaaaagaggcaatcaaattaaaatgaggtcttcagggtgatcctgaatccaatgtgactgatgtctttatgaaaagaaaaattttgacacagaaactgatatgcacagtacgaaggtggccatgagaagatggaagattggagtgatgcgtccataagccaaggaacacttaaagttgccagcaaccagcagaagccaggaagaggcaagaaagaatccttcccctacaagttccagagggataatcgccctattgatacctttatttcagacttctagcctttagagcagtgagacaacaagtgtgtattgttctaagccatccagtgtgtggtacctgttatgacagctttagcaaactaatacagttggctaataacaatctcttgcttgcaagaaaagtataccacttcacacagagcagtaaaactggcttgaatgccagatatatctttcatagtatacttaagtaagaatatcttttgtttcattcaatatactttcagatcatagctcaagttttggcatcctttcttctattatcccaaaaaggcaatagagggataaatgaagaatgaattctgccctatctttgttgtgtaatcaatataatttttgaggtttagaatgaggtgccgagatgttgccaagtaaagagcagatttcagaaattttggttggatctctaacgtcacaaaaatccaaaagttcaaaaacacaaggccaaattaagtatcctataggacactgttcaccacaaccaaggtatggaacctacctaagcatttattagtggataaatgagtatagaaaatgtggtatatatatacatgatgggatattattccatcataaaaaaaataaaatcctgtcatttccagcagcatggatggaactggaggacattatgttaagtgaataagccaggcacagaaggacaaatattgcatgttgtccctcatgtgagggagctaagaaaattgatctcatggaggtaaagcataaaatgatggttaccacaggctgggaggggtagtatgtagggggagtatgaagaggggtcagcgaatgcatacaaaaatacaattagatagtgggaataagatctagtgtttgggcagcacaagtgggtaacttgttaacaatcacttattgtatctttcaaaatagctagaataatagatttggaatgctctcaacacaaagaaatgataaatgtttgaggtgatggatatcccaactaccctgatttgatcactacacattgtatgcttgtatcaaaatatcacatgtaccccataagtatgtacaactattatgtacccataaaatttaaaatattttacataaataaataatatcttgcaggacaaaaagtacgtttcagaaagcaggatgtcttacctgagaagattctttgatttccataaatggatgtggatgtttagagggttatgttgggaaaataatagaatttacaagagggctttagaatgtatggttatattggtgctcataacatttttatgaaagcctttctttctaaatctagcttgcccagggctattgccagtttcccttgacataatgatcatcccatgaacaataatattgccctacattctgttgtccaaatgttctatgctttaatttgccttaccctagatttctaggagctgctgctatatagaattaaatagtggtaacaggtttccttttaaaattcaacttaaaggaggatactgtgaatgtagtacacattttaccaatcccttacacattttttaatttgaaacagaatcctgttctgttgcccgggctgaggtgcttatgtgatcttggctcactgcaacctccgcctcccaggctcaattgattcagctgcctagcttcctgagtagctgggaatacaggcgtgcaccaccacacccagctaatttttatatttttagcagggacagggtttcgctatgttggctaggcttgtctcaaattcctggcctcaagtgattcacccgccttagtctcccaaagtgctgtcattacaaacatgagccaccacacctggcccccttacacattttacatatacagtcagttccctggaaaatgcttgccagaagtaaagtgcttgggcaataagcccaactcgaagggtgctaaggtggaatacatccaaacatgcccaaacacagatgtagaaatttgctcttgcaggatctagggtggttaggcaagggtgggaagaatcctttatctccttttttaaaattatcaataagtaaagggggaaaaaggattttattttacttaaatttaaattaggttaggtagattgttagtgacaggtaaggatatgaataagaaaaatactgaattatgtctaggtatatgttttacttgcattttgacctctgcagcttcttcaatgtggtcctctgtcttacagtaaacataatttgatttttgagtgggattgagtatagaacataaggttcttatttggagctcgaattctagcatctacttaactttatgtgctgaagattcacaccaagacctggcacctttgaggcagcagccctaaataagtcacctcatatccttccaatgtctttctgatctttgctttcgagcaaaaaatctagaaaagtaaacatcctctgaaggctggactcaagaatgcaaattaagtaggtgaaaaaaaaatcactgaataaagggattaataaaaattgagttctagtgttaaccgatggtgcttccttaaaattttaatatttgtctgtagataagactagatagaaatctgataacttgacttttatatattgcagttgattttcagttcctatatttggattataatgtccccgttaataacaaaaaggaaactgacctatcatgaactattcctgcaacacataaacaccaccactagacagaattagctaattaaatttgcaagttctttggagggaggtaaggcaaaatgcactggctggtttgataataatagctagtatttatttactgaccaagggctctgctcatttgatctcatttaatccgcacaactattagattggtgcaaaataatcgtggtttttgccatcaagaataatggcaaaaaccacgattattttgcaccaacctaacacttttgagacaggaactgtaaatatatccatttcacagatgaggaaagggaagcacaggagtgttcgaaatttgcccagtctcacaggtggtaagaactgagctggcatctagcccaggcagactcactcaagagccaggacataaacctcctatcatttcactcagctgcctctcccattgaaaagccactttggaaacaatcaaaacatgaacatactgaatctcagaacttgaaggatgctaagaatcatgaaatcctcaagtcctctgatatggtttggctgtgtacccacccaaatctcatcttggattgtggctcccacaattcccgtgtgttgtgggagggaccaagtgggaggtgattgaatcacgggagtgcgtctttcccatgttgttctcatgatggtgactgggtctcacaagatctgatggttttataaaggggaatttccctgcacaatctctcttctctagtctgctgccatgtgagacatggctttcgccttctgccatgattgtgaggcttccccatccacattgaactgtgagtccattgaatctctttcttttgtaaattgcccagtcttgggtatgtctttatcagcagcatgaaaatggactaatacagtaaattggtaccaggagtggggtgctgatgaaaagataaccgaaaatgtggaagtgactttggaactgagtaacaggcagaggttggaatagtatggaggactcagaagaagacaggaagatgtgagaaagtttggaactttcttaagacttgttgaatggctttggccaaaatgctgataatgatatacacagtaaaatccaggctgaggtggtctcagatagagatgagaaacttgctgggaactggagcaaaggtggctcttgttatgatttagcaaagagattggtggcattttacccctgccttagagatttgtggaactttcaactggagagagatgatttcgggtatctgatggaagaaatttccaccaggaagaaatttccaccatcaggaagaaatgttaagcagcaaagcattcaagaggtgactttggtgctgttaaaagcatttagttttataaggaaagcagagcataaaagtttggaaaatttgcagcctgacaataaaatagaaaagaaaatcccattttctgaggagaaattcaagctggctgcagaaacttccataagtaacaagaagctgaatgttaatccccaagacaatggagaaaatgtctccaggccatgttagaggtctacgtggcagctccttctatcacaggcctggaagcctaggagaaaaaatggttttgtgagccagacccagggtccctgtactatgtgcatcctagggaattggtgccgtgtgtcccagctactccaggcatggctgaaaggagccaacatagagctcaggccatagcttcagagggtgcttccatgtggtgttaagcctgcgagtacacagaagtcaagaattaaggtttgggaacctccacctagattacagaggatgtatggaaatgcctggatgcccaggcagaagtttgctgcaaaggcagggccctcatggagaacctctgctagagcactgcagatgggaaaagtggggttggagcccctgtgcagagtccctactggggcaccaactagtagagctgcgagaagagggccagcatccccagaccccagaaccagagatccaccaacagcttgcactgtgcaccttgaaaagctgcagacactcaatgccagcctgtgaaagcagatgggagggaatctgtacttagcaaagccacagcagtggagcttcccaagaccatgggaacctacctcttgcaccagcatgacctggatgtgagacatggattcaaaggagatcattttggagctttaagattttagtgccccactgtatttcagacttgcatggggcctgtagcccctttgttttgctcaatttcttccatttggaatggccatatttacccaatgcctataccctcattttatctagaaactaattaacttgcttttgattttacaggctcataggcagaagggacttgccttgtctcagatgagatgttggactgtggacttttgatttaataccaaaaggagttaagacttttgagggactgttgggaaggtattattggttttaaaatgtgaggacgtgagatttgggagaagccagaggtggaaggatatggtttggctgtgtccccacccaaacctcgtattgcggctcccacagttcccatgtgttgtgggagaaacccggttggaggtggtttaatcatggggtgggtgttccccatgctattctcatgatggtgaatgggtctcaaaagatctgatggttttataaaggggagtttccctgtacaagctctcttctcttgtctgccaccatgtgagatgtgcctttccccttctgccatgattgtgagtcctccctagtcacgtagaattgtgagtccattaaacctctttcttttgcaaattgccaagtcttcagtatgtatttaccagcagtgtgaaaatgggctaatacatcccctctaaaatgaagtgtgtatccaaacccacttaatttttctagggatttggaattcaccaggtcctactgcagtacattctaaacttaagggcatcctaaagttaagaaagtttcctctaaaaatcaattttcggtaacttgtagtttttccctctggcttaatttaaatttctatctaattctttttctgcatagtggttctagtgatatctgaagagagcttttacatccctctgaagtcttattttctgcaggtaaaaaattccctgttgctctcaaccaggggtgactttgctcaccaggggacatttgacaatgtctggagactttgttgttgttgtcacaattgggaaggaaatgctactggcatccagtgggtagaggtcaggaatgctgctcaacgttctacagtgccccaataacaatactggtctatgtcagtagtgctgagattgaggacccctggtttagatgagaggattttcaccaatagcaggagtggagctccttgtcctctgtatgtgctataacatgtcgttatctcttaagagtggggtgccacaaggacagcactatgttctggtgcatcctatatggaccaaaaaccactgcattgccttccactttgctcaccataacttaatatagcttaggggatacccagaagcacaggacacctgtgcccctaaaaaagaaaatgatctaggacaagaggtgggaaaaccgtcccccaactgatgtataagttccatgaggacagcaatgtttgccttgttctgctttgtgtccatgatggctagtacaatgccagatatattgtggatactgacaaactggatttttaaaatgtaataaactctcaatcactaccaagtacaataaattccattaaaatatgttaccaggttttggagatgtgaacaggcatatctagcagagggatggggaaaggctttcttcaatagcggttttttaagtcaaatgttagagactggatcaggatggtggaggagaaagtgtaatctaggtgctgtagacagcatggccaaggcctgaagagagaaattatatatatgaaatacatacccataaatgtatattcctatatctatatagccctataaacataagagtaaagttaatgaaattgtagggtgttcacaaggaagtagacaaaaataagcctaaaaaggctgactggggcacgtctcagagcagtggttctcaaattgtatcatctgtcagaatcacttaaaggatttgttgaaacacagattgctggtaggtctggagtgaggcccaataatttgcatttttgatatgttcccaggtgatgctgttgctagtggattggagaacacactttgagaaccattgtcttagaggttttgaatgttaggctaggaggagttaccaaaagatttttaagctggaaaacgtccatcgtaatcaatattgctgtgtgcttttctaaagaagctgaattaaaacgaagtcaagagaaagagttgttgattcatatgctaggtagacagtgtttaacaggaaaagtaattgtctcatctcaggaatacatgaatcagcaaaatttgttctccagccttccattgggtatctcccattcttccttaaccagaaaacttttacaaagtagttaaatgaatgttcaaatgatgagtgaggttccagatggccaggattaactaaaatgaagcaaggatatttacaaagtaatttcttatgcaaaacatttcaaaagtattgctcataaaactccattaaaatctgcttttgtagacccagccaccagcttctcccactgcagccatgtgcaaatgtgtgatcaaattgcttttaaatgtctctggggacacaatttactttgacaactcttagtaggcagccatgtattttaagctccatgctaatcccttccgtgctccttctgcaattaaggaaaattctacttcctcacttcctgccctcccaaccacagaaaaggcacaagaagcaatgataataagttggaattctagactgtcagaattggaggagatagtagcagtcaactttacgtcttcaccattgggtaccaactttccctgccttaactccttagtagctctgtggtcttagaatcagttactaacctcaagaagatccagtttcttcatctttaaagttagaataattatgtcaacctccaattatgcctctccttcactgtgagaattgatgaaataatatgtttaaaacataggaagttcttggcacataaatatctgtttaatacatattattataaacagactcaaatatattttggaattatgagctctacattatttaacaaataataaaaagccacttggttcaacatctttccctaacagttgattctaagaaatataaaggtgaatgaattggtctctaaaggcaaatgaaagcattaagaccatatttgttatgtgcaatggaggtggttacatgtaagatctagtaatcatacattgtcgcttaagctgctgagttttgatgtagatgttacatgccaatagataacaacagggtaaacaggtcatgtatagcttggcaaaaccttccaactgggttccctggccacctcttaataggtgcatttgggctggtaacaggtatgtaccttcctgggatgaagctcccagagtgaggggcaggctgccatctttgctgttttgcacttttcactcttgatacctccatgtagtgggagatccaaggtgactagcaactggagcaggcccccagcatactgcagtagccatatgttaaagtagccagacttaagtgggtacctgttcccatatctcctcaccaggcaggtcctccaggcctgggcctccagccatcccctgccagaggtattgagccagtagcaactcaggacctcccgggacagagactccaggggcaactgaaagcctctctgccactgcttctgcagtggaactgcccttgctacccttggactaatgaaggagtaaagaccctaagtgccttctctacacctccaacaagctgcacttgacccaaggagaggaggccagaccatctctcatgggtcccacctactccttctgcttgcaccagacaggtaacccctaacttgggccccagcacatacccttcagtctgggctgactgcactgagcaattcctgacctcaatctctctggggtggagcctccaagagataagcaaaagacccttgtccacaaccactactaaggtcccttcctctgctgcctccaagtggaggaaggaatatgaatactgagattgccccagagctacagtcagcagcccaggagttccaagccatgatctgcagccagcatgcaagtgggagaggaacccacaccttcagagcatttagagggaacacagctgcaactgtgaggaaacaggggagccacacaactgagcaagagtctaccaattgaccatatgtctaagtgccacccacaggaccacacctcgaagcttaagcatcaaaaatacctcatttatatacccacctctgaaaccaaagacaagaagtcagcttcaaataaagactgtacacaatgccttggccctgtgaaagcaggcaggaaaggagtctattgactgtattcaatctacactgcagttaaaggaatacccacatacagagatgagaaacaaccaatgcaaaaactctggtaattcaaatgaccagagcattgttatgtttccaaatgactgcaccagttctccaacgagagttcttaaccaggctgagctggctgaaatgacagaaatataattcagaatatgaataggaatgaagagtatcaagattcagcaaaatggcaaaacccaatccaaggaaaccaagacacacaataaaatgatacagaagctgaaggatgaaatagccagtataaaaaaagaacataatggatctgacagagctgactaacacaacacaagaatttctcaatgcattcagaaatttaacagcagaataaatcaagctgaggaaactttctcagaacttgaagattgtctctctaaaataagacagttagacaaaaataaagacaaaataattaaaaggaataaggaaaacctctgagaagtataggattatgaaaagaggccaaatctacaaatcactggcatccctgaaagggatggggagaaagcaaacaacttggaaaacatatttcagaaaatgatttatggaaactcccccaaccttgctagaggccaacagtcaaattcaggaaatatagagaactcctgcaagattctacacaagaagaccatccccaagacacataatcatcagatattttaagataaaaatgaaagaaagaatgttaaacacagctagagagagagagaggaggtcacctacaaagggaacaccattagtctgaaagcagacttctcacctgaaaccctacagaccagaaagaatcgtagtcctataatcaacattcttaaagaaatatcttcaaccaagaatttcatatccagccaaactaagcttcctaagtgaaggagaaataagattcttttcagataagcaaatattgagggagtttgttaccaccagacctgctttacaagagatcttgaaaggagcactaaatatagaaaggaaagactgctaccagattatacaaaaacacacttaaatacacagaccaatgatatataaagcaactacacaaacaagccagcataataaccagctaacaacacaatgacagaatcaaatccacacatatcaacattaaccatgaatgtaaatggattaaatgcctcacttaaaagtcacagagtggcaagctggattaaaaaaaaaaagtgtgacccaatggtatgctgtcttaaagacactcatctcacacgtaatgatacccatagacttaaaataaaggaatggaggaaagtctaccaagcaaatggaaaacagaaaaaaacagggattgcaatcctaatttcaggcaaaatagacttcaaactaacaaagatcaaaaagcacaaagaagggcattacataattgcaaagagttcaattcaacaagacctagctatcctaaatatatatgcactcaacacagaagcacccagattcataaagcaagttcttagagacctacaaagagacaacaatgcccacacaataatagtggaaggcttcagcacttcattgacagcactagacagatcactgaggcagaaaattaacaaagatactcaggacctgaactcaacattgaccaaatggacctgatagacttctacagaactctccaccccaaaacaacagaatatacattcttctcatcaccacatggcacatactcttaaatcaatcacgtaattggacataaaacaatcctcaacaaatgcaaaagaactaaaatcatatcaaacacactttcagaccacgatgcaataaaaacagaagtcaaggctaagaaaattactcaaagtcatgcaattacatggaaattaaaaaatatgctcctgaatgatgtgtgggtaagtaataagattaaggcagaaatcaagaagttctttgaaactaatgagaagaaagatataacataccaggatctatggaacacagcaaaggcagtattgagaggaaattcatagcactaaatgctcacatcaaaaagttataaagatctcaaatgaacaacctgacatcacaactgaaagaattagagaagcaagaaaaaaatcaaccccaaaaatagcagaggacaagaaataaccaaaatcagaactgaattgaaggaaatcaagacacaaaaaaacattcaaaagatcaatgaacccagaagttaggtttttgaaaacatgaagaagatagataggatactagctaaagtaataaagaagaaaagagagagatctgaataaacacaattagaaatgacaaagaggatgctaccactgatcccacagaaacaaaactaatcagaaactactataaagacctctatgcacactaactagaaaacctagaagagatggataaattcccggacacatacaccctcccaacactgaaccaggaagaaactgattccctgaacagaccaatgattagctctgaaattaaatcagtaatagacagcctaccaaccaagaaaagcccacacctgatggattcacagcctaattccaccagatgtacaaagaatacctggtaccattcctactgaaactattccaaaaaattgaggaggagagactcctccccaacccatcgtatgagaccagcatcgtcttgataccaacacctggcagagaaacaacaacaagaagtcaggccagtatccttacatgaatatcaatgcaaaaatccctaacaaattacttgcaaactgaatccagcagcacatcatatagctaatccaccacaatcaagtaagcttcagcctcaggattcaaggttggttcaacatacacaaaccaacaaatgtgattcatcacataaacagaactaaagacaaaaaccacatgataatctcaatagaagcagaaaaaggctttcaataaaattcaatagctctttatgttaaaaattctcaaaaaaaactaggtattgagggaacatatctcaaaataataagagccatctatgacaaactcgcagccaacatcataatgaaatggcaaaagctggaagcattcccctttacaaatggcacaagacaagaatgccctccctcttctaatagtattggaagtcctagccagagcaatcaggcaagagaaagaaataaggagcacccaaataggaagaaaggaagttcaactatgcttttttttgaagataacatgattctatatctagaaaaccccatagtattgccccaaaagctccttcagctgataaacaacttcagcaaagtttcaggatacaaaatcaatgtacaaaaatcactagcattcctatatacctacgacagccaagctaagagccaaatcaggaaggcaatcccattcacaactgccgcaaaaagaataaaatgccaggaatccacctaaccagggaggcgaaagagctctacaatgagaattacaaaacactgatcaaagaaatcagagatgacacaaagaaatggaaaaacattgcatgttcatagctgggaagaatgaatattgttaaaatggatgtactgtccaaagtaatttgcagattcaatgctatttctatcaaactaccaaaaacattctttgcagaagtagaagaaaaactattttaaaattaatatggaaccaaaaaaaagcccaaataacgaagtcaatcctaagcaaaaagaacaaagctggaggcgtcacctcacctgacttcaacctatactacagggctacagtaaccaaaacagcatggtactggtatgaaaacagaaacatagaccagtggagcagaatagagggtcagagataagaccacacacctacagctatctaatctttgacaaagctgacaaaaacaggcaattgggaaaagattccctattcaataaatggtgctgggtaactggctagccatatgcagatgattgaagctggacccctttcttacaccatatacaaaagccaactgaagatggattaaagacttaaatgtaaaacccaaaactataaaaactctggaagagaaactaggtaataccatcctggacataggaacaggcaaagatttcattacgaagacaccaaaagcaatcacaacaaaagcaaaaattaacaagtgggatctaaacttaagaacctctacacagcaaaagaaactatcaacagagcaaacagaccctacagaataggagaaagtatcttcaaactatgcatctgacaaaggtctaatatccagcatttataaggaacttaaacaaatttacaataaaaaagtcaaacaaccccattaaaaaatggtcaaaggacatgaacagacacttttcaaaagaggacatatatgcagccaacaagcatataaaaaagagctcaatatcactgatcgttaaagaaatgcaaatcaaaaccacaatgggataccatctcataccagtcacaatggctattattgaaaagtcaaaaaatgacacatgctggcgaagttgaggaaaaaagggaacatttatacactgttggagggaatgtaaattagttcaaccattgtggaaacactatggcgattcctcaaagagctaaaagcagaactatcattcaacccagcaatcccattactcggtatatactcagaggagtataaatcgttctaccataaagacacatgcacccaaatgttttttgcagcacccttcacaatggtgaagacatagaatcaacctaaatgcccatgaatgaccgattagataacaaaaatgtggtacatatacactatggaatactatgcagccatgaaaaataacaaaatcatgtcttttgcaggaacatggatggagctataggccattatcctcaggaaactaatgcagaaggagaaaaccaaatactgcatgttctcgtttataaatgggagctaaatgacgagaactcatgaacacaaaaaagggaacaaaagacattgcgtctacttaagagtggaggctgggaggagggagaggagtagaaaatcatattaggtactgggcttattaatacttgggtgatgaaataatgtatacaacgaacccctgtgacacagttcaactatataacaaatcttcaaatatacacccaaacctaaaataaaattttaggttttattttatgtgtgtgtatatatatatatatatatatatatatatatatatatatatatatataatcttatatataatttttataaaataaaaattttagaaaagatatttataaaaaataggtgtgatttggcatccagctgatcatgggagataagtaaaagatgacttcaaaaagttgtgtttcgatgtctgaaagataactaatagattcaccttcaatatacaatgtggaagaggatatagtattagtttacaataaaaatgtctacttgagcacactgaggtttgagaaaacagaaagatgtttaaggcaagatgctgagcagacagagatagaaccccagagcccagtgtgtgaaaggggtgagggagagacaagagcagaggtgcaagtgaagccatgggataaatgaggtttccaaaggaaagaggggacatactcagggctggaaggctaaggatctaaccttcaagggcactcagctatgagtcagaaagaacaagatgactatcagtgtctgggaaggccctcgctacagccactaggaatttgcatttagagaggaaaacaataatggaatagtccttgtggctaacattaattgaacacttaccaagtaccatgcactggtctatgcattattcagtttattaactgaacaataaacactcagttatttattcctcacaagtcctaaaagagaagggaagggattttctattaataacacaatttttacagataagacaaagtccagaaaacctttgtcacttctccaagatcacacacttgacaaccagtcaagctgtgactgaatctaagcagcctagcacctcaggtctcattcttaaccactttctatattaagagttctgaggacagagaaaccaaccccagcgtcatacaaacaaccacaagtcacatctcagcattcagtgctcagccaaacatgcatggaacagctattatgttccagaaagaaaaacacacgaatagataagataaggcctactctcaagaattttatattctggagcaaggcagacaaatcaaacaattattgagacgcacataataagaaacttctattaaccacgatgctttgattcaatactccatgggagctcagaggaagaaatgacaaatttttatgaatgaagcccaacagtcattggagaaggcgacacatgttatctgagtattgaagaaaggtggatgtttgccagaaaaataaaagaaacccaaggcacaggtagcaacatgcagttatgaggaaacatatattcagggaatgataacagatcactcatgggtaggagttgaggtaggaaaatcagactgagaacacattggaaaagcagtgaaagctgagctaagaatttagcttttagttaacaagggctttcctatgggttttcacatgcgttttcaggagcagccactccccaggcctcaccaacttccctatcccctactgatacccacagcccctgcagatcccggcatcagcatcacttgctcaggagcctaccctgctttggagattgcaacttagcagactccaatagctttttttttttccttctccttatagtattcaatggtcaccaattttactgtaattatctgtttactgtctgtattcccaactagacaaaaagttccatgattcagagtttttctgatcattcaccactgtatttacaatgtccagaacaactcatagtaattagtaagcactccataaatgtttgatgaaatgaatataaaaataacagttcaaaccctctggcatgaaattcaactcaacaaatattatgtacaaagcctgaacctgccctaaaagagtatgtgagaaggagaaacttttaatatactttccttgtgaaatgcatttcaatcctattgggaaaacaaatgtaattgtgtgacacagttcacaatgacagacacttttcatttatacattacaaaatcgaattatactccagggagatcattaagaaaatgcagatacatttatctccagcacaagattaaacatgcaaccttgaagtaagaattgtatgttttacaagtaaacctgtttaaaagaggatcggagactaagaaactgttggagaattttgccgataaaacacatcaaatttttgagctgtgcagaggaagggtgacaattcagctgggtgtatccaaaaaagaatcttgcagtactatagagaatactatcttcaaggaagtgaaattgactttttttttaaaaagggaattacatttaatgctaagtaaaggacaaagtacagcatgttcagagaaaggggataaaaatggttaaaagtctgaaaagtatggcttatgaggccagcagaaggatctagaaatatttggcctaatatagggaagacttggggatgatatacctctgttttgttgtggaggctccataaagatacctgtagggtctggccagcctaaggggaactggtatctcctcttcttgtctgcctaacacccatctttccagtgagaactgctatttcttcacaccatatgtttttggtaaagctgggagtcatggtgcctgacctctgcccagtaaccaggatgtgtcatctccacaccacagtgactggttaagtgaagagtgtttgacacaagcaaagccaacggaaattcttccatgagaaacagcacttaggtttctcttcctatggactcatgtgttaaggatggtttaagatttgttgactgtgactatttttctttcctggtggaagaacccagcctaagaaaaaaatctaacaagaaaccagagctgatggacagcatagggacaaagagggacagatagaaagagaggaatagacatagggaaacagagagggaagtaaacagggagaacaagaaggcaagatggagacaaagaggagagggaaacagagttagagaggggcaaagttagactaaatgacattgttcaaatccttgtagagagccatgtctgaagccagacttttcagttatttgaacgatcaatttattatctgccgcatgctgctgaaagaaaccttgctaatagatcatccaataagcaagttggtaaaaacattacattcaggcaactcactggcatatatcataaactcaaaatatattcaaataagtctgcttattacatatgaaatcactggcatttacaggcagttgctatttacagtggttacctcaggttatgcagctgtggaagtggatattgaaagaattggggacattatgttctacttgtgaactgatggcattttctacaatgctcaggtattattaatattgtgacttaaaaaatctgtgaggattagaaaagggactgttagaaaaaaatcaaatacaagcttgtgaacagggaggaggttaaccaagaccaatgtaggagtgatgcaccccgtaagagatggtgagggctcccttagagggagatgtgagggtgtttgatgagaaagcagagagaacacactggtcaggaagatttccatgctccctggcttgttctgacctcagagggaactcccagcactgaagcagaatgttctcagagaactgaggaatgtgccattctagcaacattttcagttaaaaggctattgtggatggacttgcatttgagaaggttacgttctagcaaagggaaaattgaagtttaaaatgtgtattacagaaattagtaaaactgaaggcccccaaccccaatttaactgaccatccactctggccagcactacaccgtatgccctacccctcaaataaccacctgttaacgatttggtgaaaattcattcatgatctttctttttcattctcaatctctctctctttctttctctctctctctctttctctctttctctctctctccacctctctttctctctctctccacctctctttctctctctctccacacacactcatgtaaacccagatacatgcatctctatatttattttacaaaaatggaactatgctaaacattagagtctgccagttgctttttttcccccaacataatacaccagtgatatatttctaggacaacacacgtcattatttctcatggttttcaatggctgccttatatttcacttttaaaactagtactctatcatgactacttggttagcttttattcaccacagtactttagatcttaaaaaaatcaactgtactctaaagcttttaaagcagtttttgatctcctatgacccatactatatggtgcatttattttaattatgctttggaaattatttttaaggaggcaataaattcttattaacagaattcaattctgaaagcaccaggaagcacagtgagctgagaatgggagttgggaaaatgcattttgtagtactaaaggagtcctacattttgctttgatccaggagtctgccatctgagaagagttacaaattaaagtgagccctcttgctcaaaggaactaccccttatgattgatcccagaagacttgtagcagctctagagagaaggacatggcatactgccgggaataacatggctaacaaggacatcacacctcattgagacattcactctgtgctttggcccagcccagctgaaccaaactgttaggacgggaaggacacagcaaaaacagagctagatgataaataaaaccatcctcttccaggctaaaacattgccctgtaatgttcaggatggaccctccagcactatgagggaacgctcttgggacagggaaagctggagacaagctggaggcaagatccccaagctccccaaggaaaataaaacaaaagaaaccccatctgatatcttacttatggtattggagtttttgacatacactgtcagagaatgaaatggaattattggcatgactctcacaaagagaacgtgctgaccactccatttgttcaatcgtgtttgtcaaatacctaaataagtatttatgcaatgactgtttaattgtcaacctccccataacaatgcaagttctatgagggcagggatcttgcccttgttcgtagccttgggcttcctcccattggaatagaaagacatttaagaagaaagtatagacttgattttaactataattacactgagttctacaaaggagaaaaatggttttgatggagtcagcgaagacttctgcaaagaagagaagatttagctaaaatctgaaagacatgcaggagaggaggggcagaggaagttttcaggcagagggaaaagccaaggcctcaggtggctgagcagagagccctggagaactagaaagaaggccaaagcaactcgggcctggaggtgaggttaggaagggggtgaagggaagctggggacatggacaggaaacagagggtgaaaaaccttgtatgagtctggtcttgatcttcaatgcaatgaatagccactgaagggttttaagcaaaggagcaacagtattagagcagcattttaaaaggatggcttttgatcttgtgagcgacaagtggatggggagggaataaaacatatttggagggaataattaggaaagtgttgagtgatttcttcaagaaatgatattactttggatgaatgatagagagaaatagactaggatctctttaggaaagaaaatgagcaggacttgtcattatttaaatgtaggaggcaaggaaagactgctatcagaataactacctggtttctagatgatgcaagctgttggagcagctattcactgaggaggtgcaagtttgatgagaaagatcatgagttgtatggctagttacaagaaactgacatgaacaacaacatccactaacatggaatattgtgacaagctgggccaaagtgatgccttaaatggattatccaatttatacctaactgtagtcatataaaataggtgctatctccctaagttttagagacaagaaaggcttagactcagaaaggcttaatcacttattcccattcccagaactaaacattttaaaagctgggatttgaacccaaatctcttcaattctaaagcagatggttcttaatgaccaattcatcctgtttcatgacaactcatacctactcaggaaaagtttcctgatttgaaaagtacgtaggcataaatctgaagccaaacctgtcaaggaaacctctagaccttctctcagggctgcccacagcaaactctccacaatggacagttgattctacactttctcccattttttttcctggctgactggctctttttcttactcctgcttttacacaggccttgaggttacctcagctgcccctatcacccctgcctggtcttctccaaattcctgtagtactttcagtctcactactcattttaacaatgatcatatgcaggttacccagcaggatttccatagattttctacttccttacattgtatttcctataatacaaactttcattcagtgtatcctgactgtctttaaaagtctttcatgtactaaagtcagattgttgtaaacaagctaataaacacaaatttccaactatgccatgccatgggtctggttgcttgccatgagttcaattttaccagagtcattatctctagctatagagtggagtctcattatacatgcatttaacttaagcatattcaactatatgttcttggcagaggaaaagagaaagcaatttaaatacagcaggccattatgactaccattccaatcaatgcacatatgtcccatgaaataggagatgaacctgctgtcccctcagctggtttcagtctctaagtacctcccccagtgtgattaattctctgggaagactatgatgttagtgtttaaaagtgtgtatgttagatataccacaatctctagtttcagtcaactacttttcctagtcctcaatttaaaaaaaacagtgattgtcggtgaaaccccgtctctactaaaaatacaaaaaattagctgggcctggtggcgggcgcttgtagtcccagctactcaggaggctgaggcaggagaatggcgagaacccgggaggtggagcttgcagtgagccgagattgcggcactgcacttcagcctgggtgacagagcaagacttggtctcaaaaaataaaaataaaataaaataaaataaaataaaataaaataaaataaataaataaaaataaatgaaaataaaaataaaaaacagtgattgtctgagcacgatggctcacatctgtagtcccagcactctgggaggctgaaggctgaggataacttgagcacagtagctcgagaccagcctgggtaacatagtgagacttgtccctataaaaaataaataagaataaataaaactaaattttaaaaaagtgatctatcccaagactggaggaaaacttgggtttgttgggttgctcaagacacagtaagaaatcattgtccctggcaattctgattacatgtgatttgcaccccacatttttctgagagctaacccctaagatactactacattgataacagcatgtttgtgtagtcatctgactttagattgcattctacctttatgatgaaatgtaaattagcaggaattggaaaatgaatagtgatggtacaagtgataaatacataaatctgcaacaaatgaggcaaagatgaaaatcattaggtcccctgaagtcaaatatgaagaaagaaaataaaattatgccacaagaatgaaatgctagatctgggtccaaaaatcataaaattattgggaagtttactgtaactttctggaaaagagtctccacaattatatgcacatacataaatatgtatatcaaattattacagaaacatattttcaagaaaaggttatgttcaaacatagggcattttcattctgaaccacccctgctgccctctgggaagatgtactcattcttgatgcttagcttcttcagaattttgttcatgccatcagtataaaatttacagctctatagtaaacttgattgctgacatctattgctatttagattgcaatctccttgcagacaagttataggtcttactaatctgtgcatctacagtgcctcagagagggcctgactaaaaagggggcctctgcaaaggctggagaatgactgtataactgaattatcaaatttacctctctgagattcatttcttctaatgaataagaaaaggcagacactgcccaatatccatcaagtcatgtctccagcatggagctccgctatgcacattgttctgtccttacctatccagagaaatgcagcacaggtgaaaaatcgatgccgttgtgagcaggacgtccagagatgtccgaacaagacaaaacacctccccataaatccagatgtcttgaaccagctcaatggcaccaaagggcatcaccagcaccgaaaccagcagatccgcaaaagcaagagatacaatgaaataatttgtttttattttcctgtgagtgaaaaagtgtaagagaggaggcagggggagggatgaagggaaaaaggggagggagaagagatcaagagaaaaaacagggaaaagggaaacaaagaaagaagaaaagaagggagggggaaagaggaaagaaaaagtcacatgcttagtgtattccgtgagattcaatttccccttctgtaacatggctgagaagacccagcgtggtccagcctctcctgacttctccagacctaccttataccaaaacctcttttttcctcccccttctggccaccctgccctaatctgagtttccctgcacatataggtcccttttgagggccaatgcagatgttctttcttccaacggttgcctggttaatcccacccacccgtcagtccttggtcgggcattctcaggaaactctcccaaggtatgccctgtgactgtagtcacagtccaccattttacactagcagactggctactgtgtactcacatttataacactggtcagaattgcgcttttgcactttatttgcatcatcattagatgtgtggatgtcttacttagagaggaactgcttcgttataccctcttatggcccagaggctctcatcccaggctgtacactagaatcacctgatgcattttaataagtattgatgctgaggtctcaccccagatcagttagttcaggcaccctggggagttaacgcctctcccctcaaagattaccagatacaatacaggatgcctgattagatttgaactttagcaataaatcactttttaaatataactatgtccaaaatactacatgagacatactaataccacacgatgatagtttttcaaagtgcttcaggtggttctaattgcagccagggttgagactgatgaagtagaagtgcaaaaaacacaggtttaatttctagatctgtcccttgtcagccacatcttccctaaaccattaataaaatggggaggttagattatatgtgctctcaacaattgtatatatagtgatcacaactataaacacatttgacaaagaaaaaaatgacaggatggaaatacactgaaatgtttacactggttgtattagagttgtaggattaattgcaatccctttttctccccttttatttttaaaatgttgttcccatgaatgttttctttcttaattacaaattctaatagaaatgttcacacccaactctctagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtaacttcaccatcagctgatgacacatatatttatcatgcgtttaatgtacaccaaaatctgaaccggtcgcttgacattttatcctggttagctcctacataagaggagtatgaggcttagagagctgaattaacaggttattttccatccaagcacttgtggctttccttcagggcatttagttcaactagcattcagacatatgtagttgatgcctgttttgtgcacctactcaactagattgcaaaagctgagtgaatgaatgatagtaactttgcaactgcaggagcagcccaatttggtccaactttgtgtataaaatggtgagttgtgttttagttgccatggacccccaggttgcaagttaaactgaccaggcccagatgaaccaagcatgcaaccacagggtggaacctaagtgcttggaccaaggcatggggaccaaataaagaagtggacgtctcatggcatgatccacgatccaatcatatagagccctagcatcaccttgtggcataatccagtcagatcatacctcttggcattaacttatcacaagatccaatcagatcacaccttattaccctctacctataaaacctgccacagcccccagctcagggggacagatttgagctttgcctcctgcttccttgccgatcaacttacaatgaagcctttttttttttcctcaaaagccagggccatagtattggcttctataaacatcagcaaggagcccactgcttgctcagtagcaacttgaactggttgttactgagcaagttactttgcattcatacagttacttggcctgaatgcaaagccatcttgttacagtgtcccattccagcccatgcagaagcttctgcttacaggtaggttctcccagagagaaaagattgtggtgtgatggttgttcttacatcagttcacctggacaaattgaattcagattctgtgaagtctgttggagagatagtagccaataaataagctcagtggctcctttcaccaccctgatcatttcttttagtgcccacaatatgtcattgttttcccagttcaaatttgtgttcttgtcaagttcagcatctgatttagtctacaaatgttgccttccccatgtaaactcagcattttgttttattaacttgaaaatgaagatcccttttcaatgaaagcatgatatctgcagattaatattcagaagctatagggattttaaaaacttttatagtataataaaatgttctttttaatgaagtttcaaagaatcttaaaactcttagaccagcggtgtccaatcttttggcttccctggtccacattggaagaagaattgtcgtgggtcacacataacatacactaacactaacaatggctgatgagctaaaaaacaaattgcaaaaaaatctcataatgtgttaagaaagtttataaattgggttgggctgcattaaaagctgtcctgggctgcctgtgccccgacaggccatgggttagacaagtttgtcctagacccaaaccccacatttgaatatgggaaaaccagggcccagaaaagaagagctgacttgtcagagcgtgctagtggctggtctgggagaggctgcttgtcctgtgagcccaccactgagaacacacagttccaaaaatcaagaattctctgtctttcctgagctcttttgactgaaaattaaggtgcatgccctctccagatggaagcagcctgcaaagtcatggctttggccttgtccagaacttctgttaagctggcacagaagacaaggggccaaagggaatgaggaaccagtctggcagcagttggagaatgagaaagtccctccattcagctgagaagtatttttataggcagattgatagattgtttatgactgaagttcagatgaaaagaaattccagatatgcttatttaaatcacccttctacacttaagttctaactatcaacagtacaaatatcagatagggaagatttaattcaatgaggaaaactgtacacttagaaaaaagaccttaataggctgatgtggccaccaaaaattcatttgatcttaggtcatgttagttgagttaaagcactaacaaaggaggtgatggtggttctcttccctgtccttcttagagactaacggcccccctgaaactcatctcttccacccccagggcctctgtatttgaggtgccttcttcctggaatgattcttcagtgacagacttcttgtcattcaggcctcagattaaatttaacccccagttagtgtaccacagccaacaaacatttttcattttctttacagcatttactgttatctgaaatgacttctgttattgttttctgtgccccaattccacagattgacttttgttatctttttcactacaatctccagtgtctggcacaatatctagtctagagtatgtattaatgtacatgaaatgctatgtattaatattacatatgtagatgatgcattacatagtaagtgctcaattacttgctgattcagtgaaagagagatatattgtgctcataatggttatatttattattcaatgtctttgaagcctggttgaaagtatagagatttcacctagagaaaagaaggcccagagatgaaatgcaaaagctacttgcagctatctgagcgctgtcatttgaaataagagtagattcacatattcattcatttaacaatttctgagcacctactctgtgttaggcattgttgtatgtcctagggaaacagcaataagcaaaacagagagaaaaacagacaataaacagatgcatgagacagtatgtaaggtgtcagctgatagtacagtccatggcaaaaaaaaatatctaggagggtaaggaggactggatggcctgtggcggattgcagactggctatttaataaaggatgtcagggaaggttcaatgataaggttatcacaggttgtgaggctaactaagaccagtgggtgaactttaagcagtggttcccagccttacctgcatatttaagttacctgaggagccttaaaaaatgctgattctgggaatccaccctcagaggtgctgatttaattggtctgagttgcagcttggatagagaaatttttaaaatctcccaagtgactctgatgtgtaatgaattagagtcactgacagggaggcaagatttagtaccagataataagagccttctaacaattaaagatgatctgcaatagcttcccggtgttgttttgtgttccctggcacagaaagtgtttaagaataccagaatggcaatgagatactaatttgcactcattaggatggcaattataaaaaataaaacaacgaataaaaaataacaagtgttggtgtgaatgtggggaaatggaaacacttgtgcattgctggcgggaatgtaaaatgctacagccactgtgaaaaacaagtttgatggtttctctaaaggttaaatatagaatgcctatgtgatcccccaattcaatcccaggggtacacccgaaagaattgaaagcagggatacaaacagacacttgtataccaacagtctatagcagcattattcacaagagcccaaaggtgaacacagcccaagtttccattaatagataagtgaataaatagaatgtggtatatacatactacaaaattttatttctctataaaaaggaataaagtttgttgttgttgttgttgttgttgtttttgagatggagttttgctcttgttgcccaggctggagtgcaatggcgcgatcttggctcactgcaacctctgcctcccgggttcaagttattcttctgcctcgggcttccaagtagctgggattacaggaatatgccaccatgcctggctaattttgtatttttagtagagacggggtttctccatgttggtcaggctggtctcgaacttctgacctcaggtgatccgcccgcctcggcctcccaaagtgctgggattacaggcatgagccaccgcgcccggccaggaatgaagttttgatacatgctaccacatggatgaaccttaaaaataaatgaaacaaataaataagtgaaataaatcacacacaaaaggagaagtattgtgattccacttacatgaggattctagactcagaaaattcatagggaaattaaatagaaaagtagttatcagggactgggagcacaggtgaatgcggagttattatttaagaattatagagtgtttggaatgatgaaaaaattctggaagtggatagttgtaatggttgcacaccactgtgaatgttctttttttagctttttattttaggtccagaggtacatgtgcaggtttgttatacagggggtttggtgtacagattatttcatcatccatataataagcattgtttgataggtagtttcttgatcctcaccctcctcccaccttccaccctcacgtaggtcccagtgtctgttgttcccttctttgtgtctgtaatgtactcagtgttcagcccccacttgtaagtaagaacatgctgaatttgattttctgttcctctgttagttttcttaggataatggcctccagctccatcgatgttgctgcaaaggacatgacctcattctcttttggggcttaatatcactaaattatatgcttaaaatgcttattttatatattaataataaattttattatttatattttagcattatataaaaaaagaattcctggatgaccacatatcaaggtactgtacagggctcctatattgggggcaggctggcctggctgttttaggtcgcttttttgtctatggactgtgatttaaacatatccttataacatgaattctccatcaacaccaccaccaccataagaataatctttcttatactgtctttactcttgtaaaagaagaaaacagattcagagcgtctgtgatgaacatctctggctccagagaaggtacattttgaaccaagtgggaatgtcagggttagagagcaccaagttcaatgtaatggttcatttgtggcatgccaattaggagttagaaatagcttaactttaaactaggagtgacgagcaaaatttaagcatagaagaagctttttaaattaggcagaactgtccattgaactaaaagtaagtccagtaatgacaattaaaataaattccaaaccacttctgcaaaattcatgttaggtccttgggttgcctctgacaccctcaagcaatcctgtcaaccacaactggacagctttcatctggctgaagagctgtccactccactaaattggttcgttgacagctattcttatgagaaattttactttctcttcttttttgctttctccgtgatcttttgatccattaataaactccacaaacttgtgggctggttttgccattttctctgctcttcatgaaagaaaatataaagacacaaattctgggtaaatttccacataggttagtatatgtgaaaatggactgtgaatgataaagtatgataaataagtgattattgttattaataatgatagagacaatagcaaaggaaatcttaggttatactttgtcacacacacacacacacacacacactctctctctctctctcatactttctggagagtcaagaacattttttgttgttatttatttatttatttttgagacagagtcttgccctgtcccccaagctggagtgcagtggcacaatctcagctcactgcaacctctgcctcctgggttcaagtgattctcctgcctcagcctcccaagtagctgggattacaggcacctgccaccacacccagctaatttttgtatttttagtagggacagggtttcgccatgtgggtcaggctggtcttaaactcctgacctcaggtgatctgcccgcctcggcctcccaacttgctgggattacaggcatgagccaccacgcccagactttattgttattttttgtgggcttttgcactggttttgttcataaacagctgtatgacttcaaaaaattcacttgacttttctgagcctcagtttcttcatggatcaattgagaaagttagattaaatttcttattcatcaaatatgtattgagtgccaactatataccaaggactgtgctgagtactagattcaatagtaaagaaaatggacaaatttcctgacctcatggggttcatagtatggatggaaacagacataagcaaatgcacaattaaataaataaatacagtttgtgatcagttcttcccagttccatttcccaaatgttaatatttatattaatccactgaggatcttgataaaacgcagattctgattttttttaggctgaggcagggtctgggattctgcagttctcacagacccctaggcattgctgatgctgctggttcctgagtcacaggtggagtagcaaagtataaaaggtgtaaacatgacattatgatagaaaacacgctggcttagagagaagtgtgaggtggttgggaaacactggaggtgacagtcaactgagttctgatgtatgcagagaatttggaagtcagaggaaccaggataagtgcattgcattcaaagggaagagcaactgcaaaagccctgagacagaaaagatttttcatgttcactatcacaggggaaatgagcaagggactgagcatctgagatgagctcagacaagtagtcggaagccagaccctgagggcttttttgtgctctagggagaagtttatgttctattggaagatcaatgagaagacacagaagtgatgtaagcagagtaatgacatgggggcaggggtgataatatgccaggggtttctgcaggagtccaggtaaaagaagatggtagttaaaagtagcatggtggctggggagatggagagaagtgggtggaataaaggttttttggggagtaaagagatagataacaaaaatagattccatgagtgagtgggaagaagcacaaataaacgccatattttagaattgcatatctgaataaatgttggtacaatttaatgagatgggtgaaacacattaagtgtgagatacctataggacattcgagtgaagacgtcaagtaggcaattggatgtatgtgtgtctggagctcagagggatgactgggcaggagatacatgcttggaattgccagcacttctatgggatttagagaactgaggaaggatgtgatcacccaagaagagggtcagggtcttgatgaacagcagtactgagatgtgcagtagagaaggtagaaccagcagaggagactgtgaaagactatccaggatgttctggggacatcagatgagagcggtattttggaagccaagaggaacatttcaagtgaatatatgtatgtataatacatatatataatatattatataatatatatattaggaatatataaatatatatattcttgatacttccctggaactacttcaagatcactcctaagaatgacaggaagcaaggaggcagggaaactagagtactttttctctttatatttttatgtatcgaactttgcaataaaattatgttagaccagagggctccaccattgcaccaatgatctccgcagtaagtgtctcctctcccacctgttaggagtgtcatgtacacaagaaatattcttgaaaatatacacagcacatccacaaaagatcccatactccctatctaagtatttttttcacccttcctgcccagccctgcacagtcttttgcaaaggaattacatttaaattaaagaaaataatgtttcattttcttaccaatcaacagttaggagaagagtacaagggcattctgacttacaagagagcctgtctaaaattgaattatttttttctagtgagaattttattaaccttaaatataaggtccctgttggtttctatactgataagagaatgaatattaaccaagagggccttaacgttccactcagcttgattaaactttagacagccttcttcctgactccaggctctgaactcccttttcttagagcatttactttagaaaatttgtaattgcaaattctttctctaacactttgagatgtaaatgaaagatactcaccagttttacaagctaggactgccattctcaagaacttttcctttccctttgaaaggaaatcatcaagaaatatagtgctcctatctctcagtctgtaggatcgaacagcctaacttaggtggacaccttgctccaagttgtaaaaccgtcccttgtcgtgaagatatgagaaagtttacttatcctttgggtaaggctaattaggtagcacattaggtaatcccttccccccactctatttcttaaaaaccctcctgtcctttgttgtagtgaagttgaagtcagattgcattctggtctctctccctattgccatagccttggaaaagaaaaaagtcatctttacctgcttaacttcatccagtgcaatttttgttttgacagtatacatcatttattacaagtacagatgttcctagacttatgatggggttacctcccagtaaacccattgtaagttgaacacattgtaaatggaaaatgcatttaatgcacctaacctatagaacattgtaacagcctagcctaccttaaatgtgctcagaaagcttacatgggcctagagttgggcaaagtcatctggcagcagactactctgtagagcgtaggttgtttaccttcgtgatcacctgactgattgagagttggagctcactgctgctgccaggctaggtaagatggtatcatacagcatattgctatcctgggaaaagatcaaaattcaatattggaaatacagtttccactgaatgcatattgcttttacaccatggtaaagtaaaaaattcttaagtcaaaccatcatgtcggggaccatctgtaattgtatgtgtgtggcttcttcattacctttattactggccatgaacaaaatctgagtttaacatataggagcgataaactcagataataatcacattgctaatatgacttatgtaaattgatttttcaaatacttctttatttaaaatagaaataacagaatccatgagtatgttgtttttccttataacaaataacctgagcaatactatgtaattgttttaaagtatatatcatttcctttaaatatatgcactctttccccctaggtttcttgagagactaaacatacaaatggacaatggccagaccatgtgtaacaataaaactccgatggacaatctctggcagccagcccagaacgatcaggacttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctcttgctttatcatgctctgaataaattgcttgtttgttctcatctgtgtggtcttcatttgtttccatattctaggtgtgttctagatgttacacttatttgaaatcctatattttgacttaagtggaaatcctttctgaggaagaaaatatttcttatgatttggcttatattactttgggttcttgtactaagttctcaggtctcccagttaacgttttttcttttcttttttcttttttacggaaagctttttttttaaaaaaaaaaaaaaaaaaaagaggaggattaaataagatagtttgcatagccttattccataatatgaagcatcagagcagtggtgcttcaaaatcaccagcaaacactaggatcatctggagggctgggttaaaacacagactgctgaacccacccacactttctaacttagtgcatcttgggtgaagaccaaaattttacatttttagcaagttcccaggtaatgctgatgtcgatgctggtcttgggaccatactttgaggaccactgacctagaaccttacaagggatgcccttaatcttaacctccattctgcctttgcaaattattttcttctgcttctcactttgaaatgtcttccttggaagtgggttgattttgacattgatgtactgaacacctaccatatggcaaacaatgcacctggaagatttttcatgttggcgaattcaatcttcataattatcattatcatgtgatgtaatatcatgatgcccccttttcagaagaggctggagctcagcatggttaagagacgtaatattttgtaactattaagtggtgaagctgggatttaaacccacatatttttattgcaagtccagtatttctcctactaaattttaaacatgcttacttagaagtgaatatatttcctttaaaaaaacacatgctaaaattttgctttttgtctagaaacttaagactcaaaatactgatgatgacagcttaatatgtgttgtaaaatgtgctggctatagaaaatggtaggagaaaaaaggaataaaccttgtaggatggaaattatatataatggagtttttatgtaattctaaaataattttatttgattttttttgaaaaccctatagacaaggacacgagggcagggaggtggttggtgcacagctggtgaaggttaggtagttttgaactgcaaacatgcagagtaaaattcttgaggcaaaatcttaatagacttttcaagaacctcaaatatcacacatactgggcatgaaacaaacttcaaagcccaaagaggatctctctgtacagagtataatggagttaaaagctgtaaggaatacaaaggatttcaggatgaaagacactgttttctgaggccatgcctgaatgtaaagccaaggcaggatagataggcaaggtgagatctacatctggagagatacccactgctgcacagcatgttaatcattaaggattcaattcttcttggaaatgaaatgccaaataatagtgctagtcaattagacctcagaggtggtctctctttaagaaaacccattttccaaaagtggaactgagtcaacagctacagagatagatttcttttctttacaagatcattttttctttatatgtgcacagtctagcgtctctggtttgtgttgaaaacattttttttttttttacacacacttgttaaggaatacactcaccaggcacagaaatgtcttcctttggggtaaaacacatgacatgttttcaatattcggctgatcatttcctcaaaattattcctgtgattatgagaaattcagcacagggaaaaaatgtggaccacatatgccctctccactttggtaaatcatttaccctaagcataagcactcaaggaaaagtggactttcccatactctgatagtaacctgctctccattcctttgcaacagatggcctctgtcactaggcccaattgccagtggatacagctctccatattttgccaggatcttggtttgctgttgccaagtactatggtttctcttcttacttctgcctctgataatgcaaaaaatcctttgcccaaaggagagatgaaacagctcaattttatgctgttgcaggagtagtcaaacaatggccattgggccgaatccagcctgctgtctgtttttgtaaataaagtcctagtggaacacagccacactcaatcatttatgtagttcctctagctgagtttacactacaaaagtagagctgagtaattacgagagagatttcatggcccgaagagaaactttactccctttatgaccctttatgaaaaagtgtcatgacccctgctcttttgtaaccagagatgtttggtctaaagaagaacatggcattaagacacaaagacctataagagcctaaaaggagcctatttactgggagtcattcattcctctggattctttcactaagtggaaagcaacacccttccggttgaccacgccagaaactgagcatcttgctcatttttttcttctcctttacctaggtcattatctactctgaggatctcttaaatcccttcacttctctccaatctgctgtcaataccctaggagagggcttcctttcatcttctcctagactatcacaaccacttttatcccactaactactttgtctttgtcttcaaattcttagtatatgagacagcttaaatttaacatgttcaaaattgaactcctgatttccctaacctcaaacctgcttcccatatgaatacatagcaaatctatttctccagttgctcaggttaaaaatttggaagccacttttaccaggtctctacctcttctacctccagtacatcagcaaatcctgatagctctaacttcataacgtttcctgatcccaaccctttaccagccattcaatgtcataccattctagttcctactacatcatgcttcacttggtgactgcaaagtcctctcaactggcatccctgcttccatcatttctcacatacaatccactcttcacccactagacagaatgagctttgaaaaatattgagattggaacatatcacttccatactcactgcccttaagatggcttgtcatctcactaggagtaaacccagaaccctcaccatgacctatgtaaatttacaaagctggccactggctgcttccatcatctcaactctcaccactctctctttcccaggctgctcccgctaaggagacttcctgacttccacactgttcccagatggtgccaatcatgcatccacctccaccatccacctctcacctgatgctaccaccatctggatctctccattcaagtgaccagagaagctcacccttcacttcattcaggtgtctgctcagattcatctctgcagagaggacttatttaaaaaagaacctcccctcactctctattctcttgacttgcattattgattttcacagctgttaccttttacgctcccacacacactagaataacttgaatgtaaaatcactgaaagcaagaacttgggctgttatattcactgaagtattttccagcacctttttggtactgttttacagtacctagcacatagtagtgctgtgaaagtacagttggttctctgtatctgtgggttccacatccgtagattcaaccaactgtgaatcataaatattctttaaaaaatagtgcctgtattgagcatgtacagactttttcttgtcattattacgtaaacaatagatataacaactatttgcatagtatttaccattgcattaggtattgttaagtaaccttgttgaagtatatgagaggatatgcttaagttaaatgcaaatactacatcattctatatcaggtacttgaacatccttagactttggtaccccaaagaggtcctgggacaaatcccctatggataccaagggacaaatgtatctgtggaatgaatgactgactgaatgaatgaatgaatgagctacttcttaattagttattctgccttggcaattactctttcccaacactctcaacactgaagtcaagatatgttcttcccccaaaagaaattagctaatttctccctcttgttcaaaatcttataatgtcttcccattgcaattttgatacaatagcacatcttgacctggtttaaactggtccctacttacctctctagctttatttctgacactgttccataaccaacactaaatgaagtgcccaaattctcactcagtgagatgaggcacgcttgttaaactccttcctctccttcccattctttacctggcaagctctcgcatgtccttcagcactcagcttaaacatcttattgtctgggaagccatcctgacctcaatattgtccctgtcgtatatgcttccattgtaccctataattatatatcatagcttttatcaccctatatttaattgttatttaaagatctgtgcctcccaaccacactaacttactgattttggtatcaacagtgcctagtataacaaatatatgttagacaagtaaactgatatacaaggtagcccttgcttgaaagaagtttaaagtagtgatcaacacaaagggatttcccccttcattcagctcaatagttctgttaatcctgtctctaaaccactcccccagacaagtgcatttgggccaccaatcctcgctttgaattacaagttatagctgttaacatcacatacaaaccactaaagagttaacaagtttctccagagaatatcagaagcctttcccacattgtactctttaggctaataatacttttaagtctattttctagtcatgtcctgggcaccgaagttgttataaagattaataaatttggcccgatgtggtggctcacgcctgtaatcccagcactttgggaggccgaggtgggtggatcataaggtcaggagttcgagaccagcctggccagtatggtgaaaccctgtctctgctaaaaatacaaaaattagccaggcatggtggcaggcacctataataccagctactcgggaggttgaggcaggagaatcacttgaacccaggaggcagaggttgcagtaagccaatatcacaccactgcactccagcctgggcaacagagtgagactccatctaaaaaaaaaaaaaaaaaagattaataaatctaaatctaaaacacttacaatgttgtttggcatgtagtgtctgttatcttaatcctagctattaatattcatcttttctgttcatttcaaatagacacaaatgacattaacactggtcctggtcttctagctcacaatgtagcaagaaactaagcctgatcaatgactgatcattatgagagcatgttgtaatttcaacagctgggggctgttgaaacgacaactataaatagcggccagagaaaagagataatgagtaagaatacactggagtttttccagacacaactggtagaaaacacaatttaatatagcagagaagaaataaaggtgctgaaactcataggagtggagatggggtttagaaggtggtaaacgaatgtgaggggcaagaatttgggaggatttgaggctggcataatcataagagaagcagggagtatccagtatcttgatgggcataaggattttgaaaagaaaggctctgcattctattccacaaccaacatgtatacactcacacctacacgccctgccatgcacccaacatataagagaagatgagggagtgaaggtgatgggagaggcaggtggagaataatggtggggttgcccaaagatagacagactgaagttcagattctctacctggattagaccctctatccactacttctcctcctgcacctggttactagtcatctctagagccaaagacagaatcatgtaaaggaggctcatttggaaaagctggctgtggcattccaacctggcaaatctaagaactgtattgcagtacttgtcaatgcatatccagatgatgcttgtgacaaatgttaaaaaagccttaaaaacattcatgctccaaaaattccaaaagaaataaatccttatagctgttcataaagatttctgtacattattactcacaaccatgttgttcataactggagaacatgaaacatctaaatgtctatatttgggtattggttacataaacaatttattaatacacagccattgaaattcaggtttaaaatatttaatgacaagggacatttctcctaaataccatccaaagttaaaagcaggtataaaacagtaaagcacaagctcaacctttgtaaaaatatgtatttatatatgggtccagatactatagtgaaagattaatttgtgaccttttttaaaaaattacaaaaatactagaagaaatgagtggttaccttcttcctccatctcaagaaaataactaagatttgtataactacaagctttgaagactccagtgtcaagcttgacagggaagcaacagagcctcttgccttcaagggatctgtggacgtggtggtgaccaggacaaagtgaaaagcaaaaggtccagcttaacggagaaagaggaagaggtccacaaaatgtctgagattgaatttaccattgagacccagcttgaggagctcacagaaaagttaactaatttagagattaaaagaaatttggcatttcgtacatctgaatgttgtagagtaacactgaaatgcaaatctggtatatgtatgtgatacacatacacatacatgcttacatatacaaacatatatatgtacaggtaaatgatacatacatggtacctaatatttatacgtatgacatacctgtatttattacatatgactccatatattaatattatctatatccaaaatggttatctctaggtgatattaatctaaaaaaatttgaattatttcttcatttttttttttactttttcccagtatttcccatcaaatgtgtattacattgctaatccacaaaaaattgtgttttttttcaaaatgcattgcctatgtctggttttgctcataacagtgccttaataattatatgaaatccgcacgtattgttcctctcaccagttattaaacttactaattggcgtacttcattttaagaagtttttaattgcaaatgtagctataaactgtggtgtggtgcttaatagatgaaattttcttagtttttgcccatccacctgaagctgctacaaagaaagaataacttcaataattttttttaaacaaagttctctccccttctgtggatgttttggagcttacaactttgtcctgaatctaaccacttctcatcagtggtgccactaatattagtgcaagccactattatctctaacttacttcttacaagtttatttcttgcaataaaatcttgtcttcaatttcctgcccttatagtctatgtgctacacaaaatctagagttatacctctgaaatcaaaggcagacaatgtatgttttccactcaaaattattcaatggcttcccagctcatgcagaatatcccaagtttctaccgagacttggtagaatataccaggatataaggaacctggtaccagctgcccctttgatctcgatttccaccagttcttctcctccctctgctccaggcacaaacacctcctctgtatttctccaatatgtcaagtgcgctctgacctgtgcgcctgttgtgttttcttcctagaatattcacttccaaatatccactaggttccctttttgtcttcacttaggtctctgctcaaaggtgtccccatcaaagagcattttcctgactattctaatgaatgtagcatactttgtcattctcagattcactatgctgctgtatttttcctgatggtatgtatctaacatattgtatatttctttgttttctagtgtctattaactgtctcccaccaatagataagtgccacgaaagcagaggctttgtcagttttcttggcccataataggtacttaacagatacaagttaagcactgaatggtgccactgaagactatgttggaaatacggttgtatcacctactactacaacatgtgattatttatccactttatccaaagtcctgccttcagatacttcaatcttctactgcaaatgaaatactctatcttttcctcaagacgttatatatgttacatccaatagagaccataagtctgtcctctccagttccattatttgtttgttttgttttcagaactcagttgaattgtttctattttaaagtttagggtttttggccacactaatccccattttttgttcttacataagcattgcaattttcattttttacactgattatttctagtttagattaccttatccctttagagaatttttttaaagtatacatagggtctgataattaattaacctataaatcaatcaactaacgaaccaatcaatatttattacttatttaccatgcttggccatggagctatagttgacagggagacagataaggtccctgtcctcatagagcaagtggtaatgaattacatattgtagaatcactcttctttttacaaattgtccatgagcttaactaaagacacacacatttataagtagccaggaaattgtaacttcaaacaataagatacaatttccaccagtcagactcaaaaaacaccaaattgccaatcttttgaattgacaagggtgtgctgaaagcatactctcaggactggttatgggaggacacattagtaaagctttttggatgctaatttggcagtatgttcgaaatttttgaatgcacatttttaacatatctattctagggaaatgccccaacacttgcttaggtgtccagagatgcatgtagaaggttgtgtgttgctatagttttttgtaaaactgaacacttggaaatggtacaaaacttcacaaatctattagtgattaattacatcatggcacactgatacccttaaaaaatactatgcaggtgttaaaaagaatgagaagggatccatatacatataataaaaagtatacagccatgcataaacaatgaaaccagggaagtagttgtagggtcaagacagacagaagagttttttttttttatcagaaggagatctgattttcatcaggaatatatctgatcagcagagagttcagtcatatttgtaatattttatatcttaagctgggtcatggacacacaggtgttcttttatgttttttctcagtaccttttgttatatctaaaatagagccattaacacaggaacagaaaaccaaatacggcatgttctcacttataagtgggaactgaacaatgagaacacatggagacagggagaggagcaacacagactggagcctgtttgggggacggggagaaggggagtatcaggaaaaatagccaatgcatgtgaggcttaatgcctatgtgatgagttgataggtgcagcaaaccaccatggcacatgtttacctatgtaacaaatctgcatgtcctgtgcatgtatcctggaacttaaaataattttttaaatgactttttaaattaaaaaaatcttattttaaatacattttattattttattgtatgtatattatatttatcttatttattattttattgtacagaagttgtgctatacttacaataaaataatataatgtatccaaaacatgagtagattaaaaaattatacatcaatatacattatatgatatcataggagtttgaataaaataaaaactgagaagaagagggagacagaaatgcatatgtatgcatacatatacacatatttaatataagtagatccagaggtcatggccataagaatgcacacccaattgttaatcataaatattttgggcagggtattgaagatgatgggagacttcttcattcagaatattactagaactttaaactacatgaatttgtatgcttatgggttacttgtttaactgaagaataaggaaagacttttccctcacctgtgaatcccatcttttgcactctggccaacacctaagtcttctcactttgcactagaaggataatgtactgctcttgccaaataggtcatacacaagagtattaatttctccaagcagctgggtgtgagcccagctccaagcagaaaacaaacaaactctctgactcaaaaagaggcttggccaaggaatgtcaggttagatataggcatatgtttgtccatttgttcattcaaccattccttcaccaacttaatcatatctagatgcactcaacagagtatttgatagtccactctatttcaggcactgagaagaggaagcaggcagtcccttccctcagggagctcagaggctactgaaggagacagacatgaatccaataactgcatatacataaaattacagctatggtggatattataaagggaggtacacaaggtaacattgaccctgatgggagaacagaaaacactttcttgaggagatgataattgagctgcaacttaaagaggaatagaagttgacagaaaaaaggcagaaaacactggggactgaggctggaaagtgcagccgtgagagctacataacttcgtccagcaactgaaaggagacaaagatcactggagtgcagagaatgaggggatgcctcatgtcagatgcggccagcaagggtcacacatcaggagggggttggaagttgtactaagtatttatgtattatcattaattcggtgattgttttaagaaggttggcactgggggtgacatgattagatttgcattttgacctatctggtgtataaaagagaagggacaagagtattttttgtgttgtttatgtgtgtgtgggtttttgtttttgtttttgttttattttgtttagggtggtcttagtaatttaaaaatattttccttgtatcgataccagtcaacctatctagaacctagttattggtggaagtggcaccatctcctaggggatgtttgagatatctttgggatactgggttgtagttatgattggggagcacaacacaaatctagaggaaggacaggtttcacattacaacatgagggacaatccctcataagaaaattatcattctacaggccacattctccatgattctagaacatcctaccagccacttgtgtaagtgaaaaatttgtttgtaattatctaatctagaacataactccttttacttataaataaaaagaatcttgcatggtaatttccatacactgaataaagggaagggtatgctttcatttggttcagaacaaatattcaccctgtcacctacatacaacatgtctgcgttagactttgttggtagttgtcgtgtccatggtggtgacttaatgtacaaatgcacatatctgactgctttattatgttctgttgtagatgagcctagcatttatacaatgaaatgtatgttattttaccaaaattactctccttttattgcttctttgtatttcagttaagacattatattgataattgttcattgtgtatagatacgttagattactcgtggatttcatttcagtattgtaaaggggtattacaagctatttgtttttaaaaagagagtagcagttgatctggggtgattgagaattactggcctagaaaaatatgactttcaagagctaggctgtttcgatagacaagacacacttcaggtgtcttgtctaaatgaatgcactggagtgttcctgatttatcagtactggatgcatgcagttaaagaagctcagagaatgtcaaaggttggagagagcagcacaggggcagaggtggcacactagttccctatcaagaaaattagaaagatctgctccagcttcaagcttttctcaaagtcctgaaggatttttaacacatcttccataaaaagctgtaatttattatctcatgaatatctaatttgacaatatttgcaaatcaagtttgtggaattttggtgtgttcatttgagtgtgtgttttgttctttctcaaaataattcttaaggtagaaatgtttctatgtgctagaaatgctgagataaaaaaattaattttgtggttagcttgaaaataaatggtgggctctaatatgcaacgtaatgtaatataatataataagggtatccccttagggttgactgtggcagctttccaagattttaggccttgtcagtttctctgctttgataataatggaataaagaacagttattctcattatctgagtgctactatatgccagaaagagtcatatctgttttttatgcattggctgatttttatcgtcacaacagcctatggttatagatattatgactatatccaatttacagatgaagcaactgaggctcagagacttgaactgatgtgcccaaggtcacatggctggtagatagtccagaacaggatatcttaatccctatgatagacaaatgtaataatattttaatttaatcaccagtggcataattatgaagataatctaacagtaaaatacataatatggaatacagatgaatagaaatgtttgcctcttaaaaaaagtctgataactcctttgagaaccaagcctgctctccttcaatgagcttgtgctctgtacttcctcagttactcactccaatgttcagtccatgagttcgtcattaccaatagttgtaactcccaacaatttcagtttaaaatatctcattcttaaaccatcatttcctgtctctagaacccttttctttagtactcttgactccagtaattctttgaccatctcaggatattcaacctattgattctaacatgttttcactgtccctcaccctcctcatgtcagaacatgacaggccacaggcaggctatggattctaaaagatatcgtgaatgctaaaagtgctggaagattaaggataccctgagaattgtcatggataatgataatccagtgatactaaaacatatctagacaattaaccagaataatgaaggtttagaattattccctgtggcacaggtagagcagctgaggaaatggagatctcattcgagagaccaaacagctcagaggttctggagcagctaattccaatctctgaacactgtcatgcagttctaaagagtgtggctggatcctagtcagggaagatactggaaggtagagttcagctcaaactaagagaaaatgaaaggtacttttcttctcatactacaactacaattcaattgtatagctgaaatgctgtattgagaaggtttctgagaatgggttctcagtcaccattgtctcagtcagattgggttagattatactctgggaacaaagaactcttaatcctcagtaatgtaaaacagcaaaggtttatttttcactcactgtacatgtctgtgtgcattgtcaggaggctctgctcatctcattccctctgtgatccagaaagatggagtggtcaccatctcaaatgttcccattttacatgctagagggaaatagaacgtggggggttaaagtgtgtgtgtcacaaactgataatgaaatgttccagcctggaagtgacttatattatatctactcaaaaactcattggccagaactagtcagaaagactcacccaactataaggaggatggggagtgcaaatctacaatgaacaacataatgagcaccagaagcagtggcatgagcagtggttgacctcctgggtctagacaaggcattctagcatttgtcttgctactcctcatccctgccctaatcaccagagctgccctgcaaagccttacaatgtagtgagctccctaacaccagagtgttgcaagcaaaagttaaaggagtgcaggttaatgacaccatagaggctattcctttatctagtagactaatggtctacctggatctacacgagtctcttaccactctgaaataaacagaactaggaattatggaatactttgctaagtgtaccagatatttggagaaaaattaccagttctcaggccagctaaacaaccaagcaatggggtgaattttgctcatttaaaacggagagaaacataggctgaccattatagtcccatcattgctccttttcccgcaggagggcaaagcacattaactctctccccagcaagagacaatgatcagaagaatcaacataaagtgagggaaaggatttttattgaaaaagctgctatagcaaagtttgtggtgctaaatatttctttataaaaaccagcacttgactatcagcctccctattcagctacagacaggacagcaaatggttgggtgagaaaatgcactgctattcacccaagactgttaggctaatcagcaatggaaaaaacatctgaaaacacctgataaaagggcaaatatgctgtaaggctctcgcgcgctctctctctctctctctcactcacacacacacgtgacagattttaaaaatcaacatctgaatgcagccttcagttgtcaaaagctttctttatgattcctatttaatccacaaaattcagggaggttagaattactattataaatgatattttcagataaataaattcagattcaaaaagattaatttgattcactttgtgtccaagtgggtctacatctgtagtacacaggaaagcaccttgaatggatgtgtgacaaaaactgacttcttaatctttcaaagctgacctcatcacaccaccactacttgctggggctggtgacagaacgtcgggcttgagggaccacagttcctgtaatatacggtgcttcttacatgctcagggaaatcatttatcattgacattctacagtaagtgaaatttccacccaccacagaattcattttatttttcatattgtcaaatgacataaaataattttctctggtttctgctgctaaaatgtccttatagtggagcttataataacccaagaggaagcaagcatgataggataactaatgagttttccacataagagtcaacctctaaacacactagaaaatcagccaaaccagctggagataaaatggctgaatggctgattgaatcatgtattcctcactggtccagttgagaagggcttctgggtacatctcctttttactttctgcctgcctttacctcttttctccccaagttaaaatcattagaggctcttctcaacctccaattttgaggctagtgtaatccttaatagaaggagaggtaagcatcccctgatcaattacaagaggtctatacctcaacacggccttcctgtgacgccagttaccctgtccaaacactgaagttgcacattggctcagaaactggattcctttctttttctgttccttatttctttctgctcaccccctcccttctccctttctttctttttaattaaatgagtaaaacatgaacacattcttattgttaacaaaattggattaggaataattactgtctggcatggccatgtgttgacagagatctggaaccattatgaactgctgtgggagcatcaccacattgacagaattttggtactacctagtaaagtagagatgtatacacctgctacccactcctaggcacagaacctaaagaaactcacacatgtacccaagatgacattattatttatggactcattttctataattgcaaaacactggaaattatctaaatattcattaatagaataatcaaaaaataaactatagtcataaaattgactgctacataggagtaaaaaagtttaaataaactaaacatatcaatattgatacatttcgcacatataatgagtttctgaaaagcaagcattctccttgaaaaccggcccaagacaaggatgccttgtctcaccactcccatgcaacataatattggaagtcctagccagagcaatcaggcaagacaaagaaataaagaacatccaaataggaagagagaaagtcaaactatctctatttgtagacaacatgattctatatctagaaaaccccacagtctcagcccaacagctccttcagctgatcaacaacttcagcaaagtttcaggatacaaaatcaatgtaaaaaatcgcgccactgcactccagcctgggcgacagagcgagactccgtctcaaaaaaaaaaaaaaaaaaaaaaacaaaatcaatgtaaaaaatcattaacattcctatataccaacaacagccacgccgagagccaaatcagaaaggctatttcattcacaattgccacaaaaagaataaaataccaggaatattacttaccatggaagtgaaagatctctgcaatgagaattacaaaacacttctcaaagaaatcagagaaggcgtaacaaatgaaaaaacatcccatgtgcgtggatagaaaaaaatcaatataaaaatggctatactgtccaaagcagtttacagattcaatgctctttctatcaaactcccaatgatattcttcacagaactagaaaaaaactattttaaaatttatatggaaccaataaagagctctaatagccaaggcaatcctaagcaaaaaacaacgaagctgaaggcatcatgttacctgacttcaaactccactacagggctacagtaaccaaaacagcatgatactggtacaaaaacaggcacctagaccaatggaatagaatagagagccctgaaataaggctgcacatctgtgaccatctgatctttgacaaagctgacaaaaataagcaatggggaaaagactccctattcaataaagggtgctgggatcactagctagccatatgcagaagattgaagctggactgctttcttgtaccacatacaaaaatcagctcaagatggattagaggcttaaatgtaaaacccaaaactataacaaacatggaagacaagctaggcaataccatcctggacaaaggaatgggcaaagatttcatgacaaagaccaaaagcaaacacaacaaaagcaaaaattgacaactgggatctaattaaacttaagagcttctgcacaacaatgacaaaaaactatcaacagagtaaacagacaacctacagaatgggagaaaataatttgcaaactatgtatctgacagaggtccaatatccaacatttaaaaggaacttaaatttacaagagaaaaacaaccctattaaaaagtgggcaaaggacagggccatccattttccaaaaaaagacatacatgttgccaacatgcatatggaaaagaagctcaatatcactgaccattagggaaatgcaaattaaaaccacaatgatatactatctcacatcagtcacaatggctattagtaaaaaatcaaaaaataacagaggctggtgaggttgcagagaaaggggaacacttgtgcactgttggtgggagtgtaaattagttcaaccattgtggaaagcagtatagtgattccgcaaagagctaaaagcagaactaccattcgacccagcaatcccattactgagtatatgcccaggcgaatataaatcattctaccataaagacacatgcacacgaatgttcattgcagcaccattcataatagcaaagacatggaatcaacctaaatgcccatcaatgacagactggataaagaaaatgtggtacatatacaccatagaatactatgcagcctatataaataataagatcacgtcttttgcaggaaaatggatggagctggaggctattatactcagcaaactaacccagcaacagaaaaccaaatactgcctgttcttacttacaagtgagagctaaatgatgagaacttatgaacacaaagaaggaaacaaaagacactggggtctacttgagggtggagggtgagaggagggaggagagcagaaaagataactattgggtgctgggtttaatttctgggtgatgaaataatctgtacaacaaactcccatgacatgagtttacctatgtaacaaaccttcacatgtacccctgaacctaaaataaaagttaaaaaaagtaaatacgtaaaataaaaaggcaagttgtcaaatgatatatgaagtatgttatttatataaaatatgaaatataaaatatactaaatatcattttgtaatacatgcttaatgtactaaaaagtattaagcaaatgcaacagaatgataagactacaaattctgggagacaattacctctgtgaggcgaagtgaggggatgcacacaaggaggggtaaactgtatttgtcgtgctttgtttcctaaactggatgatgcagatttgttctgttgtgcagtgttattttcttagtctgaactattttgcaataaattataaacactctaggaaaaaaaattcaaatatttcagtaaacttaaacctcattttgaccaccacccagcacctagtcctaggcatcctgaagagttatctactgttagttattagttcttttccactcaatataaatagcattgtttgaacaaaggtatctctttcctttttatataaacgataatctaacatgcatactttcaatgaacatcatgtcttaaccatataaatgcacttccctcttcaacaataacgaattttcctggaacttaagcattttctttttgaggcagacggtataatcgctaaaagcacagtctttagagacaaactgcctgaattcttcaaatcctggagtcaatacaatatttacccagggcaagttattttctgtgcttcgggtgtcttatctataaaactgataatcacaatacctacgtcttaggattgtttgaggattccatgagtaaagtcatgtaaaacactcagagaagtggctggaacatagtaaggccttgataaatattatttgtagctacagtctttgctataacatattggaaagggcccttacaatggtgtccttacaccaagtccaacttatggctactctagaaaaatcaggatgttcttttgcccacttctcctaattatgctgagctttggaaatcagtcatccttcagaaactctatagaacctgtagcaatgcccagtcttttgatttctgcacactaagttctatttgtccaaattccaggcattgttttcttataggagaatttcttcaagtcactcatagctgtcagtttctgccaatttaatttggcaattaaggaactgtacataagtgtttatatgtcaccgttctttctttaagttgagcctgggggcacagccaatgtttcttttttcacattcatgctaataatacgttggttgagttgcacatagcatatgtaaatttttggcaatttatttttctcatagttctcagagtttgcttcaaatttatcacatcatctacgttatacttgcagttagtctacttctcacctaatatcaaattttggatttgcgtaattccctacgttaagagagattaaaaacaaaaattttagagtcagccagacctgagttcaaatcctagctctgccatgggttaggcatgtggcccaagtaaacatattagttttctatagatagataacaatttactgcaaagttagcagtttaatataacacccattcattatctcacagtctgggcatggtgactggattctctgctcaactctaaaattaagatgtaggtagggatcactgctgatctcatctggagctcaggattcccttttcagctcacatgattgtgggcataattcactgtcttgcagttgtaggactaaagaccccattctcttgctgctgtcagctgaggtaacttgcagctccagcagcagcccacattccttgacacatggtctcctccatcttcaaagccagcaagagatttttcccacatatcaaatcactctcaaattcacatcgctgatttctgcatctctttcctctggactcagatttaaagggctcatctgattgggtctggcctacctggataattttcctattttaaggtcagctgattttggaaccttaatattacaagccaaattcctttacatcagtacctaggtgagtgttttattgaataccaaggagaaggagtatgtatgtactccagggagcaggatatcttgggggacagcttacatttttgccactcacaacaagacatattggctttgcaatcctcagctataaaatgggaacaatggtgctcactgcagagaaaaagtcaattagatacagtgaaacaaaaaaagcttccaagtactgattatgctcaggattaggctgcctgttttcattacttcattgtcccagtaatctttttcccccagttttactgagatacaactgatatgcaaaatctctacataattaatgtatacttggtgagtttgaacatgtttacactcatgtcgccatcactataatccaggaaataaatgtatccatcatgccaaaattccccctttttactctaatgagagctatcctattaaccaatgagtaagtgcactgtatcttattgttaactgcaggcactattttgtacagacctctagaacttactcatcttgtataactaacattatatctattgaataacaactcccttggtaaccatcattttattatctacttctatacctttgactgttttagatgcctcatttaaaacgaaacatacaatatttgtctttccgtgaccgacttatgtcgcttaacataatgtcttccaggtttatacatgttgccacaaatgttaggtttttcttctttttcaaggctaaataatattcaactttatgtgtttaacacattttctttgcctattcattcatctgttgatagacatttgggttattttggctactctgaatattgttgccatgaacatgggagtgcggatatctctttgagaccctgatttcaattctttgggttatatagccagaattgagattgctagatcatgtggtaattctatttttgattttttgaggaccctccatactgttttccatggcagcagtaccgttttacattttaaagggttcctgtttctccacaacctcaccaacatttgctgtctttttttttttaataatagccatcctatcaggtgtgaggtgatatctcaatgtttttgatttgcattgccctgatgattagtgatagtaagcatctcttttgtttgtcatttgtatgttttctttggagaagtgtctattcagatcttttctccatttttaaatcaggttatttgatttttttgctattgagttgtaggagttctttatatgttttggaaattaatgcattatcagaaatatggctagcaactattttctctcatttcataggtcgccttttcactctgatgtttcctttgctgttcagaagtgttttcgtttaatgtagctctacttataatttttgcttctgttgccagtttttgggtgccatatccaagaaattattactgagatcaatgacaagaagcttttcccctctgttttcttccaggcattttatggatttagatcttatgttcaaatctgtaattcattttcagttaatttttgtgtatgatgaatgacacaattttattactttggatgtggatatacagttttccccccaaaaaattattgaagagactgtccttcccttattatgtattatcagcatccttattgaagattaattgaccgtatatgtgtgggtttacttatgagcctactattctgttccattgatctatatgtctatttttatgccagtctcaaactgtgtaaattactgtagctttgtaatatattctcaaatcagaaattttggtagctccagctttgttcttactattcaaaattgtcttgactatttaaggtcttttgcagttgcatgaaaatttaagaattgttttatttataattataaaaatgtttttaagatttagctagggattacattgaatctgtaagttactgtgggtagtgtagacattttcacatagaatgtatttttgggaaaagcacacaaaatccacatttttatctaatttctttcatcagtattttataattttaagcattcaaatgagtctttcacctccttagttaggtttattcctaggtattttattctttttgatcctattgtaaatgagactgttttcttgacttttttttggatagtacattgttaaagaatagatatgcaactcactttcgtgtgttggttttgtattcttcagctatactttgtagcctgaattagtttattagttctaaccttttttatatttttagagtctttagggttttatacatataagatcatgtcattccagagtctttttttataatttcaaatttgatttaagatgcaaggggtacatgtgtgggtttgttacgtgggtatattgtgtgatgctgaggtttggggtaggattgatctcattaccctgatattgagcatattacccaatagttagtttttcaaccttgtcctccttcatccccccttcatccctccctcctctagtggtccccagtgtctattgccatcttcatgtccacaagtacccagtgtttaactgccacttagatgtgagaacatgcagttttctgttcctctgttaatttgctttggattatggcctctagcccagcagcccttttaaaatgagcccaatacagagtctcctttggtgactgatgctgattaggtctccaataattattctttatataaaagaatggtgcaattgtgaatgggagttcactcatgatttggctctctgtctgttgttggtgtataagaatacttgtgatttttgtacgttgattttgtatcctgagactttgctgaagttgcttatcagcttaaggagattttgggctgagacaacggggttttatagatatacaatcatgtcgtctgcaaacagggacaatttgacttcctcttttcctaattgaataccctttatttccttctcctgcctaattgccctggccagaacttccaacactatgttgaatagcagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctgttgagataatcatgtggtttttgtctttggttctgtttatatgctggattacatttattgatttgcatatattgaaccagccttgcatcccagggatgaagcccacttgggggaggggggagggatagcattgggagatatacctaatgctagatgatgagttagtgggtgcagcgcactagcatggcacatgtatacatatgtaactaacctgcacattgtgcacatgtaccctaaaacttaaagtataataataataataataaataaagttaatttgatattttgcagaaaaaaaaagaatgatgcaaaggctaataatactcatattttacagatgaagaaactgggacttaaagataatatctaaaagcagttatcatagttacagcctctggcaaatagaaaacactcattaatactaattgccatcatcatcatcatcatcatcatcatcatcatcatcattattatcatcattttatattaaaaagaagaaacacaaaagtgtccagtagcacctaccacacacccactcctaatctgggccatgtaaaaactgtggagatgatgagtcctttgcaaggcatttccggggagctcctgttccctgggaagctgcctggtcatttttcggctgcttttttaataccccaaggagggctgtggttgaagctctagtcctggaactgacaacaccagaatccagaatctcccagtttcttaataccaacttgatggtggaatttgcattgtctagtgcaaaatgcagcccttttaacatttacatttgatctttatcttctggttatacagattacttcatctaattttacctgttatttgttttaaagcttttcaccccatcttacccaacttttagtggagaaaggtaatactcaaaagctctctcaattcttataacagcatataaaacatttcatgctcattaaactaacacccttcattctctcattcttttcaaatgtcaatccttaagtgacataaataaggttagcaaaaccttctaagagattttagactttatctagtacaaacaccttattttactatggagaaactggagctttcccccaaaaaaggattttcttaaggtaatcagctggtggcagagccaggactagacagatggacatcaggagtccagtcacccagtgccacacaccttccaattacatgactccacttggtgcctagtttatgacctccaaagctctgcttagtgactactttcattttctctgtgtatttatatataaaaaaactcaaaggagaaattacaaagtaaaaatagctcattataacttaacagtacccctaagcaatcagacattctgtaacaattcaatggccaggctgtcctattaggtactgcagacactgataactaccttcccaatagccattctctcctacttcctaggtgacagaccccagttttgtttgggggcaccaatatgcccaactccatcaagctactctctttttcaacctccctggctgccaggagcaacaagatatagtttgggccaaggagttacaggcagaagctgagtaagcatttggggaagacttgtttttctgagtaaatgaataaagattgctggcatcacatcttcccttttcttctctttgaaccaaaattgatatctagagcaacagtagccacctggaagccatacacagagacaacaaaatggaaggctagaggtacgggtcattgatatcactggctggctgcaccagacctgaactattaattactgagtatcttttcagtaaaagaaacaataactcagaaagcaacatggtatagaacctaaaagcactgcctgggagtgacagacttgggtgtgagtcctggctagctgcctgaccttgaaaaagttacctaacttcactgaatgccagttttcccaattcacaggattgatttaaacattaaataaaagaatgcatataaaatgcttaaaatggcacattgcaagccctcagtatatggtagcctggttcaatgtaggaatctctctctgcaattatctgattattatccattgtttatccagggaatgtatgcagaattgatctcattggtcagcaaacaacatgtattacactcacaactttatatgtagattggtcatggaaggcacaaattaccaaaataaaactaatgaatattcatcaaagattgccttagaatcctagaacgctaaagctagaaagatagcttaaccttcatccaataaatatttgctgagtgccaaatatatgttcagaaccatgctagtcactgttgatatatgaatatatcattgaagtaagattcctgttctcacgggatttatcttatagtgggggcatttcctaatgtatatctaatatgaccatctcaatcacagctgaagaaactgaagcccagagatgttaaatgacttgcaggcatacctaggtcacacagcagttaatggcagatgttggagtaaaattcaagcctcttgactcctattgggttggtcttttgtctatatcctgaaattcctgatttacatttttgtataccgtcagaaagtattccttgctgtccaccaggatgactgagatagaaaatctgatccctgagtttccttcatttcctaccactctctcatttccctatgctccacgaagtatagtcttggtgtgatttcctcaaacatgtcaaacttgctccttttacaagactcttacttctggttggccttcatccctagttttatttgtatggcattcattcaccatttcagcctcagcttgagggccatttgttttgactgtcccttaaaatgtatcattatcattctctacctcactcaccatttctttcagctcatatatataaccagctgaaattaacttactaactttttttccacatgtttgttgttgggctgcatgagggcagacaccttatctgccttgctcactgctgcattccagaggccagaacaatgcctgcaaccagagctggtacccaataactacttgtcaaaagaacattgggtgatgctgttagctctagaattctaggctcctgagacaatctttgtctgataaatatttgtgagctatacttggcaatctatgttgaacaaatgaatgaataaatcctggagccattttgtatttagctttataagatactagatcctgaaaagatcctgaagcaaagttactcgaaccctttaatgtaaaacaggagtatattagtccattttcacacaaggcacttcttacatggcggcaggagacagagagagagcgaaggggaaactgccacttttaaaccatcagatcttgtgagaattccctcactatcacaagaacagcataggggaaaccacttccaggatcgcatcacctcccatcaggtccctccctcgacatgtgggggttacaattagagatgagatttgggtggggatagagccaaaccatatcaaggaggaaagtgaagttgagtacttgccttgagatctaattgactgaattaactgatgtgtagacagggcgaagttgggggtaaaatctatccatggctacctctctaaaaatctagaataatagtgaatgagatagcaactgatgatttgactatgagatggtccaacttctctcacccactcctttactctctgctgccctaatcctcttaaacctcataggatgcatgcctgaaattccatcacagattttctttttcttttatctggggctgcactctgatggccctgggcagcacagtgtttctgaaacacttgcatgtggatgcctctaggtgaggcagacactctccagctcccctgaacccccactgctccctattgtctcacctctggctgctttagaaacttatcgtacctgctggacctctggaaccacgtttgttttagggctaaagtgcaatttcttcagctgctatcaatagattacatttgaccatgagtaaatgacccagggctaattttgttgcatggaggacaatatcttgaagatatttatagtcgcatagggtatcagaggtaaaagaaatttagacatagtcttttctcacctttttcacttgagaatgaagaaacaggcttaggaaaggtagatgacttgcttaaggtcacacagcaagttagtggcagatctggtactgaaatttagacttggtgaccaaagtggtctggcacagagcaaggatgctttgaagtacttgggcggagggttgggggggtggtgaaagaaagctgggatggctggtggtggaatttagaacatcttcaagattctgcctgggctgagcccacctttctcaggcttttcctcccagtagaactctggaaggtaggatacttgctcctcccatgtaatgatacacttgtgccttcatcctccttcactaatttgtgtctgtatcttttctgtcactttatataactaattactgtttactctttccaagcagggtgtgtggggatccaaactgtgggagagaatggtgttactttggggaagcctttgcagaaacaagacagtctggaagaaagggaaactccagctgcagaattttcttctcttttcttgctgtggccccatcctcccacctggctctaggggaaagtcctatttaaaagtgagagttagtaacttagcatctttcagcagatatcacagttgcctctggcacagcctcttgcaccctcgtacttcctctcctggctgtgcctgcctcagcatggggataactgactgccctcagttttcctcaccctgctactagatttgtagctggatttggggacctctgaaggaattttaaccacatagggaagcggtatgatcaagtggaagaaatgaaaacaccaaggctcgtaagattgagatctaatcctgctctgccaccaaccagctgagtctcccctgctgaaccatcagtcagctctgtggttgcaagaccgatagacttttctcagcactggtctcatttaatctctgcaacacttgcattgttgaccaacctctttaacaatttttaaaacaatttctaattctgaaatgttccaaaaagtacagaaaatattacataatgttgagcaaacaaaccgtacaatcagacctgagcaatgattatgagaaaaagctcaggtggccaaaggttaaattctgggagggtcttagacttggggaatggagaagaaccagggggaagaaaaagcctttactgctttgctccctctccccagaagttatcactacactaaaagtcagtgtatatcattcacagtaggttttaattcttttttttttttttttttttttttgagatggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagggttttaattcttttattataaatgtataataaatatacaaatatgtgtaatatatataaataatacacaaatattatggtcaaaatatactattttaaatgtttttatgttttctgtatgtttacgtttatgtgaatgatggtatccttttgaaagctgcttttttattcaatgccattcttttgagattgtctatagtatatgtatacactgagtccatcttaatcgatactccactatatgaataacccacaatctatttttttctcctataagagatagataatttgcttctactattttgctaccacaagcaatctgcaataaacatacctgtgcacaagttcgagtttttctaggtcaaaaatctagaagggggcttgctaagttattaggtatgtattcattttaaggttcttcagaatagttataccaaaattctgctaaatacttagatgaaaattctgccgaattgctcttcaaaataattataccattgaactctcccttgaataagagtttctgtttcctgacattctgccagcccttgttgtctttgatttataaagttttgccaatatgatgagtatcaaatggcatctcattgtgctagcatttccctattttcttgtgagatcacatagcttttcatttattgtattgaccactcagttttcttcctctaggaattgtcttgtttctcattttctggttgggttgtttggtgttttctcttagtgttttgtaagaaattttatatcttggcttgtaatactttatctgttacatggtttacaaataatttctgtagttggcttttttcactttgttttgggcatattttgccatacagaagatttaattttattttcccccagctttatggagatatactttacaaaaatatataatatatatgtatttatggcatacaatatgtgatattttaatatacatacacatttttaaaaaattaaatcaatctaattaatatgccacctcacaaacatcatctttttggtgttgggaacatatgagatctactctttcagcaatttttaagtatacaatccactattattaatcgtagtcaccatgctgtctagtagaactccagaagtatttatttatcctgtctaacaaactttgtaccctttgcccaacatctctcctttccccagcactccctaatccttggcaaccaccatttcactctctgcttctatgagtttaactttcagaagctttaattttaatatagtcaaagaaaacaatatttcattgttggattacaatttttgtgttttgttgaagatgttctgcctaccataatgccatacgagaaacttctaacacccctgtaattgaaaatggtattcttcctccctcaacccaggattttagttctaccttgtttttattattctaaatgactggtattattattttcttttttcttttcttttttttttttttttttttttttttttgagacagagttttgctcttgttgcccaggctggagtgcaatggcgtgatcttggctcaccacaacctccacctcccggtttcaaggattccctgcctcagcctcccatatagctgggattataggcatgcgccaccatgcttggctaattttggatttttaatagagacggggttggtattatttttattttatttttacagaacagcagagcaaatactttctcagcgctacccacatgttcattaaatttttggggtatatcacttcttgaattatatttctactttctggtttaatttcctttttcctaaactccatccttcatacttaagtgagagactctatgtaaatgctcttagtcttgtttaaaaacgtatttgtttcaacattgatgttgaaatatttttctttatagatgatacgtagtgtacaaatattttctcccattctcccaaaaggttatctgtttattctgtgtatagtttttttttttcctgtgaagaaactcaagtttaattacataccacttgtcaatttttgcttttgttgcatttgcttttggggtctttgtcatgaaatctttgcctgttcctatgtccaggacgtattgcctggcttggcttccagggtttttacagttttgggttttacatttaagtctttaatccatattgagttgatttttgtatatggtgtaaggaaggggtccagcttcaatcttctgcgtatggctagccagttattccagcaccatttgttgaatggggagtcttttacccattgcttgtttttgtcagctttgtcaaatatcatatggtcatagatgtgcagccttatttctgggctctctattatgttccattggtccatgtgcatgtttttgtatcagtactattttgttttggttactgtagccttgtagcatagtttgaagtgagtaacattacgcctccatctttgttctttttgctaagaatttccttggctattagggctcttttttggttccatatgaattttaaaataggtttttttaatacttctataaagaattgtcattagtaatttgacagaaataacattgaatctgtaaatggctttgggcagtatagtcattttagtgatactgattcttcctatccatgagcatgagatgtttttccatttgtttgtgtcatctctgatttctttcagaagtgttttgtaattcttattgcagagatctttcacctccatggttatgtgtatttctaggtattttattctttttgtggcagttgtaaatgggattgcctttatcgcctcattaaaaagtgggcaaagaatgtgaacagacactttacaaaaggagacaaacatgctgccaacaagcatatgaacaatactcagtatcactgataattagagaaatgcaaatcaaaaccacaataagatatcatctcacaccagtcacaatagctattactaaaaagtaaaaaataacagatgctgcaaggttgcagagaaaagggaacacttatacactgctggagggagtgtaaattagttttgccattgtggaaagcagtatggtgattcttcaaagagctaaaagcagaactaccatttgacccagcaatcccattactgcagcactattcacaatagcagaagacatggaaacaactgaaatgtcatcaatggcagattagataaagaaaatgtggtacagatactccatggaatactgtgcagccacgtaaaagaatgagatcgtgtcttctgtgggaacatggataaagctggaggccattatccttagtaaactaacataggaacaaaaaatcaaataacatgttctcactgacaagtgggagctaaatgataactacttatgaatacaaagaaggaaacaacaaacactggaatctacttgagggtggagggtgagaggagggagaggacaagaaaagattactattgggtactgggcttaattactaggtgatgaaataatctgtacaacaaactcccatgccccatatgtttacctatgtaacaaaacttcacatgtacccctgaacctaaaataagagttaaaaaaagaaatttttttttactgagaatagatgcctaaactaataattatatcctctcagctctctaaggataaaagccccatgtcttctagtctgtactgttgctgaaaatttgctgttgctctgcaaataagcagactcttccctctaataatattttgtcttctatgtctttgatatcatgcagcttcaccaatatttttatatatgaatttactttcattttttctacttaggactcattgttattattatatattaatattcatgtacttcatttattctgaaaaaattccagccatcattttttgaatattgcctttccccaattcatcctatttgatttttgtgtctcatacgaaatataaactaatttattttcctctgtgccctatgtcctttaaaatttcagatattatttatctctgtactaccactttgctaatttcctcacttcagtcttttagttcattaattctgccttcaactattgtttacgtaatgttttattttcctttgacaattttaaattttgattactatgtttttctctttagaagctgtatttggctacattggtttattcttcatcataatgtctcatggctgtcttatggtttcaatttattctattgtttattaattttaaacaattatgttgtaatctctcaaactggtatgcaatctgaagtacttatagttaaaatttttctgcttttgggtcctctgattctgactcaaagcagcttttactcccatatagttttccatttttggttgtgagttcctctttcatgggacttttcctgtgagaattctggacaactttggttcagtgtgtgtcccttcagaggagtatcaagttttcttccggcaggagacctgccagggcaaatttcatgatattttcttggcttgtgagttctcagatcaatgacagtagtataaatttgaaccacacatattcattacaaaatggaacttttcatcatttgttctcaaagctactctttctctgattttgttccagtcagctaaccaagaaggaaacacagcatcatcattaatgtctcatattttcttactccctaatccaaatatgtgactcctgtggcttctatctcattactttttctgaaatgcctcaatttctctccacctttaatgtaattaacttaattctttgatctcatacctgaaataaaccttctaattactgcttctgccacaagacttaaccttccctgattcattacaccacagctgaattgatattttaaaaattcaaatctaatcctgtcattctatggcttaaaaattattactgcacctccatcactttcaaaataaaaataaaaccttgaattctaagatgaaattcaagtttattggcaatctgagctctgtttttggcttttatctcttgcaaatttctcttgaatgcctttatacaaatgaccaatgcttcaaccatactaaattttcaatgtgttcaaattcccagaatatttttatatgctagagaaatcaatgtgttgatccataaaatccagatgaaagcttctcagcatgaattattgtcacatcttttctgatgacaaaaattgttattctttattatacgtcattatactaagcatatttactatgcttcgtagtgaaagtatattaaattgtagtcagcaacaatattcttctttttaggaattgcattcatttgtttatatttcagtagcagtataacatatattcctaataatatgacagtgtatgcgtttaaacatattgtcaatgacaaatataataatagaattctcacagacaggtaaatgcttgtcttaagtgagttcttaaaggcgaactgagttgttagataatacggttagaaattataagaataaaaagttgagatcaataagttcttttctggctcataattttacaattctgggtttcgtgtgtgtgtgtgtgtgtgtgtgtgtgtaaagttacctaattgacattacagtaagtgtaattcattgggaaaagcaataaaataataaaatattatagctgaaagtgaccttaaagataatttagttcaatagtttctgaaatatgttactagccagaacattgcttccaaagaaaaattttgaaatccaacatgtgagacaggtacatgtgggcctcccctgacttcatttagagactttaatactgcagccctatgcacaagtaatccttccttctcctatctacccgcaacaccgaggttacacagaactaagtttaaaaatcactgatctaccgcaacccagtcactgttcaaatgaaaaactggaagcccagagacccaatgatgtattcaaggtcaattagccatggacaaggctggctttaaccctaatcttgtaagtctccatgaagttctatggctatgactcttattttttacaataagttcaacccaatctcagaaagccaatagaatttctcatttctcatatcccataaatagattaatgttttaatgtaacaagttttcccatgtatttactccctagaagctttgacataagaaatagttgctcattgcagaaaatttcaaaaataaagaaaaacaaacacataaaagatagaaatcttcagaaatctctgctggaagaaataaccattgttatacttttttctctgaaaacagtttttttttttttaaccaaatgggattatacaaggtgtatcagtgagcatttctaactgcaaatagcaaaatcctctttagctaatacagacagaaaagacatgtattaaaggatattaggcagttctagaatctctagcaagatcagagagtcagtgttgaagtcaatccaaccagaaaataatactcaaacattacaggacttctccagagaaaattctagcaccaccacgaccaatggacacagatgccccagctcacactctagaatgtggtgtaggcccaagatccaacaccagcccaaagtgagattctccactgcctcccaaaaattacaaaagaaattttcccatgtcatctgcttcatcccattttcctctcttcttgacgagactgatagcacccaggacacaggacacatctacccaccaggagcaaatcatgccccaaacatgagaagggtgtgcaaagatcccacaatgcaatgacataacatttgtaacaggaaaagtcttcatatatttgtgttcttttaatttatatattatattaattattggcctgacaagattgatacattgaccattatatgcaaatcatcttgccgtaagcaatttgtattgattccaaatataatgaataattcaatttatcctttcctttttcttgtcctccaaaaaagtattttaaaaatcttttccaatttaaatgatataaattataaaaatgatgcaacccatttataaggacaaaaatccataaaattttgggccgcatgaggagttagtgtagtgacacacttatttactccaatgactaataattattgcaacatcatgtttttatctctccaacttagttaaaagtatcgtacagatgatcagttgcttcagacaccaatcagcatcccacggacttccgatcaaagactgtggctgcaaatcaattgcagcatatggcgtttgtgcttctattacccagagcagtagctgaggacatagtaattaagcaaatgctaatgagaagtctaaaatattcacaaatgtatgaatgtatggattatagttatttggcaccaattttaagtaacaagcacaatctgtgtcaaaatgcacttgtgaaagtcttagtatgtgccgataatatcttactactagtctctgaatgtgtccaggaaatctatttttacaaatttaaatgttgcaattatcactacctcactaataaataatcctgattcatcttccagaagcaaacctcaaatttggttactctccaacttcaactctggataggctctcattgtttattctttaaagttcacagttcttacccaagcattcaaagctctctattaactcacctcaagcaactttttcatgtattatccccccattcccgttgtctctagctcagcgtttcccaatgctggcattttgggggctggggctggctttttttggagagctgatcagtgcatattagaatgtttcacagcatcctgacctctaaccattaaatgtcagaagcatcaccacccccttctgctgcgacaaccaaaaacatctctagacattgccaaatgtcccctggtggtggagggaggggggtgggaggtgccccagttgagaagtactgctctagcaaaactgaattactcattcttcctacacaaactctgatttttcctgcctccatgtccatctttcattcattctgcatatattttactgaacattgactctatgaaaagcactctaccaggtgctaaaagttcagtagtgaacaagatggctatggccctgactttgtgtagctaatagccttatgaaataagccagatcaagtgtaataagccaagaaggcagagagttgagtaagcagcccctgaagaggtagagtgaaaagtgctgagagcagaagcctccactcacctgagtaggacatcctttccagaactcagtgtatacaaattctacccaccccctgaagcccagctcagatgctggctttattcagccttctctgatagcttcatatagaagtaatctcctatcctctgcatagccagagcagacattctctatggtacttggcaccctgctctgtattggttattattcatggccccattattgcatacatctctgactacatgaacctcttatgtataggatgcatgtcatattcatttctgatttatccacaagaaactcagttctttacacaaaaagaaaagctaaattcacatctactacaggctccaaccagggtcttttccaaagggcagtgagggtaatgtgtttaaaatgccatacatcaccttagaacccaagttgaaacagtttctcatcactcttgggattaagaacaaagccttgaatgtagctaccaaagtccctaatgcctgtctcattcttcttcttactccttacctcttaccactgtgccctttactgtctgtgttccagccatattcactccttttcaattgcttcaaggtgccatgatctctcctaaagcagggcctttgcactgctcttttcactgcctagaatgctccccaaccactgtctagcctctgcatcgcacctttcaactgtcactttcctacatagccttatctgaccctccagccaacatgtggttttttggaaacatgttaaagaatcaatttcttttcctgcataagttatttagcctatattatatccttgcctctatgattgataaaggcttatcgccttcactatatcaccagatcagtgagaacaagtacctcctacactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacttaagtagccatcagtgaactctgagggaagattctgggattaagaggaaagagtaggaccataaaaagggtatgtgcacaggagagtcagaagaaatgaggaggagctgagggaaggacagactgatttgggggaggttggtggtaaagaaatgagacagaaaagtgatgctcagaaggccagtagttgaggccaggcacagtggctcatgcctgtaatcacagtacttcaggaggctgaggcaggcagatcacctgaggtcaggagtttgagaccagccttgtcaacatggtcaaaccccatctctactaaaaatacaaaaattagccaggtgtgatggcacacgcctgagtcccaggtactaaggagtctaaggtactaaggcaagagaaacacttgaacccgggagatggaggttgcagtgagccaagatcttaccactgcactccagcctgggtgacagagtgagactctgtctaaaaaaaaaataaaaaaagccagtagttgagatcagaaaaagtaaaatcagtgaaggttagtggtcagtaagaaagaccttcaagccatgaagtctagcactttaaaaagtgtcttggaacacagtaggtactaaataaatatttattgagtaaattctgaccaaataatcttctacttaaagtaaatctactttttagtattgtgtcagacttatttgtaattgcctgactactagccttccttccgctaacaaaattcatgttgaaagaatggctggtgagctatctggagttgtaagacacagactttaaaataactagttaacatgttcaagaaaatagacgataagatggacagaatttcacaagtagattttaaaatattttaaaatcaatgtaaattctagaattttaaaatacaattattgaaattaagtaagttaattgattaatgtaacagcaggatatgaattacaggacatagataaagagaacattaaaaaacaggaagatagtcaagtagaaaaacacactgactagataatagagataaaaaagaatggaatacaacaaaaggaaagtatagccgatagatgagatacattgaaatggtgcaaggtatatgcaattggtagtccacaagatgcagagaaggaaagggcaaaagcagagtttgaagaaatttctgaaattgctgaaacacatcaaatcacaaatcaagaaatattatgaccgcaaccaagatcaatacaaagtaaaagtaagcctaggcacaaaataaaaagaaaaatctgcttaaaactccaatgtaaatagaaaattttaaaagcagcttgggaggtggggaggaaatagacacatttcttcaaagaaaagacatctgacttttcagcagtaagtatggaagtcaaacacaatggaatgaacaattcacaatactgaaagaaaacaatactgtcaacctggacattttatatccattgaaattatccttcaaaagtgaaaaaaaatgaaaacactttaaggcaaataaaaacagaatttgtcatcatatctagtactggtaaattttaagagttctctttacgaagaaaaatgatcccagagaaaaacatgggaatgcaaacagaaatgaaaaacaatggaaagggaaaatatataagtaaattcaaattatttattactatacaaacaatatattatgttttttgcagtttaaaacatacctagatttaatatgcaaaacatctaagaaaggaaggagataaatggagtcagagtgtttccttagcattgtctgagaaatggtaaaagtaaaaagttatattaagctaataacataagcatattttaatctctataataaccattaaggaatatacttctaacaaatcaataaaggagaaaaagcaataataaaagacaaattggaatgtacttctaacaaatcaataaaggagaaaaagcaataataaaagacaaatttttagtccaaaatatggtgggaaggcttataaaataattataaaaaaggacaactagaaaataaaaattaccatactagacatacattcaaatatatttgaatgtaaatattttaaataaactcatgaaaaagaaagcattgttaactgggttccaaaagtgtgtgctgctttaataaagttagtttaaatataaggacaaataaaatatgaatatatcttcatatatatacatatataacatatatacatatataaacacatatatattatattatatattttaatatatgtatattatttatatatatatatttttttttcacacatgactgggggcctaatcagcaccagtcactaaaggaagctcttaactaggcttatttcaacaggactgatagggatgacatattcctatatgtagaaaaccctaaatactccagaaaaaaaatgttggagctaagaaaggaattcaggatacaaagtaaagtttcaaaatacaagatcaacacacaaaaagcagttgcagttttatacactagtaagaaactatccagaaaaaacaaattaagaaaacaatcccatttacaataatttcaaaagaataaaatatttagaaataaatttaaccagtgaggcaaaagatccgtacgctgacaacaaaaaccagtaatggaagaaattcgagaaggagaaatggaaaagatctttgactttagttctggcaataattttttttaggtatgacaccaaaagcagaggcgacaaaagcaaaaatgaacaagtggcattgtatgaaactaaaaagctcctccatagcaaaataaatagccaaataaatgaaaatgcaacccacagaataagagaaaatacatgcaaaccacatatttgataaacggttaatattcaaaatatatgaggaactcccacaactcaatagcaaaaaaaaaaaaaaaaaaaaaaaaaaacaaataatgcaattaaacattggctaaaggatttaaagagacatttttccaaagaagacataagaatggccaagaagcatatgaaaaggtgttcagcatcagtaatcatcaggaacatgcaaatcaaaaccacaatgagataacacctcacatcacagaattgctattattaaaaaaaataaagataagtattagcaagaatatggagaaaaggaacccctactacactggtgatggaactgtaaattggcacaagcattatggaagacagtgtagaggttcctcgaaatagtaaaaatataactaccatatgagacagcaatcctacttctgtgtatttatccaaggaattgaaatcagagtctcgaagaaatacctgcactgtcatgttcaccgcagcatttttcataatagccaagatggaaaaagctgcctaaatgtctattaatggatggataaataaagaaaatgtgataaatatatgcagtggaataacatttagcctttaaaaagagggccaggtgtggtggctcactcctgtaatcccagcactttgggaggctgagaggggtggatatcttgagctcaggagttagagaccagcctgggcaacacagtgaaaccttctctttgctaaaaacacaaaaattagctgggcacagtggcatgcatctgtagtcccagctacctgggaggctgaggtgggaggatcattggagcttggaaggcggaggttgcagtgaactaaggtggtgcggccacactccggcctgggagacacagcaagaccctatctcaataaataaataaataggaattctaccatttgtgacaagataggtggactcacaggatgttatgctaagtgaaataagccagacacagaaatacaaacactgtgtgatctcacttctatatgggatctaaatcaatcaaactcagatgtagaaagataatttttcagaagctgggggttggaaagatgaggagataatagtcaaatggtgcaaagtttcaattatacaaggtaagtaagttctggaaatctacacacagcatagtgcctacagctagaaatactccattatatacttaaaatttgctaagagagtagctcttatgttaagtgttcttaccacaaaataataataataataaatcgggttggggaaaagtttgggaggtaaaggtcgtgtctatggccttgagtgtggtgatggtttcacgggtgtatacttactcccacactcatcaagttatggaccataaacatatacagctttttacatgtcaatgatacctcaataaagtagtttaaaaaataactggggaattttttaatatttggaaattatgcaatatccttctaaataaaccatgggtcacagaagaaatcaaaatgggaattttaaaatgtttcaaactaggtgataattaaattatgatgtgttaatatttatgggatgcagataaggcaaggcttagtgggaaatttataaccttaaatgtatacgttataagaaaaattgttaagaatataattttttcaaaacagcttaaattacataaataatcaactaagaagctagaaattgaaaagcaaattaatcccaaaaaatagaatgaaggaaatagaaaaggctaagcagatgttaattaaattaaaaccaacaacacagaaaataagcaatgccaatacttgattccttgaaaagagtaattcaattgaccctagacaggcttattaaaaaatgtttaaagagagaaataaggcacaagttatcagtatctggaatgacaaatggcacataccagagattctacaaacatcacaaaagtaataaacatgtaagcaactgaatatccataaatttaaaatttagatgaaatggagaaattcccagaaaatcataatttaccaaatgtactcaataagaaaaacaaaatctgtaagtaaaagcctttctacaaaatcttcaggcccagataacttactggtgaattcttccaaacacttaagaaataaataacaccaacttacacaaaaacttttaaagaaaaaagggcagaatgaccttgataccaaaatccaaaagggcattacaagaaggataaatatatgcatatttatctcataaatattgatctaaaaattgtaagcaaaacatgaacaaattgaataaaaccgcatctaaagcaacaaataatagttatttcatcattgtgaggttagtttaacaaatataaatcaatgcaattctccatgttaataaaggagaatattcataccaccacctcaaaaaaagcatttgaaaaaatgttataattacgatttacaaagaaaaaactcagcaaactaaggatagagggaaatttttgtaatcccaaagaacaccttataaagatattttacacaaaatactatacttaatagggaaatgctaaaagctttttcataatatcaaaaatgggcaaagatgtccactttcactacttctattcaacagtgtgctggaggtcctagccagtatgatgaggtaagaaaacaaagtacaaagtttgaaatgaaagaagcaaaactgccattatttacaaaacgcatggctctatacatgaaaaatttcaaataatctgaaaacaaagtgttagcattaataaactaatttagaaaatatactagatacaaggttaatttccaaattaattttattttgacataacatcaacaaataattagtaagttaaattgaaagtgatgccatttatagacatacagtaacacatgaaatgtcctaaactacaggaaataagatagggtgatattggtataagagttgactaacaaaccaaagggacaaataggatttggaaatagccccacccgtaatcatcacggacttaagatacagagtgcagtggagaaaaaagacttttcaatgaatggccctaggtcaatctgatatctatatatatatttaaaaactcatcataacccttaccatataccatgtaaaaactcaaattcaaatgaatcataaatctaaatgtgaaagataaagtaatatagtttctagagaaaaacttatgggttttctcttcacgaccttgaggtaaccaaagatttcttaaataagatgcaaaaaggcactaaccataatagaaaccattgataaattagactacattttgaagagcttctgttaatcaaaagtcaccttcaaaagagtgggagaatatatttgcaacatgcgtatctgaaaaataaatggctttattcagaatacagaaagaggtcataacaatatgaagagaagcaatcaattcaacagtaaaatgaacaaaagacttgaacaaaatcttcataaaaaaaaagatatcaataccagcatttgccaggatggggagaatttagatctcttatactgttgctggaaaactgagagtatcttgcaaagctgaatatacacatagcctgtgatctaagcaaacctgctactaactcaatgtacagtagaaatgggtacacatatgcaagaaaaataaaaagcaaaaaaacttgtatagcactcagtgtaagagtgtaaaaatcaaaacaattcaaaggtccactattaaaatgaactttaaaactgtgttgcattcatccaatggaatagttagccatgaaaatgaattaatcacttttgcaagcaatgaaatggataaatctcaaagatataatgatgaatgaaagaggccagacactaaacaatatagaatgtatgattcaatgtatatgaaattcagaactgatatatggtaattacctttgcagggtagaggtagggactaagcacttcaggtattggaaatgttattatttcttgacacagttgttccaataaaaacatttttttcaccacctacctggaccagtggggtaggaacacagtggagaagatggctggctacctatatactaaatgagataataaagggaaaacattttgtacactgtaagccactacgtaaaataaggtatctctgtatacctattgcatttgatggctcagacagtataggaactgactgctatatctcacataagcacagtacagctcgtgttggctcagctggtaccagggtcaactggaagcagggatgctactgtggccgggacattcccctgcttggtctcttgggtctctgcttttttcagtatgttcaattctttctatgttaccacagattgcattttcttttcttttcttttctttttttttttttttttttgagatggagtctcactcttgtcgcccaggctagagtgcaatggcgtgatctcggctcactgcaacctccgcctcccaggttcaagcgattctcctgcctcagtctcccaagtagctgggattacaggtgtctgccaccacacccggctaatttttgtatttttgtagagatggggtttcaccatgttggccaggctggtctcgaactcctgacctcaggtgatccacccgcctcggcctctgaaactgctgggattacaggtgtcagccaccatgcccggcctcacagattgcattttcatgaggaaagcatgctctagatcttcacgttccgcagttactacctatattgaaggacagagcgggccagggatccccttcaggacaaattatctatggccctgaagtcaggatcatgtaacagatttttatcaccattgtatagatgaagaaactaaatgtttctgtgatttaaaaaaaaaaaaaatcggaaaacaaatcaacccagactgttacagctgagatctttaaacctacagagtgtagcagtctcttctttctgaatggcctgtacaacacttggtatattaactgctaccaagaagcatgcaaaatctttgatgcggattaattaacacaactcaattctacagatcctactatatgtcaggatctgtgctatgcttagtgggggataatttgataaataaggcatggccattgccctctgggtctcagaatctggtagaagagaagttcaacagataaatgattttaatatatatggaattttaaaaaatattcaaaatacaaacagaaagaaactaacagattaatttggaattgcagagactggagggaaaaaggagtgtagagcaggtgtcctttcaaatgaatttgaaatatgagaagtactttgaaaggcagtgatagggaatgaggacattattgggaaagggtagaaaatgagcaaaattagagctgagagaatgcaggaaggatttgaggaactgtagtttacatgatacagctaggacacctggcatacaggcaggtgtaaatatgaggtataacaagactgcagataggctgacacacttggaatgtcaatgtgagaaatctgaattttcatgtgaacacagttgaaggtgttaatgcaacatcacattggtttcaaaaaaaaatggagctatgtacatatttaaattgtatttactagctctctgaccttaggcaagtggcttaactccaccaaaactgactccttagatgaggtaatagtgcatgtagaacatttagcactattatatattcagtatataatatgtgctttgtaaatgttagctgccattattattgtttctatgaaggagagagaatcatacatattcaactctgtatgatggttaaaaaccagcttctgagttattttaaattttatttagatttacgtttgtgatgctgtggcttaaatccatacaaaatatttggtgataggtcccattgttctttgatatataaaataggtctataactgatttgtcacttctatgaattagcctcctgtcaaaaataacactttattggaagttgtctgcaacatttaaaagatttggattctttaccgtgaaacagcaatgtttcaaatcactataggtacaaggtttaattggtaattgttttatgtccctctaacttaagcaatattactgtagattatttctggagataaaggcaatccttttttcagttaaaccttaatcataatggtggaagtaaaaaggtattgtggggaagcactggctttggcattggcttgatctaggtaagagtcttaattctattccttcctctttgtcttcagagaaattgtttaacttcccaggaacccaattcctcacttgtaaaatgagataaagatatttatgttcttaacacaatgcttagacacatgataattccttcttttccatgctcccagatcacagcacaagtactgcttaggggggaaaaatgtagtgggcacagactggaccagagttcagatacttcggtcaaaaagttgagatacttttcaagcttcaatgttggcctagcctgcccatgctgtgattcgggcagcagtgatgcatgctgtacagggctcatgaattgactgaagatacttgaaggaaataaaattagtcattttttatgggtctttgttgtttttatacccatcctcccaacatcatttccactttcttttcctaagaaggccccaactcaactttgatgagcctctccattcccacttgcagttcaagtgccctgggtgggcaccatgtgcctccagagatggagcatgtgacccagtcccagccaattggagcactaagtttctctgaccacagtaattagttcatcacaggaaacatgatccaagttggtccaatcataagaataaagagatatgtgtagtagctatcagaatattctatttttctgtctgtcccactggatttcaatagttggagcctaaaacataaatgtcccatggactaagccccacaatactcactggctagagtttttagggaagtcaactttagggaagtcaaaatggagaaaccatgaaagttatttatttatactttcaaatttaatttggcaatgtcgtatactgccaaatcattgatccctagagaatcccaatcagaatactggagggcgacggctaagatgaggaatggtgcaggagcttagaaccttgctctggactatctaactgcaactgtaaacttaggcggaatgaactataccccaaatctatccaaaaatacattcttgtctggatgaagagctggtttatcaagcgataactaaggctactttggagccaacagtgtaaaccgtgcttactttcacattcactcaacaaatatttattgagtgtataccgttctaagaaactgggtaaaataagcagtgcctgccttcatgtatcttaaagtcttgcaggggaaacaaacaaacaggcaattatcatataatatcataaatattataatgagaagagtatataaaatattaaggggacattttagagaagcagctaatctaggctttggtggtccacaaaagcttctgagagattgtgccataactagccaaatgaagtggtgaagaagaatgctctcagtagcaagagaatgccatttatggaaaaatggaagtaatgcattagaactggaatacgggccgtaaagtagaaagtggtatgatacaatatagatggaacaggggccaaatcacaaaagcctttaacagccatgttaaaaagtctggattttaatcaattgaaagcaatggggaactactgaaggcttttaagcagaaaagcagcataacaagattgacattttagaagcatcactccaaatgcagcatgcagaatggattggagggagacaagagaagaacatttctattagccccttagtgtgaccaacaaggaggatattgcagtaacccaggtgagagatgatactgttctaaatcaagccattgtcagagagatgtaaaagaatttcagagggattaaggaggtcgaagcagtagggtttattattttattggttctgaagcttgcctgatcttcggccatcaactcccagatggccagtcaggatgctacatattctatcaggagtgttaatagaagagattcttacaacagacaagggactggttcatctcacttaggatccttttcaagtttgcagtactttgattctgtgctgaagatagggaataagaatgaataattacttaattaatgatttattgaatgataggagtggggaccccctcgttgcctaaaaattggtaagatattggaaataaaaagaaagcactacttataatggcattgcattgcacacacagctaacctattctgagagagaaagagaggacccaattgaatattaccggcaattttgttcagtgttccactgattgatcacatgcccccaaataaacatgagacaagagctgggtatcttctcttccttcagtcaactcagttcccactgtccttcactggggacaaactctggcattcttcttctaattctggtgatcaaggatatgaatttttgaattttcaaacatcatggctccccaaaatataaggcaaatacttattacagttctcaagataatgtgttccaatactagaaaaatggtgatgtggatttattgagaaagggcatattaggccccacttttgtataatgtgcttgtgtataaggaatttttaagggtttttttttttttttgagactccgcccaggctggagtgcagtggcgcgatctaggctcactgcacgctctgcctccagggttcatgccattctcctgcctcagcctcccgagtagctgggactacaggcgcccaccaccatgcccggctaattttttgcattttttagtagagacggggtttcaccgtgttagccaggatgttcgcaatctcctgaactcgtgatccacccacctcagcctcccaaagtactgggattacaggcgtgagccaccacgcccggcccatgagccactgtgcccagctggtatttttttttaactgtgaaaattcaccttaaatattaatcttagaaacttttgagtgagatttgactccagagaagaataaattaatggaaattacactatcccagaagttgcagaacttgaaaatacaaattttataagttccagaaggatcattggaagccagggcatttcagaacaattctaatatgatgttgtccttccaataaaacattgctcatcacaactatctgagaaaaagagtgagtggaggccttcttcagccctcatagtcttgtggatagaaagctcctaaaggtggtggaggagccaagatggccaaataggaacagctccggtctacagctcccagcctgagcgacacagaagatgcgtgatttctgcatttccatctgagctttgaagagagcagtggttctcccagtacgcagctggagatctgagaacgggcagactgcctcctcaagtgggtccctgacccgtgacccccgagcagcctaactgggaggcaccctccagcaggggcacactgacacctcacactgcagggtactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagtgcctctcctcctccaaaggaacgcagctcctcaccagcaacggaacaaagctggacggagaatgactttgatgagctgagagaagaaggctttagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactatgtgaagaatgcagaagcctcaggagccgatgcgatcaactggaagaaagggtatcagcaatggaagatgaaatgaatgaaatgaagcaagaaggaaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttactctcaaagggaagcccatcagactaacagcggatctgtcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatgtaaaggaacaaccggtaccagccactgcaaaatcatgccaaaatgtaaagaccatcgagactaggaagaaactgcatcaactaacgagcaaaatcaccagctaacatcataatgacaggatcaaattcacacataacactattaactttaaatgtaaatggactaaatgctccaattaaaagacacagactggcaaattgggtaaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactattctaaatatatatgcacccaatacaggagcacccagattcataaagcaagtcctgagtgacctacaaagagacttagactcccacgcattaataatgggagaatttaacaccccactgtcaacattagacagatcaacgagacagaaagtcaacaaggatacccaggaattaaactcagctctgcaccaagcggacctaatagacatctacagaactctccaccacaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaacgagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgatatcaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaattaataaatgtaatccagcatataaacagagccaaagacaaaaaccacatgattatctcaatagatgcaggaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcacaagacagggttgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatataccaacaacagacaaacagagagccaaaccatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattctatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacttgagaaaaacaagcaatggggaaggattccctatttaataaatggtgctgggaaaactggctagccatatgtagaaagctgaaactggatcccttccttacaccttatacaaaaattaattcaaggtggattaaagacttaaacgttagacctaaaaccataaaaaccctagaagaaaacctaggcattaccattcaggacataggcatgtgcaaggacttcatgtctaagacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaattcaaacaaatttacaagaaaaagcaaacaaccccatcaaaaagtgggcaaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcagcattattcacaatagcaaagacttggaaccaacccaaatgtccaacattgatagactggattaagcaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaacatcacactctggggactgttgtggggtggggggaggggggagggatagcattgggagatatacctaatgctagatgacgagttagtgggtgtagcacaccagcatggcacatgtatacgtatgtaactaacctgcacaatgtgcacatgtaccctaaaacttaaagtataataattaaaaaaataaagaaagaaagaaagaaataaaataaaataaaataaaataaaataaaataaagctcctaaaggtatgttaagtggttaagtttctggatcctcttcttgcagactgctcaggtaaaatgctgattcaggactttcacttgtcaatcaatttctccagcgggagccaaaatacttttttgaaaaatgttgtcctgtctaaattgacccagatgctgtgatttaatctgcaactggaagatacagttcgggcagtctctttttccctttggtttccataagctttctctccttttctatttttcaatataaaataaaggacaagactttacagtgattaagaagcacacatagtaattccacaaatgttgctaggcaacaagggccacgtattagctcaatgaatggattctgggcatctgcacgaaggagaaatatgaggagcttgtgagtgaactgtcttgataaccacaagggttagtgctttttgacacacatgctgttggatatgcctgagaaagggaaaaggcacacttattttaaacctttctgatggtttatttttccaaaatgtgtttagaattctctttgatggaaatttgacacagtgtgttataatgatcattatctcaagcgggaaagtaggtaaaaatggcctgtttctatttctctagttcagggctgcacctatagcctgagttattttaacatcttccctcctgatcctaataggcatgctttttccccctcccataccagtccattcactcagctgataaattacaagggcatgttctatctgctagtgagcaactcctctcccttgtgatcagtatttaccctcttcagttgctgtgataatataatattattgactctaagaagtctgctttattttgttcctattacaaagcaatacatgatcattaacaaaaaagcagaaaaatatagacacatgaatgaacattagtatctgtgttcatcttcaccagaaagaataatataatataaattaaggcaatgtaaataccttggtgcatatcattctagatttttttctgtacatacacagacagatttttttcttctatcacccatataaaaaagttataacttaccttataaactccacaatagccaacatagtttttaatgacttctgcactacaccaggatcatttaagtattttaatgaaacttggaagagtaattaacagggtaaatgatcagctattagataactctactaatcttattgcattttcctgttaatcacctaaacccaaccatagttagctttattaattacagaatcttatatcattatttcctttccattttgatatggtttggatatttgtcccctctaaatcttatgttgaactataatcctcattgtcggaggtaggacctggtaggaggtggctggatcatgaggatagatttctcataaatggtttaatgccatgtttgtgctgttctcacaatagtgagtgatttctcacgagatctggttgtttacaagtgtgtggtccttcccacttccctctctcttgctcctgctttggtgcctgcttctgcttcaccttctgccatgagtaaaggcaccctggggtgccaggcagatgctagtgccttgcttgtacagactacccaaccatgagccaactaaacctcttttgtttataaattacccaatctcaggtatttacagcaatgcaagcacagcctaacacacacttcttataatattaccctagtcaagtctctctcttttgtttttttttgttttttttgagatggagtcttgccctgtcacacaggctagaatgcagtggcgcgatcctggctcactgcaacccccacctcccaggttcaagtgattctcctgcctcaacctcctgagtagctgggattacaggtgcacgccaccacacccagctaatttttgtatttttagtaaagagagggtttcaccatgttggccaggctggtctcaaactcctgactttgtgatctgcctgtctcggcctctcaaagtgctgggattacaggcatgagccacggcgcccagcctaacctagtcaagtctcttacctggttcttacagtaatgaattaatcaggactctggtttcaaatttcagaaacttcaactcaaagggactcaagcaaaaggcaaagtatggctgcgatgctaaaagttgcagtaggagaggctagctgaatgcatagtggaagtcacagactcaagtaagtcagcaaggcttagcttcactcccactgtctctcagcaattccctcttcggcaacagcttcattcctgggccagctctctccaaaacgtgaggagatggccatcagcatctctaggcttctatgttctcaagaactctaggggaaaaacagtcctctgatttagtcccaggagtcactctgattgtacccttctgaaccaatcactgtagccaggggtcaggtgctctgagtggggccagacctggagaacatgcccactctgaagcctgatgacacagttcaccccacccaaaactcaagaacccaagagtcaaggagcagtcattccccaaaagcaaaatcagggttctatccgcaaggatactgtgcagtcaaaagcagcaaccaacttttcctgtgtgttccatctactctttctgatccattctacactcttctccaaccaggctcagcttatggaccgtatcaaccagcttctttccctctggcttcaattgggcttactcaacaggatgcattagcaggagagtgaaatcaccatatttcttcatctcctgccttggtgggttacaggttggcagcagctgtgttcctgatctctttgtgggatctgataataactctctcccctcggcccttcaggcacaaggatgataacagctcactgctgtgctaagctccaaggtattccaccatcctttgttgattttaaccttgcacacacctttaactcatttgtgcctgctttccctttcctatgggacctcctatcaggctgctcaacctatcactgttccttcatgtcaaccacaaatttggttagccgttaaagtcttcattcaagaaatggatgtgaatatttaaagttcaaagctaagggccactgtcaatttaatccaaattgcctgttattatgacctaggctttggtgaccacagaagtatactgaggattgtgacacatacagccgattccaatcactttcattttgggttgatttagtagggtatatctggaatatattctgtgaaggttatattttagtggagatgatcttgattctctaggaggattgaaaagaaagtgaatgaagaaaggaaagaagaaagtaagaaaagaattgagggaggaaagaaggaagagagagaaaaaagaaaaaggacctaggaataaggagttttgatcttggagtaaagaaaccttagaattcagtccagctttgtttttgaccattgtaggtggccttgggacatctttccttttcaccggacctctctctcctggcttgtaaacactaggattgggccagaccatttttaaggtcccttccagttttaataatctatgaagttctaatgaactacaattaatgatgcttgcaagaaaaaaatgcccttacaaacactgcctgttcaaagaaaattaagatactttattaaattagataaatatatttttttctgaccaagaaagcaaaatctttttgaaaactaggcaatcatttaagttaattatggaatgaaaacccaaggtagtgcctgccctcaattcaaaacaaacttgtttttgttcagattcttgctacagaccaaattttatgtacagacaacgtggggctatcaatagggatctgcagtgaagcccaaggaaaacactaatgaagccagcaggagcccacacagcctagccatcgacacaatgcaaaattgaaaacacgactgaaaatccacagaggaggatgtccccacacttctttgtgtgtgatttgcctggtccagccaagattgtagaagctgtaggaggaagataaaaaaatttttaaaaaagaaagggccaaagcaggaaatgagctgtaacttgacagagtcacaaaagaaaacagaaaagcatgaaacatatcaggtccaaagaaggaatttggaaaatatagcctgtttattttgaaatgaggcaattgataatataaaaaaggataccaaaataaattaaaagctctgaggtattttatgctaaaaatactcattataaatagccagggtacaagaacagacaatagacaagccgagtttgagaaactaaatgtgttgatattttaggggaaaagaggtaatgtaagcaaaagagagactccatccttgagggctggatgttcacctggggcaaggtcagacaagggcagagcacctgcaccagacccagtgagagcttcacagcctcgacaaagaaggtaggagaaaagggaagaaaagtcagaggttgaaccatctgtgctgacaaaatggttttaagttgcttgccaagaaactgatcagtctgtaatggcagccttaaacattgtgttgaaaaggaaggtgaagtcatagcagaaccaggcacaggaataaagaatgatagattggcagtgtttccagtggggatggcagtaggaagggaaggtggtgacccacttgagtaatttgctgaccttggaatgtatgttctagaactatactgtccgatatggtagccactagccacgtttagttatttaacacctgtaatgtggctggacagaattcagctgggctgtaagtggaaaatgcacaatggattttgaaaactaagtacaaaaatatatactactttaataatttgcatattgattataggcagaaataatactttagatatgttaagttaaattgaataaattattaaaattggcttcacccatctctttttgcttatttttaacatagttgttacaaaatttaaaatcacatatgtggctagcatctgtggtctgcattatatttctattggacaacctgctctgtaaagtcccttttctgtctctccaggcttctgtgatatgatgatattcaggaagccttgacttagccctcactatcttctccatctcaagcagagccttgtctcagactaaccaaaaggaaaccacattgagactcaacagatgctgtaaccacacaactcacacccacgtgagaatatacacttacttagaagaacagtcactgccacctcctcacgtgtacaccccattcatcacatatgtacacaagcatatttgtatgtgtcagaaaaatatccataaataggaaaggaatattagcagaatcattgtcacagtgaaaattacatttcaactgtaattatttgtttgagttagggagactcattagtgcttgttaataagaaaaggttctttgaaattcaagaatatttaacttcatgtcttccaattcctaacaagaaatcaatttactgagaggggattccagaatcatgcttctatgtataaccaagacatcagggctgcccacgcatgacagagagtcaaaagtaagctttggccttgacataaaaacctccagtgtgatcgccaaccagcacaattggattctactctcttagctgtcttctctggacttctgctcttttccaaccctatgagccacctggtcttccagtcctgtcttccactagaatctaccacctagcacacctagcagtacctgccagttgcatcaaactcctggtccagactctgctagtcagtccatggtagcatagagagaccaattctaacgactgttttgaggctgtggtccagcaagtttgtgttcttgaacttttcaattaggtgagctagtaaattctcactgttgctgaagccactttgaatttagtttatcttgcttaaaactgtaaaaatcctaacagcactcttcaaatatttgaagagcgattccatggataatctattttttctgtacttcaaggggtggcttctagtgaagtctctcctgatgatgtactttcaccctgaaatttccttttcatttatccttttcaaaaaatggtctacaggtcatgattatcatttttagaacttgccttggtgatctggtccatccataataaagggaattcaaaggtcatttcaatacttcattctgagttactgacaatactcaacatcaagtcattcttgctgcttatttggatcccagctctgggctcttggcttctgtgtggatcctgagacccagatgccaatttgcattccagctttgaccggtatccaaatgcatcctgatgtttctgactgcctcttgtaataattgctccaaaccccagtggcttcaggatcaggagtctgtctacctgatcattcctcccaatctaagaactgcaaatgggtccctagtacattttgagaaacttctgtaagtaaactaagcatcttctctgtggtttaaaattgtcaacttccagattactcattgctatggtctaaatattaccatttactggatttgcctgatgctaactgtgtgttataaaactgctttgtggactaatctttcctcatgtacctgttatgtttctctgtaaccagccctatcctgatgggtaactttgtcttcaaatcccagccacatctcaccaaactttacttaacctttccacatgtcccaacctacaagaaacactgtataaaaccaccatgcctctctaccaatagtttatcatattgtgatgtcattcttgtcaggctgatatccttctgatactcctgtgtttacttactgacacatggatagtaagaaaacattgaacttaagcaaaacttacagattcaaaacttggttctgttatttactagcggtgtgtctttaagtgcaaaagaaaatatcttttatacctctcaaattttcattttccttatctataagttgggttaatgatacttgcccttattttgctagatattgtgagacttagataacaatgtatgtgaaagcacgttgtaaattttttgaaggactatataaataaatcattaatataaggttttattactagccagaattgttatctcacactcctttttaaccacaaacagccatacatattattaatagttggtgaatatttgtcatttcataaatatgtacgcaagtacccctaaaaacctatttgtaaagcaaaatggaaatgtatgtccaatgaactaagtgagggagggactagggggataaagctgttgaggaaaaagaaggggtagaaaatatgagttgtaaatgtgaatgagaaaaagagtgttgggcagagtgcaaatgcaagagagaaagagaaacagggaagacaaggcaagtagaatgcaatacaggagaggaagaggaggaaaagacagcagggaatgagaaaagacaacagaacagaaaaggcaccagacattcctaaaccacaattacctgcttggaaaatgttcagagactgcaatggaagcaagctccttgcccccaggtccttcaggaaaaatgggcctttgaacttatcttaaggaaatcttaggcagcccagtgaggaaaaccggtagccaaggcctctccacagagacagacaatgcctgctctgtgggaagagacaagagatggggacaaaaattggacaaatgaaatactcggatgtttaacaacagcacagaaaatgaggggagtaaaggggcagaggatgagcttaacatcctgtaaaacaaaacctgttgtcagacctattaaaatattgcataatttgacacgatctcactgttgttgcttttcttcactgatatatgtaataatctgggtttagttgactgctaagtcaaatttaaccaattatctggacatacttaaaaacaggacaggaattttcaagcccaagcagagttgctgctttctaggatcctgaagtgggaatggaattctgatacacaggagggacttcaaccctcttttggagtgttcccgtgctaacgttctaggtcctcagctgatgtcagtcacctctgaggatggcaaaaataaataaataaataaataaagaggtaacagcaactgcagatttctgattagagatgagaaagaattcctagagaatgagtcagtcaaagagaaacagaaaggttattaaaagggcgttccccctcccggattttcttggagggttcctgaatcacagagcacatggcctcacctatctgggatgatatagacgttccttcttagagtgggctatttgtattgctgactcagtgacctaaggtacggtcagctttagcacagcacctggaacaaagaaagtcttaggggtttatggttatcgtagtagagacagtagaaataaaatgaatagtaacagctgcagtagtagtagcagcacttgtagaagaggagtaatgctgatcttaggaattggtgtaataataccagtatctgtaaattctacaaatagctgtaatgtggtagtcagggatctgagcactgcaataagacctcctaggtttggctggttggttccatcccttactattagttgtataaatttgggcaagctaattaacttttctgcacctcaatatgaaatgcagataataagagcaccccttcatagagtggtcatatggagcgcatgagaaaatacttgtgaagagttgagctcagcacttacactcattgagcattcagtgcctgttagctagtagtagcagggatggtggtgagggtggcagcctgagcaagggaatagatcccacctaagggatacaaaataaaaggcatgttgtccctgtcattagcaatcacatgccaggaaatctgcaaacagcaccacaggagaagccttttcaacctcaaatagagaacttgtgttcttttcactctcccgtctcttctccaaatcccgtagcctcagattccaggctgcaagtgaaattcagtgtgttgtgggtgaagtttcaggggcatagagtggagatgggtaatggttattaatatccactgggcacaaaactttctatgatgggccttcaatgatgtggagatattgcctaaagagttaaaaaataaaataaaggctttatcaatgttttttaaattcttccaacattataagatgtcagactaaataccaggcatacgaagtccagcagaggaggcaggcatgttaaaccactaattacaaacaacaatgacaattataaataattgataacagcaatttgtatagagaggtctgggagcatagaggggaggtcaggaggcttgggggtcaggagatgataaatgacttcatactttgaggtgcaagtaggaaattggtgaaagaaagaggggacatgaaggctgggattaggctatagaaagatggccagtcgtctggctgaaaaatgaattggagttagggagtcaaaaaggtgtttggagatgatgccaatcatgcagaaaagaggtgaagccttaagacagcaatgacaggaagggtagagagagggtggcagagtcaaggttacataattctaaataaaacactgctaaaattaagctggtataaaaagggtactagttattattttcagagtaaaacctcatcagttcaacataattggatagaagcatgtcaaaattaatcaaatatgatttgtagctttaaaaaatacatgactaatagcttaggaatttttgactagatgagatattttaaatacttttcaacttccccactcttaattagaagcatcaatgttcctgcaaacaaaatgaggttcttagaagtaaagttctttttgtttgtttgtttggggtttttttgtttgtttttttagacagagtcttgccttgtcgccaggctggagtgcagcggcatgatctctgctcactgcaacctctgcctcccgggttcaagcgattcgcctgccccagcctcctgagtagctgggaccacaggtgcacgccataacacccagctaatttttgtatttttagtagagatggggtttcaccatgttggccaggatggtcttgatctcttgacctcgtgatccacccaccttggcctcccaaagtgctgggattacaggtgtgagccaccgcgcctggctgcaaagcctttttttttttttgaagtggatcgaacccttttgttttttcattttgttcacacagatgcacttcatgaattccaaggctggtctctactcatagcctattcccctcttactagtgtagaaagtcacaaccctcaggcttgactgtccagagaactggtctgagtctctcagtcatagaagactggttggctgatatgccccaccctcagttaggggtgtcatctgggtgattctaggccatcagtaatgcaaccaaagaaaataacatttgaagttacaaatagaaatcagacacaatttttctgattctcaggactctgtggcgtgactcaatttgttttgcaaaacttctgtcagtggtgcgatgataaaattcagttcaattcaaggacaagccatcagaacattccctttcagggaggggattttatcttatcctctactaaagtactaaattagttgaaactcttaattatcatagcttgtctaaaagtcacactaactcaatgcactatttattttccaaatacctgcacatttcttacatcataaccctaatgagtcataaagaatgtatttactatgaaaaatattagactcgattctcacatgttgactagaaatgaaaatacaaagaaaataagtcagtatgtcccactttaccaatgaatacacaacaggtgatttgctctcataagcttcctgagttcagatcagaaaggtgacagttttaacctttggatacttcctaattatgcaaaatgcttgtagtccttgcaaatgagagaataaaatgatccctttggtcagaagaaggcagagcttccacaaaaaggtagttttctggatgttaatatttggagagaggtttaccttttggtggtctagaaattgggagtcaatttattttatatttaattgaccatagagcagatatgattagaatcctccccaaaatatttcccaactgagattcacactaagttagccagctttctatagacatttttttacctgaatgttccacagttatctccatctcaatcaacatcaaactaagtcctcattccctatgcaccacacttcttctccaaggtcactttaaaaacatcttcctcttcctcctcatgcaattcatcatgatctaccggaaatgctacttcataaatttctctaggatctgtgttttttcctttactctcactctgttcttcctcctggtccttatcctgcctcccctggactactgtcaccgtttcctcaggcccctcctcttgtcaaccctgtaaccctatttgcattcagtgtcagtcatgcttcctacatgcctaacagaacttttctgtcttccgtgcagactgatagatcgtatttctgaacttccatatttagttgtctacagtgcctctgtattttctattaccaacattttttgaatgctaagaagtttgtcgatttttttaacatttaaaaaatgactctaatgtatccatttccacatacgctttttctggcattcatcttttgaggatttgaactgcagtaattacatacaatgaacagtggtggcatttgagataaggtgaggctagaaacgtcagttacactgttgatagagaaagttgagaataaatacgcatctatatttgatatgcacaaaggtatgattagtattgaacattcaaagatgagtatgttgtataaaaccttttgaaattaaatgaagtcattacaagctaaggagtaagtgagtgggcagagaagggggaaaaaagattcttcttacattctttaaaaatgcaaataagaacattgcctgaacattattacctgactgataaaatggtaatcacttagcagatatttatttagaaatctgttccaattgaaaaaatgtctgaaatttaacacaaccctatttgctaaatggtaataaaacagaattcctgggagaaaatagcaggtactaaaagtcataatatggttctacaaagttgaggataatttttaccactgttttcaaaatgtaagtgataaggtggaaagccctccagggccaggcaggcagattgcacactgaacaactgtacgctgtggctatgaaaggtaatgtgatagttcaagatggcttcctttcagacaacagggactcacagttacgactctggtaaattccagagtgcccagcttccctaaaaggattttaatccatttttaaaaccctggacaggccaaatgaacatatctgctaggccttcagtttgagaacccaagtctaaaatatcaaatgatagaccttttgccacatagaaatctttagaaaagcaaaccattgaagttcaaaggataggctctgatatcacaaaaatttgggtgaaaatactagcttcacctctttctagaaatgtgcctttgggcaaaataatgattcttctctgcctcggttacttcatatgtaatgctggggccactatcagtgagatcagataggtcacatgtttggagaaatgtctgaaccatagcaagtccttcttatcaaatgttcaaggcatcaaacaacagtgatttgatattttccttttattgtcgaaatccattttcatagatattgtcatggttgagtgacattttaatctaaattatatataccttaggagatagtttgtctttggagagttgggagataatttgaaaaaatcagtgattccggaagcaaagacttggattttagtctcaggttaatcacttattagctgtgtaggctgaggaaaaatcacttaatcctctgaaactctttttatttcttttgtaaataaagatatttatttctttatttacaaaaattgtgctttgtaggactgcaagaagctacaagtcataggcaaggctccaaattatagaaaggagcttctaagaaattgtaaataattcacagcttcaatcacgtttcttgaatctcatcacagcctgtgcttgcaaagtgagacaaaaagacacagtcttacaggaatccaagtgacccttccatctagaccatgctgtaatcctattaggtacagaggtaattctgactgggcttgagctgagagtcataaagatcttgcaattttttttttaattaggcaatatctctacccttgccaagctatttgcatccgctgatttgcacaagtcctaataaactatgtaaaaaatctcattaaaatgtgacatttaaataaagattggtaataaaagaagcaaactgcagggaggaataacaaggtgtcataagaaaagaagccagatacaccagggttgactgagcaacagacccagaacgatgcaggtcaataataattctgagaacatgtaactgttgatactaaaattcatcataacactaccctctgtgtgttccagggaacaagattaggtctgagaatttgaaatgctacaatgcttgcttctgaaatacttctatctcaagcaattttagtatggggcccactttgatcaagcatgacatggaaggcatactcttctcacttcacaggtgaaatgatgtggattttcattatcaaggagcttctgctttactaaagtccagggggaagctttgaggcctacagactgctcatttagcaggctgtaattcaaagtatgcctcagtggaactgatagagctggaggctgcagaggttcagcttggcaagcaaaacaaagtcaggacacttgggagcacccctttcagtaataaccaaattctctaaaacaggtggacaaggtaaactgcacaaaagactgagcttcctgcagtcaagcagattgagactcagatgcttatattaatgccgtcacatctgcaccctcaggtttctgaagccgggtgaagcagcctccacagcagtaagttccagaagaaaccaagcttatatagtggggaagctgtatctgttatttgccacagtttttatgcacttatatcaatcaatgagagccagaagcctgaaaactatatttttcagactttcttgcccactggcttcaggttatgttttccaaatgagagattcaacatggaaatttgggcgatgaggtgagaaagaggagtatatttcttctctatttggaggtgctttaagcagtaagagcaacagcaaatggttccagaaatgtggcaatggttgtgcctccagcagacccataacagcaaggaggatcatgaggcttcttgacctctttaacatctccttctccctgctctgccatggagctctgtgacctgcactaaatctccgtttgcttaaaatatatacaacagtttccattttcctgcctggacactgacaaatacaatagcagaaagaaataagtcaggggtattttcttgtaaacaggggtcaccaatcaagggaatgattgcatataaaggagagctggctgtatggaatccagcacaagaccaggagtcaaagagacacaagatcttaacccagatgctccaattcccaaacagaactgtgtccaagtccatggaagctgcagagaaaagagaaaatggtgctaaataggtatagaagaccagtggtttcattccaactaagccacttattagctccaatattgaaggttttctgtcatctttgggagcctttgtttcctcaccagagaatgggtacagtcagggataaatattcaaacaatttaataactgatcattaaggtcaaccaggtaagtagatggatactaaattgaaacaatcaagaaacttatagcttatagtaattaattatcagtttttgggtaataaatatctacctctcatgatactcgtgatgactaaagacacatttatcatttactctatgcatactatgtgcaaaatactatgttaagaattttacctatgtttttctgaagattacctgtaatcttaagaaaaatcccattttcagacaccaaaactgaaggctcagagagattacataaattcttcaaagtaatacagccagtaaatgggaaagtcaagacttgaacttatattattctgtttccataaaccctacttttccagcatcccatggtgttggtagttgaagttctgttaggaacgcttcagaagatgtataggatcacgtatatgtagaagattactagcttaattccataaccagaaaatttcacacattgcaagaggccattgctttcaaaatataaatgtatcttcttccttctagtagtttgtgatgcctctagcttgaggttccccataaccccaagtggcacaggggttttcaacacaagatgagtcccagctcatattcactgtattcctgatctaatcaaagtactaactgaatagtcaccattttgtcagtcaagcagtgaagttgagtattattctcatttacatttctaaagcaacataaaaataaccccttttaaatggtacccactcactttctccttatatgctaacgaatgtcacaatttccgagcctgaagagagatttcctgcaaaacacctaaatgccttaaagttgcacatgttcacaattctgactgccaggttacaaacatgaattgactccagttccaaatcaattccacatcgataagtctttagggcaaacaactaacacacattgattttttaaattctataaattatttcaaggctttagaatattcagcattaaaaattaccatttcatttcaggctttagtgaagcataatgtgtatttttaccagtattaatcaaccccaaaatcaacttttctgtttaaaaaatttctatctttttctgtttgctaagattggaaaatttcaattcattcttgtagttacattgatatccaatacatttaatttcttgatctaaagtaatgaattgtgacttggtgtcatgacagaattaaggcaactaggtaattaatttgaagccaactactcactttgttatggtttttaattaatgttgttgcatgtgtatagcaggagactgcttttatataaatattatgtattttatatttaaattattcaacttttggtatttactcagattttctgtgttgtgtataaaagcttgccagtttgatcttcagttaaaaaatatttagtggctccctagtaccgtcatcaagcctaccaaaggaatcaaaaagaaagattctttccctggaaaattcttctttcttggatttctttctcactttcctccttcttcctttacatccttaaagtggcttacaaaaatgatcaatacattatttaaaaagcaaaggaaacaagacgaagcgattaaaagggttggaaaatatagtaaaggcttgttagagccattgtacacacctagagatcttctacacttattagtggtgattataaatttgtctctcagtttcctagaaaccctagcaaagggcggaaaatgctaccatttatatgattcataatcctataagatgcttttctggttgctaatgagaaacattaataagaaagcacaacagtcatttcgtggagaagaagccgatccttaaatgaggttgttcttattaaagaaggaagaagccccagggactgcagggtcagtgaagcaagaggatagagagctcatggggcagggaggtgagtcaagggtaggcagaagctaccgttaaaaagaaccaagacataaaataaactttttctctgctcaaagcctggaggcattgtcttgagaaacctccaagtgcaagtttatatacaaatggactttccttcacctgtttatctcctgtctgaacattgtactctctggaacttaaaaagaaattgattgaaaaaatttcttagaaagcagaaactttcaaattataataaacagccagaaaaaagagacagaaacctgaactgcatttagcgatcacacttgaactgaggaaaaccacgtgtcagccgggagaatctggtagttaaacaacatcaaaagcatagctgtttctgaagtcaggcattaagtgttttagggctgaattaagtagggtgaggcaccagcaaggctcattccccaaatacaagccaaagatgttctacagggtatctgctgcaaaatcatcaaagccagtgtttccatttttctttcttcaacccttcaaaaaaaaatgcagctgcctcctccggagccttgaggaggaaaaaacagaccaataaaacagatcaggtgggtgtcagattgtctggaaagagctgcctgttgactgctaagttggctgacactatttaccaagggacaggactcatcaggaacttgcctccccaaccagggcctgattcactgccagcttttcatcatgattcaatccatcctgcatcaactgctttctctgctatggagactcttaagaggaaaatgcttataatgcttctcatattgctaaaatcaagacctagtatgacttttcttaattttaccttatagttcacagagaacatagcgcattgtatgtatcttactattagaattcttttttttttattatactttaagttttagggtacatgtgcacaatgtgcaggttagttacatatgtatacatgtgccatgctggtgtgcgcacccattaactcatcatctagcattaggtatatctcctaatgctatccctcccccctcccccaaccccacaacagtccccagactgtgatgttccccttcctgtgtccatgtgttctcattgttcaattcccatctatgagtgagaacatgcggtgtttggttttcttttatcaccgtattaaatactttagttcagtgattgtcatctagctacacagtgagatccttaagcccaggaaattgtctccctctttctgacacaaagtgtaggtgcttaattattttatagtaaagaaataaaggcaatctactgacaatttcttcctgtggttggccatgattgcattttctaactttcctggaactcccaaagttcttttttatgtctaatcctggtcctccagcatttttcatagtaattctttgagcttgtacactgtaactactcccaaattacctttgattatgttagccagagttagtttctgatgtttttagtcaaggatgctgacagacacattgtagcaaggaccaagctgaattagaaaactcaattaaatgacgccaaacaaacaaaaatgaagtgagcagtatggccggacaaaacacttaactgtaagacattttatttaatagaaaatgtcaactaggaccactctgtctcttgacatctggggaaaattgactggagcccctcaattctagagcttgtggaagtctaaagccttctctgagatttctgaaatctctctagggcatttgcagtctcctgccatcctgttccttttgggtgtccattctcacataggcatcctctcttccaaaccccatttaccaacacaggaatgtcagacatctcagcaatgtatacatagacccacacacaaacattcacatgcacatatgtattgaaataaaatatcatataaaagaaggcaatgcagttttatgaccttgaacaagttattcaacctccttatgtctcagttgacacacatggtaaaatagggataataatgatatggagcttgtaggactgctttaaaaattaaatgggataatactagtttatagcccatgctgagctcacacattcaacaaaagaaacattcaacatgaattcatagccaagctagaaaattttcctgaaggactgagtcctcggagaagtcagcacacacattaaagaaaaaaaacaaaaagatatgcaactgtactctcaaagtcccttacaactaatgttttgccccttcccaaacagagcccagattctccttctctgaatcatgtctcctccaaactcctcccttttccattcattttcttctatcttcagagcaagtaaaaggattcttttcctgggctagaaacccaggcttttcaattctcaccttatgtaggcacttttccaagtggggacatcccttatcaaagaagaatttctggttcatgcttttaaaataataaaatttcttcttgctaattacacctagaaaaagggtgtctagactttagtcatttgcataatacccttgtgatttttttaacattcccttattaattaatataaaaatgcataatatttttaaaaataaacctacatttacattttaaataaattaatcatataaggaaatatttttcactattataagtggcaaaatattattactcatcctaaggaggtaacctcaaaataaacatttgattttaaaataaaaatattgttggcataccacctaaattcattatgtattcctaacaattcatgcatcacaatttggtaaatgtgagcctaaaaacatcttttattatggacattcaaaggctgtactgagaggacatgagggaaagtctgtggcatttgcctgttattaatattgtggatagagagggggagtgggtgaggagaaacatatgttgatgggatctggttagaaaactgacagagaagatggtccagagacaagattctggggcgtgatatcatcttgtatcctgcactattgttccacagcacccaggagaatggctaatgtccatttaatcaaattgtattctgctgttagaatctaatgctgctataaataaatgtttaaaagctagaaatgttacagctcataatatctgaattattcccccaaaagtacattttaaccaactgatccagtttgatacagtgtctgaaatttaaaacaatattataatgtgtcaccattgatattgctcactctggccttttaattaacaaaaataaaattgagattctctgcatttcactctgctttctctgggcaaataatttcacaaactttagaggaaaattaaagacctggcaccaggtctggcaccagcctaaataatctatgttaatgtcctaagactctgaaccaagtcagtacatctgggaaataacaaagtccacacacttttattgagagtgtaaaatgttttattgctaaaaatacagtctctttgtatatctatatgtattagaacacaaccttatttgaaatatatatattacaacaatgacaaactgatcaacatctctttattaaatacccaccatgtaccagggattttgccagggatcatgaaacacattctaccctcaagaaattccctggttggggtgacagtacatcttggcaactcaagtcatattacactagagtttctgtcaagatatttgacagctccttttgtgatagttttctactatgtcaaatgcagaggcacaaggcccctgatctatacctgaaatatacttttctagaggtctcaagtgaatgaaaaacagttcttgtgattacagcaagaatgtattttttaggatgtattccagctactgatatctatggataattctcagcctcaaatgccaattcataacattgaggccttattgaatacacttttctttgtactatttgattgtgccaaataaagcaatcttttcgaaaagaaaatcttccctaggagtcagactactatttcatctccaaggcttgcagaaaattacaggaaaacaaatcaaaacgaaacaaaaaccatttagctttatgtaactataccatgcaaccattatgtcacataatataataacctagttgagaaaagaagtggacaaactagaacctgctataaaaagcaacgtgaatttgtctcaagtttagatatacagatagatattcttaagctatttttacccctacttaaatacatctttcttcctattacagagatgaatatctattttcaaacatcatctccataatgcagacttttagtataggaagctggaaatgtttacagtcatattacgtttttcatttaaacagaaatgacaaaacactaataatcaaacagtactgtgaacatgattatatatgaaacatcaaagaaaatccacatccattaactttataactctacaacaacagatttttagagtcttcatagcagaaatgttctcagtttacaacacaatatgtacagaaaggtaacatacctcacattagcatcaagtttgtccattacaggaaataagcatgagtgagttggatttcaatgcccacagggtc

SEQ ID NO: 1246 - DNA, 155510 bp, Homo sapiens
ctttttggcatttggatggtttggtcaatcttctcttccttattccaaagtttcttcctgtcggtttcagttccagaactaaagtaaacaacaatggaaacaataactgacaccttataagcaataagaaaaaaagagaatatgataaataatcctgagatgctattaaaccacagccaagatcaaagtcagaatctcacatggctctgggtttggcatttaccttcccgggacttctgctatggggcattcgcaagagccactgactcagctttgaataaaagacatccagattaatctgaaggacaaagctggaaaggtcaggggtctaaaaggcccaaatgaggagggtcgttcctttgaaacaaagccaaaaggcaggcaggccatggcttctcgaggtagcagacggctatagcagcatactgttgtcttagaaacagaaagaaaacttaaaggtcctctagtccaagcttgagtgcacagatgtggaaagtggggtccagagatgaaagaacactattcaagatctcacagcttgtttgcagcacagccagggcggcaatttgggtcctctggcttcaagtacagcattgcctcggcatccccagtgctgctggatcctgccctcctgcaccttgggggagctgcaggggaaaatgagtttccccagtgtgaacttccaacagttatctcctttggcagcaacaaagccagattgaagggtttcaaaatgatatcacaagttcatgggaaagatcctgaagcctaataaacacctacgatgttgctagccctgcccaaggctttttagaagacgtcccgttctagcccagcaggagagcgagcatctcagggcagacacgccagcggccaggacaccaggaggaagctatctgtcttcagcttccctccagagttgctgtggagaccattttcctctgacagatctctgaccctgtgtcttccatggaaaataaatggagcatgtcctgaagaggaggacagacattggacataaggaagagcaagtggacgtctgggactgacaagggggccaaccaagaggatgcacgtttggacccagacacagggagaaaagtgtgttagcgtctggcacagaacagggcgaagaagaggcaggggatagcttgaacatggctgtgacggacgtgaccaagcaagtaagcaagacaggagcgacgcctctggctaagacaggaacagagagggagtattttgttgatatctggaagcccacacagcaaagaaggcgtatttggagacatcagtgaccgagataggacgcagcaagctatcgtgcttagaacgtgagtgagacagatcagacacagtgagtgacgggaacatgtcagagacaccagagaccacgcggcaaaagcagagaatctgggaagagggagtgttgggaaataaaaagtgaacaaggaggccattatgtcccctgactccctccagcgccacctgctggaatctcagaggaaaagcccagcgagcaccgggttcctgcactggcggacggaaagcctcaggtgaagagaataccgggtgcagtcgcgcacaagcagcagcttaggacctggccctctttcggaggcatggctgtcttctgggtcattgtcccaggggcctaagtgtcactgggctgagcagccaccaaaggagaagttgctggcgggtgacactgactctcccactggccaccacactccactgcatccctagagagaggagaagattacagaacctcagaattggaaaggatgttgcagatcatctcctgaaagagcccacctgcatggcaggaacactctgtgccatgcagatgagtagctatttggcttctacttaggaatttccattgacaggccagtccatattaatttttggcaataataactattagaaatagcccattaatgttcagccaaaatcggtgtccatatggcttctacctgatggacctattacgcctatcaggccccctcaacattgtgccctctaccgattatatcctccaagttttctctactccaagctacacattccgattttctttaatagttcattatatattatagtttccagattattccccataatgggcactgtcctttgaacacctctcttgaattatggtactaggaaagtgcacaaattttcgcagggagcctgacttacatcatgtgcttttcatcatcaattgggtttatttctattaatgtagtcaaattcagttcatttctaaaaatggtaataagttattggcgtatattgagcttgctgccaactttgatcgtttttgatacaacaactgtcaattcctgaggttctttattacattgctgcctagttgattttattatttatttatttatttatttatttatttatttatttatttatttgagccaaaatataaaccatcacattttactcagttaaactttgttatatcggtttggtatcactttagtcagctgagatcattctaaatcatagcaattttaacattcaagatatgattatttagcacccactcaaactagaccttaagttttttgcaagcacataggaagatcaaataatctacaatggtagatatttcagtttagtgtcatctgccttttagtttttcaggcaaggtaaaaaatgttgagcaagataaaacagagaatcatagttaccccaagacaggcttccttgcagtcaaacatctaatgctcaatgtgcctgagaatggacccgctctggcaggctttgtccaataccttgctaaaatgtctctgtcaaacagaaaatctgtcctagcagataaagaaattatttggcatgaattattatacaacagtgaatcttacttacacaagctatgagtctatggtttctggagattagctttagtgtttcttgaaaaattggggcaatatttactatctccaggcttccacctattccccagtcctagaagaagttcattcggacttgttagcaacaagttttttttaagcccctgagatatgacacatcttggctcagagagagttaaatgctttccatcaatcctggacagcaactttctccctaaaatgttctcttctttccagttggaagtctattcttattatagcagaatatgcaagatttcttccctaaataatgaaatctaactatttctgggttagatctgaacatagctctgaacatagcttttgttcatccttgattcatccttggttatatgttccttcctccagattttccacatgccattttaaagtgtaaactctctagataactcaagatgtgccctcaggcctttacatactcccttacatttttatctgtctgattcattgaatatatctatttagagaaaaaacaatgaatgaaaaagaaggaatgaaggttaaaaaggaaggaaggagagaaggaagaaagggaaggaggaaggaaggaagaaggaaaggaaggaaagaaggaagggaaagagggagagagggaagaaagaaaataagaatttctcatctctcattggccaaatcccctttgtatcatatttgttattattgtcattattagcaacgataaaaacaaccacctattagtgcagcactggtgtgccaggcattgggctgaatgcagtatgtgccttaattcatgtattacacccatttaacaggcaaggaaactgagcttcagggagcataagtaatttgcccaagtatacacagttaataaatgacagggtcagaccttacatttaagtcatttttgacaccagcacctgtgctagtaactgttctactgtattgtcattcatcattttgacaactaccactatggatacagtatttaggtctcgctgtctctagcatttctttgtcccactatggcagactcctgggtgaaatgaatatgtagaggggtgcatgttataaatgttccacctgtgagaaacctgcagtgtgatgtggcatttccatttattgcaacacaatatgactgtgacactaacatgagactctttcctgctaactccatctgaccattaaagaagagtcattgccaagtggaaccccatgttttctgtgacgtagaactagggagactaggtgtaaagggggaaaaaatcctgtgaaggtaggaggaaagtccggaagacaaagagaggggccacatgaataaacataataaagaatgaggggtgaggataaaagacaaggcgaaaagatcagagctaaagaaagccatgtggttgggcatgtggaaggctccagagcaattggagagaggaagaggttctttgagaaatgtttccgaagggctacattggctctctctttctctccctctctatctatctttgacattggcaaactcagcttcaatatattggctctcttgtacaattcttttagagatttaaataaagattgaaaatactctagtattgctatttgatgtctaatgccaggttacatcaatatagctctggccatggagaaaggacaatggcccagcatctaactccatgaaggactcacaacgtctctctctcagcaggacgaatgggaatgtgagaataatgacagagtgatcttatggtcagttggctcatagccgcagttctcattgttatatttacataattgttcacagttagcagtttagtgtcatctgccttttaggccttcatgcatgataaaaaaaaatgtggtacattatactgcaccataagagacctccttcctgtgcaataagatcatcctcagtgcacatggctttaacactcaggaagcccctttcactcccagctagaaggtcaccttactaattcagagaagaaagcagcagagtgtagcaaccagaagacagggacctgggttctaatgcctttggagcctccagttgagtgactggatgactttgtccctttcctgtgcctcacttttcccatttgttaaatgaaggggaggataatctgtaagatcatttgcagctctgacattctgattctatgagtagcagggatggtgggtgacagagacaggccttctgattgggcaccagctgtgtgtgggactgttctccaaagctgtgggtaattgcttcaaatctggcttttaatattctattgttagtatctgatactttatattccatgtggagggaagaggtttcgctggaaacacagggagggtaattttggatttgtattaaagaatctgaaagacctcaatttcggaatctgtgaaattacattgcaaagctgttaaacgtatttgggtaggataggatagggtggggctgagatgccacaacttaaaatgcagcgagatcacaactgtctctcctcaaacatatgtttgatcaaaaacattggcagagccactcaaaatccctgatgcaaaacatcatttaaaaagaatctttctccaatattttaacggatgagtttttaaaatgcagtttcttgttgtaatcattttggtaaaatccctgacaatttacaaagcattgtcatatctttttttcacatttaatcttcaatgcaaatctgtaaggcaagaaggtacagagtcttgtttccatgttagaggaagaggaaagtgtaatgtagaggcatggattgatcgatgggtaatggtggatctagtgctataacttgggtattctgccctccaaatcaagaattctgcccatttggaaacatggaaatcatttatgtggtgggaagttttataacaaagttattagcagttaatgaaacagacttacaattacttgttctgtggaagaaagaataggaggaggaagaaggagaagaggaggaagaagaaaaggaggaggaggaggaggaggagaatcacttgctaagtcatctttctcaaaggtccagaggctatgtgcatgagaactatattgggtacttttataaaatacagattcccaggatccataccagacctttgacagcgagggtaggagggcaggagtgagccagagagagcagcaatctgcattttaaaaaactgctctcagctgattcttacgcacacaggtgtatgagatttccctccagccattctattcataccagagagcgagcttagagatagagacagtagagagagcgagcttagagatagagacagtagagagagcgagcttagagatagagacagtagagagagcgagcttagagataggcagtagagagaaatcacaggcaggtcagaggggccagagatagaagtccctgctcccaaagggaaaggaatggaaacaataaaataaaacatacatttcagcaaagtggacaaggaagtatttattggttgtcatcacattgaagataaacagatgagaaaagacttggtgattatgaaaatgagaaagcaaaaaatgtaaagagatgcacagagcaatgtttttttaggtgcttttcatgtgatgagaaatagaattcttgggtattgttagctgataaaaaccgagttgtctataaaccgtgaggcacatagatttgtaataagttatcagcaagtttgcttattaaaagtccatttcttaaattgtctgtagatacactatcaaccagaattctactaaggctagaagatcaagtgtttcccaaacataggatgtgttctgtgagtgacatctcagagaatgggcacagcattaaataatctgaatgacagcaaggggattcaaattattcattcagtcattctgactcagtgtggtcctgctctggtttaacaagtctctaatacctaacaaacacagtgcaggcgtcaggctcaaagcctttggcaaaaaaacaggataaagctaaattttaataactttgttttactttcattgcatttgtattaaaaatcatcttctctatatagttttgcatttaaggtcacaatacagagtttcctttacaaatatgtttatttagatttaaaacgtatttaaagaaaaatagtaaataaataatagcatggcatgggtagagtggtgatatgataaaaaaaaatcatgaaagtagcatgcaagttacaaaagcccctatcagacagatgagaaaactaaattgcagaaagcatagtgtcttggcaaggacataaagcaatgcatctgcagggcatgacatctaggatctttctttctactgtcttttgaagcttgcagaaagctgagctttcatagtttgggatgttaacattgtggcctctggacaaaatgtattcccaagggccctttaatctcatcaccagtctcagatatgtccatgtttcaatacaccaaagtgcgagatcaaatcaggtgtggctgattctaatccctatgtacttctttccctatttcccaatatgtgcatagaactaagaggtcaaatcaatatcctttcatgacttttttccattgtttaccacagttcctaaatggcaaataaaaggattgaaactctgaatctttgggagtcagactatctacctgctttttctatagtattccaatataaaaggacctaaaatatctaggagaaaataccttaaaagtacgttttaaacacagccaatatttactgaatgtttattatgtgtcaactactgtgctaagaaattcatggattatttcatataaacttcacaataatcctatcacatgggttttattatttgcaggctctggctgagtggaatgaatcctagtaactttccccaggtagagtatctagagagtggtggggtcaggatctgaactcagagcctgattgaaacaacatcactaaatttgcaccttcatggaacaggcattctcaacccctaaacagtgctcttgagaagctgcccataggagtgacagtgagtcaggtacataaagaatacttaagatactgagggataagctgagcttcctaaagaagggcaagtgggtggtaagatagcccagagactgaggagaaagtggggcaggaaagtttagagaactcctattggaactgtgcctagaagaatgagtagtcttgtgccaggctggaaagtgagacagcattcaaggcagcagagatgatccagagacaatataattcgctatttgtttgggaaaagctgaccaatcttgtatgtttattgcacgaagagttaggtcaggggagctgggctgcagcggggagagttgagggaaatgagctggaacaccagattggatcaggccaagaagggtttcatatacccttccctctctgcccactgcaagtcctactgtactgctcaaggttatcctattacaacccaatccagctggcatttgcagtttaaaatcccacatgtctgaatggcctttccatcttcctgagtgataaacacgaagcagcttctccctttatggctatattatatacatagtcccaaaagaaaaccagaggcagagaaaataatttataatttgcaactctgtcaaggaaagagcatcctaaaatcaccaaaatgtgtgaatagcctttcagttcaattctagaactcacccttttggaaagtcatgcaaatgtatatatacatatacatgtatatatataatatataatatacatatacatatatatgtatgtgtgtgtgtatatatatacatatatatatgtatatatatcctgatcagtaaatatatccaatattttttccaaatgcaatctcaggcatcaaattagctgtttaccactaagcatctatggagatatttctcctttggaaatgtctacattttctaccaaccccagattgccaaagattcagtaaaggaaagcagaatggccccctaaaattgacagtatcatttctgacatatgtcttctcattagtaatatttccagaaattctccagcttcaaccaaacaaaatgttacactggctgaaatagagtttgctgtcccctacacttaactgcactgtgggacgatgcttatgattttgtaactcacagaatcacaaaaaaaggggctgagaacgtgttattcaatctactcacctcttccccagaaatgttgactaatgaacattcagttcttccagttactgatattcggtcaatcaacacttttaattgactgatggtcatccaattgtctccttcaactttactaggaactccctagtaaggcaatccattccattttgtgctgaaatacatgttcttataacctcaatcctttgtttcttacctctctccctcacattatgcagaagaagtcgaattcctgtttcctctaacagccctttaaatatataaaaacaataattatgacctaaaacctctttgctctaagctcagcatccccagttccttctactgttatttatatgtcataaattctgtagagaaaatcatggcatttaccctcttctgaacatactccggcttgtcaattcccggtataagatgaagcttttatcatttccatggaccaggtacctgcacattgcaccatggactaaacacacatttacatgggaatatggttttccaatgggtatctcagtgtgctttggaggagatttcttcctgaacagctgctctgactaaattggaaggtctgtgtcctcgccaagtacatgctgtaagagaacaagctcctagagcctgcctagtggaaagggcttatctgcaaggttactgccggtactctaaccacagaagttcaggacccttcctcctagaaaccgtatcagtcgccttctacggcgctatatatttttttttttttggtcttgccttaagaatgtatgaggattaaaaggagccaaatggtgcaggggctgaacctcctggtactgttgaaagacctctcctgctgtccttggcagtggcaaggaagttctctgttgtaaagctcagaggactagtttgaagcagggtttcttaacctcggcactatctggaaatctggggccaggaaattctttgctctggggtgttccatgcattgtcggatgattagcagcgtccctggcctccacccactatataccaatagtattcccacgttgtgacaaccaaaaatgccaccagatattgccaaatgttctctggtaaacaagatcattcctgataaagaactactggtttaaacccacacaatctcagtgatctaagacatgcagctagatctaaacttaaagcattatctaattcaacttcctcattttattggtgttgggagaggtaatgacttcctgatgatcactaagggattagaagacaggcctcctgctctttccaggacaccagcggttgttaaccctgctgcgcactcaagctcctaaaataaatggatttctgcttcccaaccagacccaattaaaatggaatctctacaagcagagctcaggctcaggtattgcttaagaggccccaggtggctgtaatgtgcagccagggttgaaggccagggcaccacatcacactgcctctatctttgacctcaaataaaccacgttgggcatttctggagctgagtgttgtttgggggcttgccctgcagggtggcatgcataatccctttttactgcgagcgctgatctctgagggctggtacacagaacctcgacaccctgacagtgggtgcacctacggagcaaaagggggaaaacaaacacacacggaatgtgctcaacttgtttgacatggctagtatattttatgttgggtcaaagaaatgcctacaggtaatttaaaatccagaaggcatattcaaaataacagccccaactgttcagcacagggtatgatgtacccaggaaacaagtcttgtctcatgttgcttaaacaattgtttataaacagtgtgattaatttatttctggcttttcttctagtagaggagccctgcatcccttgtttcaggagaagtgtttagaacatggagatttctattgactcatttcttaagaaattcttatcaggaagctgagaaaataactggagacctggaggaagatgttttaccaagatatgaatgatgctatgcaaatacttatgataacaatgtagcagtttccattgattgagtgctttctgtgtaataggaactggcatatccctgaacggatgttatcaatttaaccttaacaaaagccccatgaaatgggttctaatattatgtccattttacagatgaagaaaaaagcttggagatgtttggtcaaacacttaaggtcatattgacactaaatggtagatctcagacaggactgaaacccaggtgggccagattccagcacctgcagccatggcactgtgctgggtgggatggccctttgattacataccagtggtcgccttccaccaagccagaagctggaacttttcctgaacagtaagtctcaatggaagggataatgtttcagcctcaacacattagcctagaagtgggcatcctggaaagaagcttaggccacccgattaacacatttctgaaaagcaggtacattttgcaaaaagcactaacttttctaatcctgagtatttgatgagaccattggtgttcttttaaagtttttattcttgctattttcctggtgtgatctcaacaagaacagtgttttctgaaagattacttcacgttgtgatggggaccaaggccggctttgtgggtatgtgaccagtgcatatacaggaatccagacctaggtttaatgctctgctgttgccatcttgaaattcttaataactttattcttgaatttgtgaatattagtagaatgtgtatgtatcaaaaagtgaaataaaagcagttgagttagttttctgcactactctggtaaaaacaaaatacttaagtgtgtatgaactacctaccatgatctgtataattttgataattccacatacaagttaaatgctcttttatttacattcgaagttggcattgcacaatgtaaaagtgaatgataaattgattcatgtatcaacgataaatgaatgataaatttattcatgtatcaatgatgaatgataaattggtgctaataattttaaaaatttcttaactaaaacaaaggtaattagcaagtaaaaaaacaccaagacaagttgggagggagtgaatgaaaaaaaaagaaaggctttaaattttaatacctttaagaacactttttcctgccattcgaacaagttgcttgtatttttattttgcatttggccagcaaattatgtagtctgccctggtaggggttaatggagacaaaggaaggtcatcctcattcatctttgatttacccagattaagtctgttttggctcaaaacaatgaggtaaacgttgaatacaattgtaacctctaaagttcaaggtaaaggccataagatggcttttaaatgtcaaacaactttccgacattagcagaaacctctgaggatccaaagtaagtcaactctaaatcatttcctcatccatgggtaaaaatcttccaattcacagtgtgaaaacctttatttaaaaggggaattctgatgtgctgaagtcaaaatttaacaagtggtttcactgtgaacaaacaactgtttcagctgtggaattaatacatattttttaaagtggtggaagcttattctggcatgcacagtccagatgaacagtgaagtataagaacatgtgtttatttaacaaatatattaattgagcaatttctgcaccatggggaaattttagggaataaaattgacatggtacctgccctcatagactggcagtctggctggacagacagataataaacaagttaacaacaacaaaaaatatatggtaagttatcatagttgttatttataaaggaaataacaaggggctgtaacccggattattttttcttctgctgtgttttgcctctcactcattctctttgcctcttactcattttcactttttttctatgtttacattttctccgctattgatttcatatagaaatctgaatacactaatgtcgtacatggaaatgttaaagatttgtatagcacatccaatagaattggttgattagtttttgagcgttgctgataacaagagttagtgagtctgagagaaagttgtattgcctccttccagagagaaggcacatatagctctggagatgcttggtcaaacaaactttttacaatcatgagaattttctacatttatatctaagccaagagccactcaccacatgtggctaatgaacacttggaatataactagtgtgattaaaaaactgagtttttagttgtgtttcattttggttaaattaaaatttaaatagtcatgtgtggctagtggttaccctattggacaacacagatctagagatctcaagtcaatggacagcctgtttatcacagggattaacagtggatgatggaggatgatagccaagaaccaagttagataggcaataagttctttggaaagtgcttgcaaaagttctcagacttctcaggaattgggtaagtgtcctaggtttgagtaagatctgaacctggaaactggggaagaatctaagcctggtgagagagcagggaaacccatctccaaagctaaagtttgcatacaatctctgctgtgttgcctaatttataaatagtctgttcttaaaattatcactctcatgtggacagagctttgcagttagcaaagcaaattcacatcaattattttgttattttgacaatgaaggagtgaaataggaggatggggattatctaccaaagaagtcaaaactggaatctttagcagattttgtacagggaaattctctgctctaaggttacagtcagcaccgctagtcccttttctgccctcagttatctgaactaataatcatggagacagttaaacagaagagagggtaagccagtagactagagacagagcattttttcatcctcttgtcaagtcctacaatgttccaggcactttactaggctctgaggatacaacaggctgcaagactggcaaggtccttggtatttgtccaatggacaaagaaccccattagcaagtccccaaagaacctcaaatcaaattaatatgacttgttcctaccacctgccaccttgttgtggtcacaagactatgtagtcataccatgtcttccaagtggggagagaggcttaaagcatgactgaactgaagcaggcttccaaaaggaattttctgataattatattttaccagttaagttagataaagttattatcttttaagagattctggcctgggtgcggtggctcaagcctgtaatcccagcaccttgggaggctgaggcgggtgaatcacgaggtcaggagttcgagaccaggctggccaacatggggaaaccctgtctctattaaaaatacaaaaaattagccgggtttggtggctggcgcctgtaaccagctacttgggaggctgaggcaagggaatcgcttgaactcaggaggcggaggttgcagtaagccgaaatcgcgccactgcactccagcctgggtgacagtgtgagactccgcctcaaaaaaaattttataagaacctaataattctaatatgtgtcataacttgaagccctgaatcacaatcaatgctagcacaccttggacaattctgatccacaaaagtctaggaccatggctctaaaccgttaatatgcataacagtcatgttagtaaaaatgtcatttacaagccctgcactgattcaatgagtgggacccaggaatctgtgtttttactaagctgccagatgattctaatgtgagtgatctgcagatcatgctttgatggaaaaacgatcaagaaaaataaaaataaaagttgcaaataagggaatatatttgcactccccaaatttccaacaataatatatacacagagagcgctaaaagaaattgggatatttattaagaaaaacaaaagcctcagaaagaacctatggccaaatatgcctaaagtgctgtcctaacgtaaaagatgtaacctgtttttctctttctcaaggcagaacgagggttagtgagtagaagccacagggatggaaacgtcaactcaatatcaggaaaacctttcaagctctagagctgcccaaactttgagcagactgctcagatgggaagcttctctcattgcaggagttcaagcagagatgggatgcccatcaccagtgatgacaaggaaactgttgatttgttagcaattccctcagctcctgataaaccttgtgtacacctgcagtgatgttcaccgtactgtaatatcttgctagtgtatcccttgcttcagtggttcatgtttatatctgctgcatgctgccttctgcattaaatgctcaatacatagttcccgtgaatcaaacttcagaacctaataaattgagttccagaatctgcaaacctggagttctgatgggcttcctataacctcaaaaggaaaatctgggttttacagccacctcttctactatccacaatgaacctttagcaatttatctgctcttcttcagtaaagttttaaagtttccttcaataaaggtcttatacttttcaaaaaaaaccattttttttaaggaactttagttattgcttctgtggatggtgttttatttttatttttatttttattttgagacagggtctggctctgtcacccaagctggagtggagtgcagtggcacagtagtatttttcttaattcacatactaattggttttttctcatgtgtaggaaagtcactgaggattgagtgttatctcatatcgtccatccttatgaaatatcttattacttttcacagtttacagtggattttcctggaagatgattataatagatcatacagatggttaataaataatggaagctttgctctctttttccagtttttttatatttcttctttctgttctttggattttgtatgtacaatgttgaccacaagagatgataagacatcattgtcttattcctcactttagtgggaatgcagctaatgttttatcattaggttatttcttttcttctctgccactatgtgcactatgggtttcctagagtgggaaaagtgatttctataaaaccaagacagatattggtgggtggggaaaacacagctgcagaacaagattaaggatgagacaaggacaaagaggctggctccaaattcactgagaatctgagtttgcacatttgatgaacctcttagaattccacacactggcattatgcctctttctaatacatgcatgcagacaaattaaaattgccctcaaaatatttatatgaaaataattcatgtttagaagctatatttagaagactatgtaacctatatgtctagacaaatggtgtcatcattcaaccaaatgctgtcttcacttctattttgatcacgggttgcatatttccaaagacacttcttgtccaacagaaaatagtcaaacacaattgcagacatctctgctactgtgtacactagttagtacaattttagcaatcaaaaccctctaagaatgtctttcaaaagcatattttatttcattggctacccatttgcttatttaataataaaatttcatgtaagtaaaagggccataaggataggaccaagcttgggagacctatgattctaaaccattgaggccaggcttggctgtttctaattcaacttggaaaagtaaaattccattttgtcaaaaagactttaaaggaaggaggccccacaatatcagagtgttgtcatgaactgggtcttctcaatgtgaatcttgtagactaagttctctataccttttaggatctcagggaagatttaacaaacaaaacctaattttcaattttgagtattttaatccttcataaatctgaagagaatcaggaacacctttcatcagcaaaaatgatcaatcaattgatcatctactgttatacagatactatgttagagactatacagttcctagagaagaggaagccatagtttctcccctcaaggaatacttgatataacaggaattaaataaggaattgtatactctaaagcagtatgaatgtcatgagaaatagtgctgtaaacaggccactgctatccagcagaaatagagaacaaatgcccaagttgaagaaatgtgaaaaaggtatgttctgaaaaccataggaagaagagtttgatcccaatcctgagatgaacttcttttaaattgattctttgtttgaataatcaacgggtacccaaagatagaagtcaacaggtggttaataagaataggtccatctgatctaaacttacttcctttaaaaaaaatgagtatgaaaatgccttcatttgaagaaggaatgttttccatggtttgtaggcaaactagagaaatatgaacaaaatggtagagttgatagattaaaaaatgactcatcaactttatccaaaaagtcaaggtgatcatggaaagttgtaatcttaactctgactctaagtggctggacaaggctgagttttgaagtcagaaacagttgggtctgaattccagctttgttgtttactacttgtgtgactttgggcatgttacttaccctaacactcaattttctcatctttaaaatgacaatgatcataataccttacttctttgagttataaaaattagatgcaaatgatggacttagggctctcaaatatagtaacaaacattcttttctggaataatgttaggtttcataatcataatcattattattaataaaatggaaggaggtctctagtgacctgtccagtactttttaaatgtttgccttgggtgaggaaaatgaaggtatgcctataaaattgtaaattttatacatgcagctagaaatttatcttacatttttatgatttatattttgcccccatggttgaattttacagttatttttatttagctccatctcttcaataccagctgattggtttctttttaaatccttaagcctgccctctaatatgttagttctccctcagagccacagaaaaagtgtcttgatttagtaacatgatacaagattattccatttatggagatagggatgactcagaaaacttgtggttggagggtgagatagtttggatgttcatccccttcaaatcccatgttgaagtgtaatctccagagttggaggttgggcctagtgtgaggtgtctgggttatgggggtggaggccacatgaatggcttggtgccctccttgcagtaacaagcgaattgtcactctactagttattgtgagatctggttgttaaaaagagtctagcatctccctcctctctttctctctcttgctccccttcttgccttgagacatgtatgaaccccccttcatcttctgccatgagtaaaagcttcctgaggcctcaccagaagctgagccaatgctgatgccatgctcgtacagcctgtagagccattagacaaataaacctcttttccttgtaaattacccagcctcaagtattcatttatagcaacacaaaatgggccaatacagggggtaagtgtatagagctaagaattctgttttggttgcatcacatttcatttaagatttccaagagacacctatatggggttgtcaaggaagcaaattggatcttctctctggatctcagaggagtgttatgccctggagatattgatcaaagagtgaggtgacagcatgaagactgtatttaaagttatagatggtgaatgtataaagtaagagcatagtctgagaagagtatcaagagccaagtcctgaagaactccaacagtttgaggccagagagaggggaagagcctctaaaagagactgggaaaaagttgctggtgagttagcaagaaaaccaggaaagtatggtgttaaggaaaattaaggtaggaagtattttaagaaggaagctaggccaactctaagaggtcaagtaaggataccttttcaaaatttgaaacttctgtaagtcaaaagttaaccaaagttaaaaagcaagcaggagatggggaggtgtatttgccaattctatgacaccagatgaatatacagaatataacaaagaacacccagaaattaataagaaaaatacaacaaagttgtcacaaaaagggccaaacacataaagatgcactttatataagaataaatataaatagtatataactaatttaaaagaggttcaatctgacaaaccgctaagtaatgcaaattaaatgatacagcaattacttttacactaacctaatattttttaattaagaaaatatgaaagattgataatattcaatgttggtgaggagaactcacactcacagatgagaatgcaaattgttacagtgtgttaggatgccaatattatagtaaacataaacattttaaatgagcatacctgtcaatacagcaatttcatttttggtagctatctgaaagaaatactagcacatgcaccaagaaatgtgttcaagggcattacaaacagtacagtttgcaatgacaaataattggaaatacttacatgcccactaacagcaaataattaaataaattttaatatgtatttttagtacagaagattatggaacagctgaaacaagtgagttagagctatattttccccagtgaaaagatcttcaaaatgtattgttaaaggataaaaaaacaagatgtagaaaagtacatataaaatgatcccatttacatagagtgagaaaaagttatatttctatggtttttatgaatgtctgtaaatacattgaaatgatcagcagactaatgttaactattgcctctgggaacaggggtaggattagcaggataaaagctgatactgattttcattgttttggttttatatttcttcaattcatctgaatttgctaatgatctacttgtgggatttttaagaaaaatgcaaaaattgtcttagttgtgttaagttaaaacaattgatcagaagaattaattttagaatttgttaattcatcaagagtttaagttcctattacatatcagacaatatgtagagtatttggtatacggcagtgaataaaataggcagaattcctgtcctttgtaagatttaacctctagcagatgcaggtttcaactattctgtataggctacccttactcttataagattctccactcccacagtaaaacatcacagaccaacttcctgcacttttcatgaactcatgaagaaacttatggaagactgtaatcccagcactttgggaggctgaggtgggtggatcacagggtcaggagatcgagaccatcctggctaacatggtgaaaccctgtctctactaaaaatacaaaaaaattagccaggcatggtggcaggtgcctgtagtcccagctactggggaggatgaggaaagagaatggcgtgaacctgggaggcagagcttgcagtgagcccagatcacaccattgcactccagcctgggcgacagagcgaaactctgtctcaaaaagaaaaaaaaaaaaaagactgaacaaaaagcagcagaaaactctgcagacttaaatgtccctgtctgacaactttgaagagagtagtggttctcctagcacagagtttgagatctgagaatggacagactgcctcctcaagtgggtccctgacccccaagtagcctaactgggaggcacctccaagtgggggcagactgatacctcacacagccagttacctctcagagatgaagcttccagaggaacgatcaggcagcaacatttgctgttcagcaatactcgctattctgcagcctctgctgctgatacccaggctaacaggttctggagtgttaactccagcaaactccaacagaccagcatctgaaggtcctgactgttagaaggaaaactgaaaaacagaaaggacatccacaccaaaaccccatctgtacgtcactatgatcaaagacaaaggtagataaaaccacaaagatggggaaaaaacagagcagaaaagccgaaagttctaaaaatcagagcacctctccccctacaaaggagtgcagctcctcaccagaaatggaacaaaactggatggagaatgactttgacaagttgagagaaggcctcagatgatcaaacttctctgagctaaaggagaagtttaaacccatcgcaaagaagctaaaaaccttgcagaaagattagaccaatggctaactagaataaccagtgtggagtagtccttaaatgacctaatggagctgaaaaccaaggcacgagaactacgtgacaaatgcacaagcctcagtagccgattcgatcaactggaagaaagggtatcagtgattgaagatcaaatgaatgaaatgaagtgagaagagaagtttagagacaaagagtaaaaacaaacaaacaaagcctccaaggaatatgggactatgggaaaagaccaaatctacgtctgattggtgtacctgaaagtgacggggagaatggaaccaagttggaaaacactctgcaggatattatccaggagaacttccccaacctagcaaggcaggccaacatttgaattcaggaaatacagagaatgccacaaagatactcctcgagaagagcaactccaagacacataattgtcagattcaccaaagttgaaatgaaggaaaaaatgttaagggcagccagagagaaaggtcaggttacccacaaagggaagcccatcagactaacaatggatctctccgcagaaactctacaagccagaagagggtgggggccaatattcaacattcttagagaaaagaattttcaacccagaatttcatatccagccaaactaagcttcataagtgaaggagaaataaaatactttacagacaagcaaatgctgagagattttgtcaccaccaggccagccctaaaagagctccttaaggaagcactaaacatggaaaggaacaatcagtaccagccactgcaaaaacatgccaaattgtaaagactatcaaggctaggaagaaactgcatcaactaacgagcaaaataaccagctaacatcataatgacaggatcaaattcacacataacaatattaaccttaaatgtaaatcggctaaatgcgccaattaaaagacacagactggcaaattggataaagagtcaagacccatcagtgtgcggtgttcaggagacccatctcacatgcagagacacacataggctcaaaataaagggatggaggaagatctaccaagcaactggaaaacaaaaaaaaggcagggcttgcaatcctagtctctgataaaacaaactttaaaccaacaaagatcaaaagagacaaagaaggccattaaataatggtaaagggatcaattcaacaaggagagctaactatcctaaatagatatgcacccaatacaggcggacccagattcaaaaagcaagtccttagagacctacaaagagacttagattcccacacaataataatgggagactttaacaccccactgtcaacattagacagatcaatgagacagaaagttaacaaggatatccaagaattaaactcagctctgcatcaagcagacctaatagacgtctacagaactctccaccccaaatcaacagaatatacattcgtctcagcaccacatcacacttattccaaaattgtccacatagttggaagtaaaacactcttcagcaaacgtaaaagaaagaaattataacaaactgtctctcagaccacagtgcaatcaaactagaactcaggattaagaaacccactcaaaactgctcaactgcatggaaacagaacaacctgctcctgaatgactactgggtacataacgaaatgaaggcagaaataaagatattctttgaaaccagtgagaacaaagacatgacataccagaatctctgggacacatttaaagcagtgtgtagagggaaatttatagcactaaatgcccacaagagaaagcaggaaagatctaaaattgacaccctaacatcacaattaaaagaactagagcagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgattaaggggatatcactaccgatcccacagaaatacaaactaccatcagagaatactataaacacctctacgcaaataaactagaaaacctacaagaaatggataaattcctggacacatacaccctcccaagactaaaccaggaagaagttgaatccctggatagaccaataacaggttctgaaattgaggcagtaattaatagcctaccaaccaaaaaaatccaggatcagatggattcacagtcgaattctaccagaggtacaaggaggagctggtaccattccaatatccctgatgaacactgatgcaaaaatcctcaataaaatactggcaaaccaaatccagcagcacatcaaaaagcttatccaccataatcaagtgggcttcatccctgggatgcaaggctggttcaacatatgcaaatcaataaacgtaatccagcatataaacagaaccaaagacaaaaaccacatgattatctcaatagatgcagaaaaggcctttgacaaaattcaacagcccttcatggtaaaaactctcaataagttaggtattgatgggacatatatcaaaataataagagctatttatgacaaacccacagccaatatcacactgaatgggcaaaaactggaagcattccctttgaaaactggcacaagacaggaatgccctctctcaccactcctattcaacatagtgttggaagttctggccagggcaatcaggcaggagaaagaaataaagggtattcaattaggaaaagaggaagtcaaattgtccctgtttgcagatgacatgactgtatatttagaaaaccccatcgtctcagcccaaaatctccttaagctgataggcaacttcagcaaagtctcaggatacaaaatcaatgtgcaaaaatcacaagcattcttatacaccaataacagacaaacagagggccaaatcatgagtgaactcccaatcacaattgcttcaaagagaataaaatacctaggaatccaactcacaagggatgtgaaggacctcttcaaggagaactacaaaccactgctcaacgaaataaaagaggacacaaacaaatggaaggacattccatgctcatggataggaagaatcaatatcgcgaaaatggccatactgcccaaggtaatttataaattcaatgccatccccatcaagctaccaatgactttctccagagaattggaaaaaactactttaaaattcatatggaaccaaaaaagagcccgcattgccaagtcaaccctaagccaaaagaacaaagctggaggcatcatgctacctgacttcaaactatactacaaggctacagtcagcaaaacagcatggtactgggactaaaacagagatatagactaatggaatacaacagagccctcagaaataataccacacatctacaaccatctgatctttgacaaacctgacaaaaacaagaaatgcggaaaggattccctatataataaatggtgctgggaaaactggctagccataggtagaaagctgaaactggatccctttcttacaccttataaaaaattaattcaagatggattaaagacttaaatgtcagacctaaaaccataaaaaccctagaagaaaacctgggcaataccattcgggacataggaatgggcaaggactacatgtctaaaacaccaaaaacaacggcaacagaagctaaaattgacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaactcaaacaaatttacaagaaaaaaacaaacaaccccatcaacaagtgggtgaaggatatgaacagacacttctcaaaagaagacatttatgcagcaaacaggcacatgaaaaaatgctcatcatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaactattgtggaagacagtgtggcgattcctcaaggatctagaactagaaataccatttgacccagccatcctgttactgggtatatacccaaaggactataaatcatgctgctataaagacacatgcacacgtatgtttattgcggcactattcacaatagcaaacacttggaaccaacccaaatgtccatcaatgatagacaggattaagaaaatgtggcacatatgcaccatggaatactatgcagccataaaaaaggatgagttcacgtcctttgtagggacatggatgaagctggaaaccatcattctcagcaaactatcgcaaggagaaaaaaccaaacgccgcatattctctctcataggtgggaattgaacaataagaacatttggacacaggaaggggaacatcacactctggggcctgtcgtggggtggggggaggggggagggataacattaggagatatacctaatgtaaatgacgagttaatgggtgcagcacaccaacatggcacatgtatacatatgtaagaaacctgcacgttgtggacatgtaccctagaacttaaagtataataaaaaaataaataaaataaaatggtaattgtactcataccatataagtttcttcaaaaaaaaaaaagaaatttatggaagaaaatatggagtgtacatccatatgccatctctaaattgtctctttgctttacaatgatcctgcagattaccagacgcagcaggattttaacaatacatcttatttagtaaaataggctttcttgggctgccctggaaactcccaaactctctatgaaaaaaaccatcaactgctaaacaactgacttagcaaatgtattaccagagcatacgctgtttgtaagttgtcaacagcctgtacttaggcaactgctagattaaatagctaaaaactatttggcacccacacagaagttcttgtacacacactttatggttgaattctttctatgacactcctgaaggcataataattaagagagaatgtcggtttctaggagtatcctttggggtctttccaccagctgaaaccacaacaccatgctaggctttagctacaaatctgcctacacttgtagcaaaaaatggaattcatgctctgagcagcctctgaggcacaggatttatattttatagcaattcttatttttcttttcttcttttcttacacatgcaaatgaaaatatcccccaattttcagccgccagaacagctgaatactaatcatcatcagaaaaattaaatgcttgtttcaaagaaggaactactccttagaaattcctgcgcatctcagggcaaagaaaaaaatgtcactggcaatcctgttttgctacaggatgaatgtatttatcacacatagctttgcatagctgagaacaattctagcccagggtgaccagaaaagtctcagggtttggaaagaggtaccataactagacactgaacatttaactccaaagtcacttccacctccatccacttatgtgaccttggggaaaaaaaatcgctggacctgtcggtattctcttatatttcatttccttccttgtactgttctatctgcctgaaatggcttccctgccttctcctccatgtctcaaattcttaggaaatactgttctgtgttctgtaaagccttccctgagcttcttaagccaaatcagcttcctttcctttctaccccaattctagattgcccatacatccattatatcacatggtattactgttgtatatttattatggtatttattttagtttatcatgttatttatggccatattaggttctcaggcactacgttattactattggtcctaatattaaataaaacttctagtaccattgtgagtgcttactgtatgtcatgccctatatgaatatattatctctactcatcagaaaacacacatgagatgagaattaacattctcatctgttttaaaggtgaggaaagtaaaaccaagagagagtatgcagatggctagtaggagcaccgagaatcaagacaaaacctattttactttaaaatccatgcttttaaccactactctaaagtaacacctttaaataataatagataacatttactaaatacttgttaagtgtcaggctctgtaccgtgcactccacatatactagctaatttgattctcataaaaactctgtgatgtagatatagtgattattatcttaagtttttaaaaaatgaaattgaggttaataatgtttaaacgacctgcccaaggtcacagaactatggggacttgattagaattcaagtcaatctccctccagagcctgagttcttaaccattgctgtattccatgaccagatagtagaatcttttataatctttgcaaactctatgcaggtttcagggataacccctttggaaacagaaaactggagcattaccccttctgagtaatacaaatcaaccaaatcaatgaactcccttagtatactcaccttagtacatgtgtggatccattaatggttgtggttgaacaagggacagtctggcccagaatggaaggtcttcggtagcgctcatcatcacagcagaggatgatgaggaaggcacgtctaaaagacttattcaagaaggcgtagagaaaagggttcaacccggaattgatatagccgagccagaggaaagcagtccacacctgcccagggacagtgtagtctatgaaaggatccacaatattggtgacaaagaatggtgcccagcagaggcagaagcaacccatgatgatgcacagggtcttggctgctttggtctctgtcctcatgcgatgagtgctatgctggtctgccgactgaggcctgctctcggaggaggctcctgcccgttgtaacatctggatctgatgggcatgctccttagctgtgacatagatgcggtaataggccagcaccatgaggagaaatgggatgtagaaggccaccacagagcaggtgatggcgtagggcttgttgaccatgaagacacagtacgtagagttagagttctggttgaacttcctcttttctatctgagagttggagggagagaggaaatgaggaaaggaggtaaaaaggaaagaaaaagtgaaaaagaagtgggaaaaatggggaagagtgtgagaaaagaaaaagggaaaaggaagaaagtggaggattggaagataaaaagaaggggaagagaacaaggaaagaaaatgggagaataaaagagtaaaggggaaaggaaagaaaagaaagtttatcagcaaagctttggttttcttataagcctacaatacaaagaaccttgatgacagaaaaggaacatgatcatatcccagggcccagagaacttatctgtacaagaggaactgaaggctccaggacagaagagaaataaaatagagacagaatcatttattacatttacccaaccagaagtgaaattctgcctctgttctcccttccctgtctgcttgcacataacagatcagtctcttaacagaatgtctgcagatcagtaacattagagtcacctgcagtacatattataagtgcagattcctgcccactccctgctgccacccctccactctcatccctgaaagatctactaattctaaatctctgggcaatgaagctcagatatatgcattttaagcaagttttttccaataactctaaagctcattaatatttgagaaccattgctctatactgtgctaaacttagctctttgggggatgccatggggcacttttctagagtcatttctctacgtattgagttccctgatgaaggtttgtctcatttagataacacagagtaacacagagtaacagcctgtgttatagtgtaacagcttgtgttttagtgtaacagccaagaggggccttagggcttgggggaaagaaagggtagatattttaatggaagaaaagaatataaagattgggtagggcaaggtcatgagggactttggaacccaaccagagttagaacctagacaacactcaatgcttcaacttactctcctcccagtctctcctgaacccactccatttaggtgttcaccctaatcactccattgaaaatgctctggtcaaggctatcaatgacctctgtgttgccattcctccttttaaatgagccatctacacctttgacatagctgaaccttccatccttcttcttttttcgaatattttattgaaccaaaatacgtataaagtacataaagtgtatatacagatgaatcaattattacatagtaaatatgcctgtgtaattattattcaaatcaaactatagaatattatcaacaacccagcagcctcccaaatgccttctcctagtcattaatatgcccaaacatagccactcatctacatcatcataatgtaattttatttgttttccaactaagtatcaatataataataaaacacacaatctgtatcttctttaatattgtatcactcacattattgcatgtacaggcagtttattctttttcattgtagtataatattgcattataggaataaactacaatattacatattccaatattgacagacatttgagtcatttttgggtttgtgctattttgcataaaactgttatgaatattcttgtggaagtttgtgtgtgtgtgtgtgtgtgtgtgtgtgtgtgtgtgtgtattttcatctctcttaggtatatacccaggactgaaattgctgtatcatagcttgggtatatacagccaaacagttcccaaagggactgtatcaatttatatttccaccacgagagcaggagagttccagttactccacatgctcgccaacatttggaatttattgtcagtatgtagtggtatctcattgtggatttgttgatgatgttggtaaagtttatttgattacataagtaaaatactccatgtgtttttgactctttccattggtttagattaggatttgtcttatgttttgttactgaaaagtgtcctgggcatccatatccacataattatagtacattgacatcactccttttggaaagcatgtgagactgagtttctgcatctgtttcctgattagcactctggttccttcaatgggacgagagcattgccttcagaatggtaaaatattgcctagatcttgtcagtcccaattcttgcagctgtatcttcagtttcaatctgagtaagtcacctcaaactctcagtgtgccctggtttctgcatctttgttccctgtttactatgtcctggctatttcattgtaattttgaattaaatccaataaacttgaatcaaatctaagtttattacaacccttcagtttcttattgcagttttactgtgcatctcctgagaactaataatgttaatcactgttttgccctttcgatatcctgtcttttgaattgattattcaggtattttcccattttaaaaattaagttgtaactctctttcttattgatttttaatataatagttcttttatattctagatgtcttttgtcagatttatgtgttgcacatatatcactctgtggcatggcttttcactctagtatcttgtgatagaaagaagctctgaaagaacctatacttttggttagtacttgtatcttgtttatgaaatctttgtttactcctaagtataaagatactggccgggcgcggtgacttacatctgtaatcccagcaccttgtgaggccgaggtaggcaaatcacttgaggccaggagtttaagaccagcctggccaacacggcaaaacactgtctctataaaaaaatacaaaaattagccaggcgtggtggcaggcacctgaattctagctcctagggtggctgaggcactagaatcgcttgaacccgggaggcagaggttgcagtgagctaagatcacgccactgcactccagcctgggtgacagagtgagactcagtctcaaagatattgtcaagagatgtaaagacattcttttacatgatcagttagcatatctttattgtgttaatttttatgtcttttttttttacagggtcatgctctgtcacccaggctggagtgcagttgtgctcactacaacctctgactcccaggctctagcaattctcccacctcagcctccctagtagctgggactacaggtgtgagccaccacccctagttaatttttaaatattttttgtaaagacagggtttcattgtgtggctcagactggtctcaaactctaggctcaagctatcagcccatctcagcttcccaaagtgctgggattacaggcctgagccactgtgcctgaccagtttttacatttaatgcttctacccaccagaaattagtttttctgtatggtatgatgtacaagatatggatattgaattgacccctgcagcatgtattgaaaggattatcttttcctagttgcactgcagtgtaaacttggtcataaatcaggggactgtatatgcatatggctccacgtttggatttcctatttgttctcttgagttgtctctctctgcatgtactgctttaacttctataacttcatacatcttagacatctagttataaaagtctttgaattgtggtttcttttcttgaagactcttggataatgttttatctcagtatttccatataaaatttaaattaatatctcaatttctataaaaatcttctaggattttgattggaatgagagtaaaatgattaagggaaactgacatctttacaatgttaagtctttgaattaattaacatggtaattccttccctttgtctttttaagtatatttcaataatactttttaattttataattttctttgtgtcttgcacatcttttgttagatttgtttctaagtattttatgcttttactctgttgtaaatggtaccatgttaaaatcctgattcctaattgttgctaatatgtagaacttggtgaggatttttattgtaagctggctatgtattcagcaactttgctaagttagatatcaactaaaattcatctttacattcttttgaattttctccaggaaatactcatatgatctgcaaataatggcagttacatttttttctctttccaatcctaatatcactttctcttgctttattgagcttgatagggcctcccatctaattttgaataaaaatgagagtagttgacaccttgtttcactcccagttttaggggatgagccttcaataatttactaagtatgatatttgctataaattgtatgtcaatgccctctacttggttaaggaaactacattctattcttggtttgatgagatttttaaaaaatcgtgaatgggtattgaattttgtcaaagcatttttggcagtaacaaaatgaacatgtgggttttctcccctttttttattgatgcaatgaattacattgattgcattacaattcctggaatgtcttatttgtactggaccctgtgacacactagtatttttcttaaggattgaaggacatttccaccaactataaacactgcctgctgacaggtcttagtcatcaaccttctctagaaatagctcttgactgaagagaactgcttaacccaatgtcacttacccttcttgggatcaatctgcatccagtgtgaatatacacatgcatgaagatatgaagaatagacacctatatgatatactcacaaacatgctattttattcctgtacatattcagtatcttgttttatagactattataaggttatcatgtatcatcctcttgaattgatatttttatcattatgaaatatttctacctcaagaaatattattttccttaaattttattctatcactaataatagtagagtaacaccaactttccttgacttatcacttgcatagtgtatgtatttctatttttttattttcaatttttctgccactttatatttaatggtcctctcttacaagcagcatatatttgtattttgttttgatgcagtctgacaactttgtcttttagcatctattctttaaataatttaatatttactaaaattgcaaattgatttacatttgtctataatcttactgttatctattaatcttttctgtttcttggttccttgtttccatatttattgcttattttcagaataatacctgtttgtattaacacattacctctctccctattagcttattggatatatattcttttattatctttattttaggggctacaactcattacagtctttttcatacatttgccatttccttggcaatgcaaagatcccaaacagcccatgccccacgcctgccttttatgctattgttttcatgcattttaatcctacatatatttgaaaacccacaagacattaatattattgttattttaatagtcaacgttctcttacactatccacatatttatcatttccagtgctctgcactctgtcctgcattatggtgtttcaatctgggattattttctttttgactgaaaaattcccataaaagtcacaatacaaaaacctgatgtggaaaaattcccttcgtttttgtttgcctgaaaacgtcttaatatcatcttaatgtttaaagcatattttcattgggtatagaattctaagttgtagattttcaacatgtcattccattgtcttctcacttctttcattttattgcatggtcagctgtaagtcttattttccctgttaagtttaatttgtcatttttctctaattacttttgagatttatcaacttgtctttgattttcagcaattttttaaatgaattttctagatatagttttcttctttatttaacctgctggggttttgtagagtttcttgaatctctgactgatggcttttatctttttggaaaattcttaggcactatttctacaaatattacatctgccccattctctctctctgaattcaaatagaatactgattacatggatgttagaacttttttgtattatatatatatgtaacatatatatatatacacatatacatatatgtatggacacacacacatatattctgatatgatacatatatatacatatatatcagaatggtctgtaataaaattttatccatttatctctatgtgcttcaatcaatattttattacaaggttatggtataacatcctcttgaattgatattgttatcattatgaaaaaatgatattacctaaattccagtttactacaggtgttctcagatatgtcaaatctactattaaatttatcattatacttatttatttcagtgtatttattagttgcagtatttccattcaattcccccctctttttttttttttttttttttttttgagactaggtcttgctgtgtcacccaggctggagtgcaatggcacaatctcggctcactgcaacctccacctcatgggttcaagcgattcttctgcctcggtctcctgagtagctgggattaaaggcacattccaccatgcctggctaatttttgtattattagtagagatggggttttaccatattggccaggctggtcttgaactcctgacctcatgatctgcccgccttggcctcccaaagtgctgggattacaggcgtgagccaccgcacctggccaaaaattccctttttttttttgtagatgctccttatctaattactccattatctagattgcctatgagactgtttctcttgtctttctgtgttcatggtttttggccatttagtcttgcttcctacagggtctggtgacttaattaaaggacacacattgtgtataaaaaagtacagttgctctggatggtagtagcctattccagaaataatttaattttcttctggcaagcagatagaatatgaaaagaacacctcaatcatgtttaggttatgtttaatgcattactttcaatggcaaaaaccacaattacttttacacagaccttatatgactcagtaaaggccccaaaggaaatagtagaggtcttctttttctttttgagagtgtagctactaagtcttatttgtcttggttactttccaatctttcaaagaatattttacttaatcttcatattttgtatttaattcagtatgttttatttagctttgatagtcatgcttatgacagttcccgccttatctagaacccaattctctctccttccttataatatgttttaaggcatatttgcttccaagacaattttctctttctttgttttcttcctcactggctgttccttccaactgtcctttactgcccttcgttccttagacctcttctattctgtatctacctgcattcctcaggtgatttcatctagtcatatggatttaaatggcatctaatctttgagaatggtccacttttttttttctttctgatcgggacctcctaggaactgcagaatttgatatcaagctccttactggacatctccaattgcatatctaataggtatctcaaataagtaaaaaagccaagtgtttgactctccacaccctataaacttacacacagtattctcatctcgattgatggttactcactctaatcttctagttgctctgtccaaaattttgggtcatgtttggcttaggttttcctttcacattcctcttctaatttttcaaaaaaaaaaaaaaatcctgttggttaaatcctcaaaatagatccagattctaaattacaatctcgattgttatcactgaggttggagtaccattgtctctcacctgtcagattacttcaatagactcccttacagtctgctttttaacagaaaaaccagaaagattctttaacaatataattcaggtcatgttactcatttgctcaatactctgcaatggcttcccattttcctcatagtaaaagtcaatggtcttaaaataacctgaaaagtcctacacgatctttctcctatatatttttttttacttcctctcctacatttccctccctcatttactctgcaacagccaccctaaccttgatatgttaggaatattctaccatagcactttgcacttgctatttttctggcctggtatattctccaagatatccacaagtacaactccccaacctccttaaagttgtaactgaaacatcaccttctcaataaagcctagtttaacaccctatttaatattacaatctgctatccggttcacctgctttttcatagtacttaccatctcctaacatcctagatatctgcttatttttaatctcctctacttattttcatctcatcacttattgtctgcctctctttgttagaatataaactttacaaggatgtgggtcattgtctatactgttcaataatgtaccctaagcgcctgaattagattctcaaatatggttggggctcgataaataattaattatagagcaaaagaatatgtaaaatctgacaatttctcaccacctcaaattgctatcatcctagtccaagttagcgttagcatcatcacttgccaggataattgtaattccttcccaaaagttttcactattttctgccattccacagtcattctctatagagtagccagaatgattcttttaaaacatagggcaaataatgtcattcctctcacccaaaccctcaaaagcttcttctatcactctgagtagccacagtctgactccaggctacctctctgacctctacttttcttaccaatttcctccttgctcactgctgtctgtaatcttctaggccattccttgaactacccaagcatgctcccactccagggcctttatgattattgcaattttgttccaaaacactttttttcttagtgcttacatgacttacttttcctcttcctgcaggactctgctccagcaatattttattaaggaaggtgaatgtcatgtgtaaatcactcactttttacttgtttttgtgtgtgtttttttaaataaaatgtaacacctgaaatatatcgtactttctcctcactagattttaaatgccatatgaactgaaattttttttaccattaatttctcaattgcctatggaacatagtgggcattcaattatttcttgaatgaataaataaataaatagtgcagccattacgagcttagactttgaagtcgtataattccctttataaaatgaatattaaacatagtaatattgtgttggttagatgatattgaaacatgtgaagaatttagtatattgtctataaatatttaataaatggtagtgatgatggaaagagaaagcagggtctaggtttgggaacataaatgagaaaattattatgtgaaccctttgaatttttaggtggtttctttcccattatgttaacaaccctgcattgggttggtgtggttaccaatttgtaaaatttggggatggattaggacatttctagcaagcttagctttaaaagcacagctgattccattgagcaaaggaagaaagtccctggagtaggtttctgccttgggcatctgtacttgcatgtatgtgtaggtttatatgtgtgggtatatagctggtcatcattaggcatagattccatatttgtgagttaatctactcattagaatttatttgtaacctcctaaatcccccaaatcaatacttgagttgctttcacagtgtttttatggtcatttgtagacatgcatgtgcacaaagcagtggaagcattgtttcctgataggtgtgtttccagctgaagtcaaacaaggcaatgctctatcatcttgtttcacttcaacaagtgtcctttttgctatttgccggcacatattttgcattgtgtgctttttgatggtgatttcatggtttaaaatggaccctaagtgtactgctgaagtgctgtctggtgtttgtaattgcaagaaggctgtgatgtgctttacagagaaaatacatgttttagataagcttcattcaggcatgagttatagtgtcttgtccatgactgcaatgctaacgagtcaacatataaattaaataggtgtttttaagcacaaacacacatcaaacaaggttatgcattgattggctgatgaaaatgttgtgaccagagactcacaggaacctaatcctgtgttttccctggaagcaaagattcagtatttaccaattcagtgtttgcaatgactttatagaatttaattgccgccaacaacatgaccatgtggattgtgctagcttctctctaggcaggttcagtgtgcaaatgagtggacagatatgaatattagccatgttaacaataaacagatgctccatttcccatttaggtgaattagggtccattttaaaccgtgattaaaattaaataggcaatccctttggctcattctaagtgaacaaaaactttctgggttgttttctttagaaattctactcaggaggtagaagtgctgatccctcatcagaagttcccaatgcacagaagcatacacttccaaagatcttctccattagggaataagtttagcatataaattaagagcacagactctggaatccaaagcccgggctcagatacagtccccactacttcctaccaatgactttagtgaataatctccctgatcctctgttcgctgatctataaaatgaggataatgataggatctacttcataatgttgttgtgaagcctaagtgaggttcccaggaataatgattaacagggggcttcatacatacatagtaagtgttcaacattcactggccattattattcttggagtaataataatggttgaaaatttggatttcatttcctccaggaatggtgaaactgacagtttaaaataaattggataggattcaaaaaatgtccatgcagttacacttctaattcactcttctgcctccggcatttctttcagaatcctaaggaatacttgttctgacataccgcatgaaaatcctggcccaggccttggtttagactcctttccttgaaaaagaacaaggcaggactaagggctaagaatgcggtgaaaagaggaaagggcagctccctgtcttgagggtcctgttgctcttaatctctcctctccactccacttcccacatctcgatgtatccggggaccacttctacagcaagtgcctgacaacttccttatggaatatatatccctgctaaagaatccagatcatagattttgatcttcattgtaagtttagtatgtcaaagctggaggactcttaaaggttagtatctagacagaatgagatggttaattttatgtgttaacttgaccaggcatggggtacctacacatttagtcaagcattattctgggtgtgtcttcgaggaaatttttggatgagattaacatttgaatcagtagactgcctttcccaatgcaggtgaacctcatgcaatccattgaaggcttgaataggagggaactcatgctgccttactgccttcaagctgtgatatcagtttttcctgcctttggactcaaactaaaacattgactctcctgggctctagtgtgccggcatttggacaggaactacactattggctctcctgggagtctagcttgctgactgtagatcttgttactggtaaacatccataatcacatgaaccaattccttacagtatccctttctctctctctacacaaacacacacacccattagttatgtttatctggagaaccaatacacagggatcggaataatgcctggcatatgttgcatgccctcctagatccctggtagaccttcttctccattgagaaccaatggatcttctcatcacagtgcttcaggaaatgagacagttcagagctgggctcagggcttagttctctcaacttctagcctggagctgtcttcattccccagcagcctctacccacatgacatattttcttcagctccatgtcagctgatacagtttggctgtgtccccacccaaatctcatcttgaactgtagctcctcccataattctcacttgttataggagggacctggtgggagataactgaattatgggggtggtttcccccatacttttctcgtggtagtgaatatgtctcatgagatctgatggttttataaaggggaaacccccttcgcttggctcccattctctcttgcctgcagccacgtaagatgtgccttttgcctcctgccatgattgtgaggcctccccaggcatgtggaactgtgagtccattaagcctccttttctttataaattacccaatctggggtttgtctttatcagcagtgtaaaaatggactagtacatcagccttatagactctccacataaaatggaataaagaccttttggggcaaatgacatgcctcaggcatgtctaagcaaagtctaagctttgaatatttgttcgcttatctacaagctgtgtgacattgggcatgttacttaaccttaacctacataagcttgtgagcctgggttttctcatctgagaaatgggggaaataactatactttccccataatgaggttttcaagattatatataaagtatttagcatactctctggcatacaggcatgttaaagaaaaaaattattcatgacatttgttaaagcagtaaagcagactttattcaggactatcaacataggttatagggactactgtgatggggttttgtagtagaagagagagattgaaatgcaacaagggaaagtggaaatttatagccaaacagcatggtgagtgggggttagtggatggaaaattaccaatagaaaacatcaggagtaagagaggattctggctaaacaaacctagcagggctcttgctgaagacaggccaaggtgatcatacatcacctgggagatggtggagggtgaagaacctaatcaaatatcaagggtgggggattctggctataccaacttagcaagattcttgctaaaattgggtgatgcaaaaacagacatagaagtccaaaagtcaagacctagatgggacaaggattcagaaaagtctaactaaagttgggttaaggagaggagttttgtcagtaagcattcaaaagtgttagctttaaaaaaaaaaattatcacccagaccactatcagattcttagaatactcaatctaatattatttattcatttaggaaccccatgcaaagttgatcagacagtaaaccagtgaggtctgtgtggatactcaccaaatcaattatgccaatgttattccagccttgcattatagggagaaaagaaataaacgtggggatgacccagcagcctcccagcattaatgcgatgcgcagaggggtcatcttgttcctatagaccaaaggctggcagcagatggcgtaatacctggagagagaatagagggcagagcataggcatgggcaaggaggaatgggagggagagaaaagagaatatatgagagagaaaaggggaggaagaggggatggagcaagggatagagaacagcaaacattgaggagaagagtcggaggggaagcagagaataaaaataaggaaataaaagaaagaatacagggtaaaaagaggagagcaagtggcagaggaagggaaaaagaaggaagagagagaaaagaacagaggaaaggaaaagtgattatataatacaacatgatatactggcctgtgagtttctgttaatataaatattaatatatactttggatcacatctgagaatcattgcctgcagttggccccacagtcctctccatctcccaatatctggaggagctccacacacaccagaaggtcttttctatttctggcactgttccaacactatcccgatgcctgtgcattgaggagcctctgcccagccctctgggcctcagtatccaggcaactgtaatctatttgattacaacttgaggtgacccaggcatagctctacatctgggctctaaccactgtgtctcagatttgtccccttacccttgatcacctgcctacatggaagtggagctctaagtccgtgtttttttttttgaattgtggttcaaggattcccctccatccccccatccctgccatgctgaatcaaactcacctgaggaagcctttttaaaatgcagatcccaaggatctcctgaatcagagcctgttggtgaacaacctggagcttgcatgttgacaagtgtgagttattactaagtgtgagttattgttaaggatactcagtttcctccttccaaacacgtacacttcttggcatccttacggctggataggaccaagggactagtcctgaccaatgaatcatgaacagaattgacatgcatcacttctgggacaaaccatttaactgtttctgggatactaagaatgtaaaattttgaatatttcctgctccatcatttcctgtctactggatgagaccaccccacttccatttattagagtctgacctctctcatgggacacagtgctcactatcttttgattccatgttctgcctatgatactaactttcttcctgcctccagaaagaggtacaatctgcccattcaacagtctggcctctaacttctagaccgttcctgcatgttactctggccttggagatcacctcttccatgcccaggcatggcatggaatttcacaacaggcagaatgctacagtagatctatcattcatttctctttgggagagtacaaaatagaaatgcaaaaagagcctggaggctgtctattctttaaggttttataccatttaatgatgaaccaccctcatacacccctcattttatgcagttcactttgttaatttttcccacctcttcttttcttttcttaattcaaagcctaactaacaaaacaatggctatattctttgaagaggtggtagtaggatgggttgagagagagggtggaatgaggagagccccgtgttggagcacgaggagcaggtgcctcaggagcagggagaggagaaatacccgctttcctacaaggcactgaggagcagctgacgacattgtgccaaaagctccttgtagctggcaagcttggtggggtgtcctgatctgggccagagtgcaagaaacaacaaatcaaagaatgggagactgtcttgctccgaaaaaccattgtctccattataattctgacatggctgcaaaatcaaactaaagataactcagtcattgaaagaatcatgattagctggattccctccacactgttggcttacaagaaagacaaattatatctgagtagcaaatttttctgaatggtgatattcataatcatcagaggtttattattaacatagaattaatgatgaatttgaagtggatgaaatatactctttttttttcaaattttgtttccttcttgatttcctgttagggggcaagtttctttccatttagcatccttcttcctttctcttgttaatagcacttcaaatccttcgggagttatctctttgctgttgctatagtgctgttgggaaaacaaatgatggggctttgacttttctagcctaggggtgacccgatcagactttctcctaggactcaatgtcctgcagagggatgcaaggtgggcaagtcagcagagggctttttatctcagcagcagccccctggtagggctggggattcattcctgctccttggatcttttgcagcatgctcttacccatcaagtcctcactccttagctctctctttaaataaaccacctcatatatttccaataaattctctttttgcttaagctggtgtcatgggttgaattgtgtccttcctcttccaaaagatatgttgaattcccaactctcagtaaccttggaatgtgaccttatttagacataggattttaaaagaggcaatcaaattaaaatgaggtcttcagggtgatcctgaatccaatgtgactgatgtctttatgaaaagaaaaattttgacacagaaactgatatgcacagtacgaaggtggccatgagaagatggaagattggagtgatgcgtccataagccaaggaacacttaaagttgccagcaaccagcagaagccaggaagaggcaagaaagaatccttcccctacaagttccagagggataatcgccctattgatacctttatttcagacttctagcctttagagcagtgagacaacaagtgtgtattgttctaagccatccagtgtgtggtacctgttatgacagctttagcaaactaatacagttggctaataacaatctcttgcttgcaagaaaagtataccacttcacacagagcagtaaaactggcttgaatgccagatatatctttcatagtatacttaagtaagaatatcttttgtttcattcaatatactttcagatcatagctcaagttttggcatcctttcttctattatcccaaaaaggcaatagagggataaatgaagaatgaattctgccctatctttgttgtgtaatcaatataatttttgaggtttagaatgaggtgccgagatgttgccaagtaaagagcagatttcagaaattttggttggatctctaacgtcacaaaaatccaaaagttcaaaaacacaaggccaaattaagtatcctataggacactgttcaccacaaccaaggtatggaacctacctaagcatttattagtggataaatgagtatagaaaatgtggtatatatatacatgatgggatattattccatcataaaaaaaataaaatcctgtcatttccagcagcatggatggaactggaggacattatgttaagtgaataagccaggcacagaaggacaaatattgcatgttgtccctcatgtgagggagctaagaaaattgatctcatggaggtaaagcataaaatgatggttaccacaggctgggaggggtagtatgtagggggagtatgaagaggggtcagcgaatgcatacaaaaatacaattagatagtgggaataagatctagtgtttgggcagcacaagtgggtaacttgttaacaatcacttattgtatctttcaaaatagctagaataatagatttggaatgctctcaacacaaagaaatgataaatgtttgaggtgatggatatcccaactaccctgatttgatcactacacattgtatgcttgtatcaaaatatcacatgtaccccataagtatgtacaactattatgtacccataaaatttaaaatattttacataaataaataatatcttgcaggacaaaaagtacgtttcagaaagcaggatgtcttacctgagaagattctttgatttccataaatggatgtggatgtttagagggttatgttgggaaaataatagaatttacaagagggctttagaatgtatggttatattggtgctcataacatttttatgaaagcctttctttctaaatctagcttgcccagggctattgccagtttcccttgacataatgatcatcccatgaacaataatattgccctacattctgttgtccaaatgttctatgctttaatttgccttaccctagatttctaggagctgctgctatatagaattaaatagtggtaacaggtttccttttaaaattcaacttaaaggaggatactgtgaatgtagtacacattttaccaatcccttacacattttttaatttgaaacagaatcctgttctgttgcccgggctgaggtgcttatgtgatcttggctcactgcaacctccgcctcccaggctcaattgattcagctgcctagcttcctgagtagctgggaatacaggcgtgcaccaccacacccagctaatttttatatttttagcagggacagggtttcgctatgttggctaggcttgtctcaaattcctggcctcaagtgattcacccgccttagtctcccaaagtgctgtcattacaaacatgagccaccacacctggcccccttacacattttacatatacagtcagttccctggaaaatgcttgccagaagtaaagtgcttgggcaataagcccaactcgaagggtgctaaggtggaatacatccaaacatgcccaaacacagatgtagaaatttgctcttgcaggatctagggtggttaggcaagggtgggaagaatcctttatctccttttttaaaattatcaataagtaaagggggaaaaaggattttattttacttaaatttaaattaggttaggtagattgttagtgacaggtaaggatatgaataagaaaaatactgaattatgtctaggtatatgttttacttgcattttgacctctgcagcttcttcaatgtggtcctctgtcttacagtaaacataatttgatttttgagtgggattgagtatagaacataaggttcttatttggagctcgaattctagcatctacttaactttatgtgctgaagattcacaccaagacctggcacctttgaggcagcagccctaaataagtcacctcatatccttccaatgtctttctgatctttgctttcgagcaaaaaatctagaaaagtaaacatcctctgaaggctggactcaagaatgcaaattaagtaggtgaaaaaaaaatcactgaataaagggattaataaaaattgagttctagtgttaaccgatggtgcttccttaaaattttaatatttgtctgtagataagactagatagaaatctgataacttgacttttatatattgcagttgattttcagttcctatatttggattataatgtccccgttaataacaaaaaggaaactgacctatcatgaactattcctgcaacacataaacaccaccactagacagaattagctaattaaatttgcaagttctttggagggaggtaaggcaaaatgcactggctggtttgataataatagctagtatttatttactgaccaagggctctgctcatttgatctcatttaatccgcacaactattagattggtgcaaaataatcgtggtttttgccatcaagaataatggcaaaaaccacgattattttgcaccaacctaacacttttgagacaggaactgtaaatatatccatttcacagatgaggaaagggaagcacaggagtgttcgaaatttgcccagtctcacaggtggtaagaactgagctggcatctagcccaggcagactcactcaagagccaggacataaacctcctatcatttcactcagctgcctctcccattgaaaagccactttggaaacaatcaaaacatgaacatactgaatctcagaacttgaaggatgctaagaatcatgaaatcctcaagtcctctgatatggtttggctgtgtacccacccaaatctcatcttggattgtggctcccacaattcccgtgtgttgtgggagggaccaagtgggaggtgattgaatcacgggagtgcgtctttcccatgttgttctcatgatggtgactgggtctcacaagatctgatggttttataaaggggaatttccctgcacaatctctcttctctagtctgctgccatgtgagacatggctttcgccttctgccatgattgtgaggcttccccatccacattgaactgtgagtccattgaatctctttcttttgtaaattgcccagtcttgggtatgtctttatcagcagcatgaaaatggactaatacagtaaattggtaccaggagtggggtgctgatgaaaagataaccgaaaatgtggaagtgactttggaactgagtaacaggcagaggttggaatagtatggaggactcagaagaagacaggaagatgtgagaaagtttggaactttcttaagacttgttgaatggctttggccaaaatgctgataatgatatacacagtaaaatccaggctgaggtggtctcagatagagatgagaaacttgctgggaactggagcaaaggtggctcttgttatgatttagcaaagagattggtggcattttacccctgccttagagatttgtggaactttcaactggagagagatgatttcgggtatctgatggaagaaatttccaccaggaagaaatttccaccatcaggaagaaatgttaagcagcaaagcattcaagaggtgactttggtgctgttaaaagcatttagttttataaggaaagcagagcataaaagtttggaaaatttgcagcctgacaataaaatagaaaagaaaatcccattttctgaggagaaattcaagctggctgcagaaacttccataagtaacaagaagctgaatgttaatccccaagacaatggagaaaatgtctccaggccatgttagaggtctacgtggcagctccttctatcacaggcctggaagcctaggagaaaaaatggttttgtgagccagacccagggtccctgtactatgtgcatcctagggaattggtgccgtgtgtcccagctactccaggcatggctgaaaggagccaacatagagctcaggccatagcttcagagggtgcttccatgtggtgttaagcctgcgagtacacagaagtcaagaattaaggtttgggaacctccacctagattacagaggatgtatggaaatgcctggatgcccaggcagaagtttgctgcaaaggcagggccctcatggagaacctctgctagagcactgcagatgggaaaagtggggttggagcccctgtgcagagtccctactggggcaccaactagtagagctgcgagaagagggccagcatccccagaccccagaaccagagatccaccaacagcttgcactgtgcaccttgaaaagctgcagacactcaatgccagcctgtgaaagcagatgggagggaatctgtacttagcaaagccacagcagtggagcttcccaagaccatgggaacctacctcttgcaccagcatgacctggatgtgagacatggattcaaaggagatcattttggagctttaagattttagtgccccactgtatttcagacttgcatggggcctgtagcccctttgttttgctcaatttcttccatttggaatggccatatttacccaatgcctataccctcattttatctagaaactaattaacttgcttttgattttacaggctcataggcagaagggacttgccttgtctcagatgagatgttggactgtggacttttgatttaataccaaaaggagttaagacttttgagggactgttgggaaggtattattggttttaaaatgtgaggacgtgagatttgggagaagccagaggtggaaggatatggtttggctgtgtccccacccaaacctcgtattgcggctcccacagttcccatgtgttgtgggagaaacccggttggaggtggtttaatcatggggtgggtgttccccatgctattctcatgatggtgaatgggtctcaaaagatctgatggttttataaaggggagtttccctgtacaagctctcttctcttgtctgccaccatgtgagatgtgcctttccccttctgccatgattgtgagtcctccctagtcacgtagaattgtgagtccattaaacctctttcttttgcaaattgccaagtcttcagtatgtatttaccagcagtgtgaaaatgggctaatacatcccctctaaaatgaagtgtgtatccaaacccacttaatttttctagggatttggaattcaccaggtcctactgcagtacattctaaacttaagggcatcctaaagttaagaaagtttcctctaaaaatcaattttcggtaacttgtagtttttccctctggcttaatttaaatttctatctaattctttttctgcatagtggttctagtgatatctgaagagagcttttacatccctctgaagtcttattttctgcaggtaaaaaattccctgttgctctcaaccaggggtgactttgctcaccaggggacatttgacaatgtctggagactttgttgttgttgtcacaattgggaaggaaatgctactggcatccagtgggtagaggtcaggaatgctgctcaacgttctacagtgccccaataacaatactggtctatgtcagtagtgctgagattgaggacccctggtttagatgagaggattttcaccaatagcaggagtggagctccttgtcctctgtatgtgctataacatgtcgttatctcttaagagtggggtgccacaaggacagcactatgttctggtgcatcctatatggaccaaaaaccactgcattgccttccactttgctcaccataacttaatatagcttaggggatacccagaagcacaggacacctgtgcccctaaaaaagaaaatgatctaggacaagaggtgggaaaaccgtcccccaactgatgtataagttccatgaggacagcaatgtttgccttgttctgctttgtgtccatgatggctagtacaatgccagatatattgtggatactgacaaactggatttttaaaatgtaataaactctcaatcactaccaagtacaataaattccattaaaatatgttaccaggttttggagatgtgaacaggcatatctagcagagggatggggaaaggctttcttcaatagcggttttttaagtcaaatgttagagactggatcaggatggtggaggagaaagtgtaatctaggtgctgtagacagcatggccaaggcctgaagagagaaattatatatatgaaatacatacccataaatgtatattcctatatctatatagccctataaacataagagtaaagttaatgaaattgtagggtgttcacaaggaagtagacaaaaataagcctaaaaaggctgactggggcacgtctcagagcagtggttctcaaattgtatcatctgtcagaatcacttaaaggatttgttgaaacacagattgctggtaggtctggagtgaggcccaataatttgcatttttgatatgttcccaggtgatgctgttgctagtggattggagaacacactttgagaaccattgtcttagaggttttgaatgttaggctaggaggagttaccaaaagatttttaagctggaaaacgtccatcgtaatcaatattgctgtgtgcttttctaaagaagctgaattaaaacgaagtcaagagaaagagttgttgattcatatgctaggtagacagtgtttaacaggaaaagtaattgtctcatctcaggaatacatgaatcagcaaaatttgttctccagccttccattgggtatctcccattcttccttaaccagaaaacttttacaaagtagttaaatgaatgttcaaatgatgagtgaggttccagatggccaggattaactaaaatgaagcaaggatatttacaaagtaatttcttatgcaaaacatttcaaaagtattgctcataaaactccattaaaatctgcttttgtagacccagccaccagcttctcccactgcagccatgtgcaaatgtgtgatcaaattgcttttaaatgtctctggggacacaatttactttgacaactcttagtaggcagccatgtattttaagctccatgctaatcccttccgtgctccttctgcaattaaggaaaattctacttcctcacttcctgccctcccaaccacagaaaaggcacaagaagcaatgataataagttggaattctagactgtcagaattggaggagatagtagcagtcaactttacgtcttcaccattgggtaccaactttccctgccttaactccttagtagctctgtggtcttagaatcagttactaacctcaagaagatccagtttcttcatctttaaagttagaataattatgtcaacctccaattatgcctctccttcactgtgagaattgatgaaataatatgtttaaaacataggaagttcttggcacataaatatctgtttaatacatattattataaacagactcaaatatattttggaattatgagctctacattatttaacaaataataaaaagccacttggttcaacatctttccctaacagttgattctaagaaatataaaggtgaatgaattggtctctaaaggcaaatgaaagcattaagaccatatttgttatgtgcaatggaggtggttacatgtaagatctagtaatcatacattgtcgcttaagctgctgagttttgatgtagatgttacatgccaatagataacaacagggtaaacaggtcatgtatagcttggcaaaaccttccaactgggttccctggccacctcttaataggtgcatttgggctggtaacaggtatgtaccttcctgggatgaagctcccagagtgaggggcaggctgccatctttgctgttttgcacttttcactcttgatacctccatgtagtgggagatccaaggtgactagcaactggagcaggcccccagcatactgcagtagccatatgttaaagtagccagacttaagtgggtacctgttcccatatctcctcaccaggcaggtcctccaggcctgggcctccagccatcccctgccagaggtattgagccagtagcaactcaggacctcccgggacagagactccaggggcaactgaaagcctctctgccactgcttctgcagtggaactgcccttgctacccttggactaatgaaggagtaaagaccctaagtgccttctctacacctccaacaagctgcacttgacccaaggagaggaggccagaccatctctcatgggtcccacctactccttctgcttgcaccagacaggtaacccctaacttgggccccagcacatacccttcagtctgggctgactgcactgagcaattcctgacctcaatctctctggggtggagcctccaagagataagcaaaagacccttgtccacaaccactactaaggtcccttcctctgctgcctccaagtggaggaaggaatatgaatactgagattgccccagagctacagtcagcagcccaggagttccaagccatgatctgcagccagcatgcaagtgggagaggaacccacaccttcagagcatttagagggaacacagctgcaactgtgaggaaacaggggagccacacaactgagcaagagtctaccaattgaccatatgtctaagtgccacccacaggaccacacctcgaagcttaagcatcaaaaatacctcatttatatacccacctctgaaaccaaagacaagaagtcagcttcaaataaagactgtacacaatgccttggccctgtgaaagcaggcaggaaaggagtctattgactgtattcaatctacactgcagttaaaggaatacccacatacagagatgagaaacaaccaatgcaaaaactctggtaattcaaatgaccagagcattgttatgtttccaaatgactgcaccagttctccaacgagagttcttaaccaggctgagctggctgaaatgacagaaatataattcagaatatgaataggaatgaagagtatcaagattcagcaaaatggcaaaacccaatccaaggaaaccaagacacacaataaaatgatacagaagctgaaggatgaaatagccagtataaaaaaagaacataatggatctgacagagctgactaacacaacacaagaatttctcaatgcattcagaaatttaacagcagaataaatcaagctgaggaaactttctcagaacttgaagattgtctctctaaaataagacagttagacaaaaataaagacaaaataattaaaaggaataaggaaaacctctgagaagtataggattatgaaaagaggccaaatctacaaatcactggcatccctgaaagggatggggagaaagcaaacaacttggaaaacatatttcagaaaatgatttatggaaactcccccaaccttgctagaggccaacagtcaaattcaggaaatatagagaactcctgcaagattctacacaagaagaccatccccaagacacataatcatcagatattttaagataaaaatgaaagaaagaatgttaaacacagctagagagagagagaggaggtcacctacaaagggaacaccattagtctgaaagcagacttctcacctgaaaccctacagaccagaaagaatcgtagtcctataatcaacattcttaaagaaatatcttcaaccaagaatttcatatccagccaaactaagcttcctaagtgaaggagaaataagattcttttcagataagcaaatattgagggagtttgttaccaccagacctgctttacaagagatcttgaaaggagcactaaatatagaaaggaaagactgctaccagattatacaaaaacacacttaaatacacagaccaatgatatataaagcaactacacaaacaagccagcataataaccagctaacaacacaatgacagaatcaaatccacacatatcaacattaaccatgaatgtaaatggattaaatgcctcacttaaaagtcacagagtggcaagctggattaaaaaaaaaaagtgtgacccaatggtatgctgtcttaaagacactcatctcacacgtaatgatacccatagacttaaaataaaggaatggaggaaagtctaccaagcaaatggaaaacagaaaaaaacagggattgcaatcctaatttcaggcaaaatagacttcaaactaacaaagatcaaaaagcacaaagaagggcattacataattgcaaagagttcaattcaacaagacctagctatcctaaatatatatgcactcaacacagaagcacccagattcataaagcaagttcttagagacctacaaagagacaacaatgcccacacaataatagtggaaggcttcagcacttcattgacagcactagacagatcactgaggcagaaaattaacaaagatactcaggacctgaactcaacattgaccaaatggacctgatagacttctacagaactctccaccccaaaacaacagaatatacattcttctcatcaccacatggcacatactcttaaatcaatcacgtaattggacataaaacaatcctcaacaaatgcaaaagaactaaaatcatatcaaacacactttcagaccacgatgcaataaaaacagaagtcaaggctaagaaaattactcaaagtcatgcaattacatggaaattaaaaaatatgctcctgaatgatgtgtgggtaagtaataagattaaggcagaaatcaagaagttctttgaaactaatgagaagaaagatataacataccaggatctatggaacacagcaaaggcagtattgagaggaaattcatagcactaaatgctcacatcaaaaagttataaagatctcaaatgaacaacctgacatcacaactgaaagaattagagaagcaagaaaaaaatcaaccccaaaaatagcagaggacaagaaataaccaaaatcagaactgaattgaaggaaatcaagacacaaaaaaacattcaaaagatcaatgaacccagaagttaggtttttgaaaacatgaagaagatagataggatactagctaaagtaataaagaagaaaagagagagatctgaataaacacaattagaaatgacaaagaggatgctaccactgatcccacagaaacaaaactaatcagaaactactataaagacctctatgcacactaactagaaaacctagaagagatggataaattcccggacacatacaccctcccaacactgaaccaggaagaaactgattccctgaacagaccaatgattagctctgaaattaaatcagtaatagacagcctaccaaccaagaaaagcccacacctgatggattcacagcctaattccaccagatgtacaaagaatacctggtaccattcctactgaaactattccaaaaaattgaggaggagagactcctccccaacccatcgtatgagaccagcatcgtcttgataccaacacctggcagagaaacaacaacaagaagtcaggccagtatccttacatgaatatcaatgcaaaaatccctaacaaattacttgcaaactgaatccagcagcacatcatatagctaatccaccacaatcaagtaagcttcagcctcaggattcaaggttggttcaacatacacaaaccaacaaatgtgattcatcacataaacagaactaaagacaaaaaccacatgataatctcaatagaagcagaaaaaggctttcaataaaattcaatagctctttatgttaaaaattctcaaaaaaaactaggtattgagggaacatatctcaaaataataagagccatctatgacaaactcgcagccaacatcataatgaaatggcaaaagctggaagcattcccctttacaaatggcacaagacaagaatgccctccctcttctaatagtattggaagtcctagccagagcaatcaggcaagagaaagaaataaggagcacccaaataggaagaaaggaagttcaactatgcttttttttgaagataacatgattctatatctagaaaaccccatagtattgccccaaaagctccttcagctgataaacaacttcagcaaagtttcaggatacaaaatcaatgtacaaaaatcactagcattcctatatacctacgacagccaagctaagagccaaatcaggaaggcaatcccattcacaactgccgcaaaaagaataaaatgccaggaatccacctaaccagggaggcgaaagagctctacaatgagaattacaaaacactgatcaaagaaatcagagatgacacaaagaaatggaaaaacattgcatgttcatagctgggaagaatgaatattgttaaaatggatgtactgtccaaagtaatttgcagattcaatgctatttctatcaaactaccaaaaacattctttgcagaagtagaagaaaaactattttaaaattaatatggaaccaaaaaaaagcccaaataacgaagtcaatcctaagcaaaaagaacaaagctggaggcgtcacctcacctgacttcaacctatactacagggctacagtaaccaaaacagcatggtactggtatgaaaacagaaacatagaccagtggagcagaatagagggtcagagataagaccacacacctacagctatctaatctttgacaaagctgacaaaaacaggcaattgggaaaagattccctattcaataaatggtgctgggtaactggctagccatatgcagatgattgaagctggacccctttcttacaccatatacaaaagccaactgaagatggattaaagacttaaatgtaaaacccaaaactataaaaactctggaagagaaactaggtaataccatcctggacataggaacaggcaaagatttcattacgaagacaccaaaagcaatcacaacaaaagcaaaaattaacaagtgggatctaaacttaagaacctctacacagcaaaagaaactatcaacagagcaaacagaccctacagaataggagaaagtatcttcaaactatgcatctgacaaaggtctaatatccagcatttataaggaacttaaacaaatttacaataaaaaagtcaaacaaccccattaaaaaatggtcaaaggacatgaacagacacttttcaaaagaggacatatatgcagccaacaagcatataaaaaagagctcaatatcactgatcgttaaagaaatgcaaatcaaaaccacaatgggataccatctcataccagtcacaatggctattattgaaaagtcaaaaaatgacacatgctggcgaagttgaggaaaaaagggaacatttatacactgttggagggaatgtaaattagttcaaccattgtggaaacactatggcgattcctcaaagagctaaaagcagaactatcattcaacccagcaatcccattactcggtatatactcagaggagtataaatcgttctaccataaagacacatgcacccaaatgttttttgcagcacccttcacaatggtgaagacatagaatcaacctaaatgcccatgaatgaccgattagataacaaaaatgtggtacatatacactatggaatactatgcagccatgaaaaataacaaaatcatgtcttttgcaggaacatggatggagctataggccattatcctcaggaaactaatgcagaaggagaaaaccaaatactgcatgttctcgtttataaatgggagctaaatgacgagaactcatgaacacaaaaaagggaacaaaagacattgcgtctacttaagagtggaggctgggaggagggagaggagtagaaaatcatattaggtactgggcttattaatacttgggtgatgaaataatgtatacaacgaacccctgtgacacagttcaactatataacaaatcttcaaatatacacccaaacctaaaataaaattttaggttttattttatgtgtgtgtatatatatatatatatatatatatatatatatatatatatatatataatcttatatataatttttataaaataaaaattttagaaaagatatttataaaaaataggtgtgatttggcatccagctgatcatgggagataagtaaaagatgacttcaaaaagttgtgtttcgatgtctgaaagataactaatagattcaccttcaatatacaatgtggaagaggatatagtattagtttacaataaaaatgtctacttgagcacactgaggtttgagaaaacagaaagatgtttaaggcaagatgctgagcagacagagatagaaccccagagcccagtgtgtgaaaggggtgagggagagacaagagcagaggtgcaagtgaagccatgggataaatgaggtttccaaaggaaagaggggacatactcagggctggaaggctaaggatctaaccttcaagggcactcagctatgagtcagaaagaacaagatgactatcagtgtctgggaaggccctcgctacagccactaggaatttgcatttagagaggaaaacaataatggaatagtccttgtggctaacattaattgaacacttaccaagtaccatgcactggtctatgcattattcagtttattaactgaacaataaacactcagttatttattcctcacaagtcctaaaagagaagggaagggattttctattaataacacaatttttacagataagacaaagtccagaaaacctttgtcacttctccaagatcacacacttgacaaccagtcaagctgtgactgaatctaagcagcctagcacctcaggtctcattcttaaccactttctatattaagagttctgaggacagagaaaccaaccccagcgtcatacaaacaaccacaagtcacatctcagcattcagtgctcagccaaacatgcatggaacagctattatgttccagaaagaaaaacacacgaatagataagataaggcctactctcaagaattttatattctggagcaaggcagacaaatcaaacaattattgagacgcacataataagaaacttctattaaccacgatgctttgattcaatactccatgggagctcagaggaagaaatgacaaatttttatgaatgaagcccaacagtcattggagaaggcgacacatgttatctgagtattgaagaaaggtggatgtttgccagaaaaataaaagaaacccaaggcacaggtagcaacatgcagttatgaggaaacatatattcagggaatgataacagatcactcatgggtaggagttgaggtaggaaaatcagactgagaacacattggaaaagcagtgaaagctgagctaagaatttagcttttagttaacaagggctttcctatgggttttcacatgcgttttcaggagcagccactccccaggcctcaccaacttccctatcccctactgatacccacagcccctgcagatcccggcatcagcatcacttgctcaggagcctaccctgctttggagattgcaacttagcagactccaatagctttttttttttccttctccttatagtattcaatggtcaccaattttactgtaattatctgtttactgtctgtattcccaactagacaaaaagttccatgattcagagtttttctgatcattcaccactgtatttacaatgtccagaacaactcatagtaattagtaagcactccataaatgtttgatgaaatgaatataaaaataacagttcaaaccctctggcatgaaattcaactcaacaaatattatgtacaaagcctgaacctgccctaaaagagtatgtgagaaggagaaacttttaatatactttccttgtgaaatgcatttcaatcctattgggaaaacaaatgtaattgtgtgacacagttcacaatgacagacacttttcatttatacattacaaaatcgaattatactccagggagatcattaagaaaatgcagatacatttatctccagcacaagattaaacatgcaaccttgaagtaagaattgtatgttttacaagtaaacctgtttaaaagaggatcggagactaagaaactgttggagaattttgccgataaaacacatcaaatttttgagctgtgcagaggaagggtgacaattcagctgggtgtatccaaaaaagaatcttgcagtactatagagaatactatcttcaaggaagtgaaattgactttttttttaaaaagggaattacatttaatgctaagtaaaggacaaagtacagcatgttcagagaaaggggataaaaatggttaaaagtctgaaaagtatggcttatgaggccagcagaaggatctagaaatatttggcctaatatagggaagacttggggatgatatacctctgttttgttgtggaggctccataaagatacctgtagggtctggccagcctaaggggaactggtatctcctcttcttgtctgcctaacacccatctttccagtgagaactgctatttcttcacaccatatgtttttggtaaagctgggagtcatggtgcctgacctctgcccagtaaccaggatgtgtcatctccacaccacagtgactggttaagtgaagagtgtttgacacaagcaaagccaacggaaattcttccatgagaaacagcacttaggtttctcttcctatggactcatgtgttaaggatggtttaagatttgttgactgtgactatttttctttcctggtggaagaacccagcctaagaaaaaaatctaacaagaaaccagagctgatggacagcatagggacaaagagggacagatagaaagagaggaatagacatagggaaacagagagggaagtaaacagggagaacaagaaggcaagatggagacaaagaggagagggaaacagagttagagaggggcaaagttagactaaatgacattgttcaaatccttgtagagagccatgtctgaagccagacttttcagttatttgaacgatcaatttattatctgccgcatgctgctgaaagaaaccttgctaatagatcatccaataagcaagttggtaaaaacattacattcaggcaactcactggcatatatcataaactcaaaatatattcaaataagtctgcttattacatatgaaatcactggcatttacaggcagttgctatttacagtggttacctcaggttatgcagctgtggaagtggatattgaaagaattggggacattatgttctacttgtgaactgatggcattttctacaatgctcaggtattattaatattgtgacttaaaaaatctgtgaggattagaaaagggactgttagaaaaaaatcaaatacaagcttgtgaacagggaggaggttaaccaagaccaatgtaggagtgatgcaccccgtaagagatggtgagggctcccttagagggagatgtgagggtgtttgatgagaaagcagagagaacacactggtcaggaagatttccatgctccctggcttgttctgacctcagagggaactcccagcactgaagcagaatgttctcagagaactgaggaatgtgccattctagcaacattttcagttaaaaggctattgtggatggacttgcatttgagaaggttacgttctagcaaagggaaaattgaagtttaaaatgtgtattacagaaattagtaaaactgaaggcccccaaccccaatttaactgaccatccactctggccagcactacaccgtatgccctacccctcaaataaccacctgttaacgatttggtgaaaattcattcatgatctttctttttcattctcaatctctctctctttctttctctctctctctctttctctctttctctctctctccacctctctttctctctctctccacctctctttctctctctctccacacacactcatgtaaacccagatacatgcatctctatatttattttacaaaaatggaactatgctaaacattagagtctgccagttgctttttttcccccaacataatacaccagtgatatatttctaggacaacacacgtcattatttctcatggttttcaatggctgccttatatttcacttttaaaactagtactctatcatgactacttggttagcttttattcaccacagtactttagatcttaaaaaaatcaactgtactctaaagcttttaaagcagtttttgatctcctatgacccatactatatggtgcatttattttaattatgctttggaaattatttttaaggaggcaataaattcttattaacagaattcaattctgaaagcaccaggaagcacagtgagctgagaatgggagttgggaaaatgcattttgtagtactaaaggagtcctacattttgctttgatccaggagtctgccatctgagaagagttacaaattaaagtgagccctcttgctcaaaggaactaccccttatgattgatcccagaagacttgtagcagctctagagagaaggacatggcatactgccgggaataacatggctaacaaggacatcacacctcattgagacattcactctgtgctttggcccagcccagctgaaccaaactgttaggacgggaaggacacagcaaaaacagagctagatgataaataaaaccatcctcttccaggctaaaacattgccctgtaatgttcaggatggaccctccagcactatgagggaacgctcttgggacagggaaagctggagacaagctggaggcaagatccccaagctccccaaggaaaataaaacaaaagaaaccccatctgatatcttacttatggtattggagtttttgacatacactgtcagagaatgaaatggaattattggcatgactctcacaaagagaacgtgctgaccactccatttgttcaatcgtgtttgtcaaatacctaaataagtatttatgcaatgactgtttaattgtcaacctccccataacaatgcaagttctatgagggcagggatcttgcccttgttcgtagccttgggcttcctcccattggaatagaaagacatttaagaagaaagtatagacttgattttaactataattacactgagttctacaaaggagaaaaatggttttgatggagtcagcgaagacttctgcaaagaagagaagatttagctaaaatctgaaagacatgcaggagaggaggggcagaggaagttttcaggcagagggaaaagccaaggcctcaggtggctgagcagagagccctggagaactagaaagaaggccaaagcaactcgggcctggaggtgaggttaggaagggggtgaagggaagctggggacatggacaggaaacagagggtgaaaaaccttgtatgagtctggtcttgatcttcaatgcaatgaatagccactgaagggttttaagcaaaggagcaacagtattagagcagcattttaaaaggatggcttttgatcttgtgagcgacaagtggatggggagggaataaaacatatttggagggaataattaggaaagtgttgagtgatttcttcaagaaatgatattactttggatgaatgatagagagaaatagactaggatctctttaggaaagaaaatgagcaggacttgtcattatttaaatgtaggaggcaaggaaagactgctatcagaataactacctggtttctagatgatgcaagctgttggagcagctattcactgaggaggtgcaagtttgatgagaaagatcatgagttgtatggctagttacaagaaactgacatgaacaacaacatccactaacatggaatattgtgacaagctgggccaaagtgatgccttaaatggattatccaatttatacctaactgtagtcatataaaataggtgctatctccctaagttttagagacaagaaaggcttagactcagaaaggcttaatcacttattcccattcccagaactaaacattttaaaagctgggatttgaacccaaatctcttcaattctaaagcagatggttcttaatgaccaattcatcctgtttcatgacaactcatacctactcaggaaaagtttcctgatttgaaaagtacgtaggcataaatctgaagccaaacctgtcaaggaaacctctagaccttctctcagggctgcccacagcaaactctccacaatggacagttgattctacactttctcccattttttttcctggctgactggctctttttcttactcctgcttttacacaggccttgaggttacctcagctgcccctatcacccctgcctggtcttctccaaattcctgtagtactttcagtctcactactcattttaacaatgatcatatgcaggttacccagcaggatttccatagattttctacttccttacattgtatttcctataatacaaactttcattcagtgtatcctgactgtctttaaaagtctttcatgtactaaagtcagattgttgtaaacaagctaataaacacaaatttccaactatgccatgccatgggtctggttgcttgccatgagttcaattttaccagagtcattatctctagctatagagtggagtctcattatacatgcatttaacttaagcatattcaactatatgttcttggcagaggaaaagagaaagcaatttaaatacagcaggccattatgactaccattccaatcaatgcacatatgtcccatgaaataggagatgaacctgctgtcccctcagctggtttcagtctctaagtacctcccccagtgtgattaattctctgggaagactatgatgttagtgtttaaaagtgtgtatgttagatataccacaatctctagtttcagtcaactacttttcctagtcctcaatttaaaaaaaacagtgattgtcggtgaaaccccgtctctactaaaaatacaaaaaattagctgggcctggtggcgggcgcttgtagtcccagctactcaggaggctgaggcaggagaatggcgagaacccgggaggtggagcttgcagtgagccgagattgcggcactgcacttcagcctgggtgacagagcaagacttggtctcaaaaaataaaaataaaataaaataaaataaaataaaataaaataaaataaataaataaaaataaatgaaaataaaaataaaaaacagtgattgtctgagcacgatggctcacatctgtagtcccagcactctgggaggctgaaggctgaggataacttgagcacagtagctcgagaccagcctgggtaacatagtgagacttgtccctataaaaaataaataagaataaataaaactaaattttaaaaaagtgatctatcccaagactggaggaaaacttgggtttgttgggttgctcaagacacagtaagaaatcattgtccctggcaattctgattacatgtgatttgcaccccacatttttctgagagctaacccctaagatactactacattgataacagcatgtttgtgtagtcatctgactttagattgcattctacctttatgatgaaatgtaaattagcaggaattggaaaatgaatagtgatggtacaagtgataaatacataaatctgcaacaaatgaggcaaagatgaaaatcattaggtcccctgaagtcaaatatgaagaaagaaaataaaattatgccacaagaatgaaatgctagatctgggtccaaaaatcataaaattattgggaagtttactgtaactttctggaaaagagtctccacaattatatgcacatacataaatatgtatatcaaattattacagaaacatattttcaagaaaaggttatgttcaaacatagggcattttcattctgaaccacccctgctgccctctgggaagatgtactcattcttgatgcttagcttcttcagaattttgttcatgccatcagtataaaatttacagctctatagtaaacttgattgctgacatctattgctatttagattgcaatctccttgcagacaagttataggtcttactaatctgtgcatctacagtgcctcagagagggcctgactaaaaagggggcctctgcaaaggctggagaatgactgtataactgaattatcaaatttacctctctgagattcatttcttctaatgaataagaaaaggcagacactgcccaatatccatcaagtcatgtctccagcatggagctccgctatgcacattgttctgtccttacctatccagagaaatgcagcacaggtgaaaaatcgatgccgttgtgagcaggacgtccagagatgtccgaacaagacaaaacacctccccataaatccagatgtcttgaaccagctcaatggcaccaaagggcatcaccagcaccgaaaccagcagatccgcaaaagcaagagatacaatgaaataatttgtttttattttcctgtgagtgaaaaagtgtaagagaggaggcagggggagggatgaagggaaaaaggggagggagaagagatcaagagaaaaaacagggaaaagggaaacaaagaaagaagaaaagaagggagggggaaagaggaaagaaaaagtcacatgcttagtgtattccgtgagattcaatttccccttctgtaacatggctgagaagacccagcgtggtccagcctctcctgacttctccagacctaccttataccaaaacctcttttttcctcccccttctggccaccctgccctaatctgagtttccctgcacatataggtcccttttgagggccaatgcagatgttctttcttccaacggttgcctggttaatcccacccacccgtcagtccttggtcgggcattctcaggaaactctcccaaggtatgccctgtgactgtagtcacagtccaccattttacactagcagactggctactgtgtactcacatttataacactggtcagaattgcgcttttgcactttatttgcatcatcattagatgtgtggatgtcttacttagagaggaactgcttcgttataccctcttatggcccagaggctctcatcccaggctgtacactagaatcacctgatgcattttaataagtattgatgctgaggtctcaccccagatcagttagttcaggcaccctggggagttaacgcctctcccctcaaagattaccagatacaatacaggatgcctgattagatttgaactttagcaataaatcactttttaaatataactatgtccaaaatactacatgagacatactaataccacacgatgatagtttttcaaagtgcttcaggtggttctaattgcagccagggttgagactgatgaagtagaagtgcaaaaaacacaggtttaatttctagatctgtcccttgtcagccacatcttccctaaaccattaataaaatggggaggttagattatatgtgctctcaacaattgtatatatagtgatcacaactataaacacatttgacaaagaaaaaaatgacaggatggaaatacactgaaatgtttacactggttgtattagagttgtaggattaattgcaatccctttttctccccttttatttttaaaatgttgttcccatgaatgttttctttcttaattacaaattctaatagaaatgttcacacccaactctctagggacagctcagaactcccatgtttcctcaaaaggttccctcctgctgctcacctgagctgcctgtcccagcacacagccaccatcaccagcaggttccccaagatggccatcaggataaccgtcgagagaaacgtgagcagcaccaccttctccactgacccgaaaccctcctcagaactgaaagacacacacaagcacaaagaattgaatgaaactctgggacacaagaaggaaaattcgtcttttcatcattgaccttcagaaaggtaacttcaccatcagctgatgacacatatatttatcatgcgtttaatgtacaccaaaatctgaaccggtcgcttgacattttatcctggttagctcctacataagaggagtatgaggcttagagagctgaattaacaggttattttccatccaagcacttgtggctttccttcagggcatttagttcaactagcattcagacatatgtagttgatgcctgttttgtgcacctactcaactagattgcaaaagctgagtgaatgaatgatagtaactttgcaactgcaggagcagcccaatttggtccaactttgtgtataaaatggtgagttgtgttttagttgccatggacccccaggttgcaagttaaactgaccaggcccagatgaaccaagcatgcaaccacagggtggaacctaagtgcttggaccaaggcatggggaccaaataaagaagtggacgtctcatggcatgatccacgatccaatcatatagagccctagcatcaccttgtggcataatccagtcagatcatacctcttggcattaacttatcacaagatccaatcagatcacaccttattaccctctacctataaaacctgccacagcccccagctcagggggacagatttgagctttgcctcctgcttccttgccgatcaacttacaatgaagcctttttttttttcctcaaaagccagggccatagtattggcttctataaacatcagcaaggagcccactgcttgctcagtagcaacttgaactggttgttactgagcaagttactttgcattcatacagttacttggcctgaatgcaaagccatcttgttacagtgtcccattccagcccatgcagaagcttctgcttacaggtaggttctcccagagagaaaagattgtggtgtgatggttgttcttacatcagttcacctggacaaattgaattcagattctgtgaagtctgttggagagatagtagccaataaataagctcagtggctcctttcaccaccctgatcatttcttttagtgcccacaatatgtcattgttttcccagttcaaatttgtgttcttgtcaagttcagcatctgatttagtctacaaatgttgccttccccatgtaaactcagcattttgttttattaacttgaaaatgaagatcccttttcaatgaaagcatgatatctgcagattaatattcagaagctatagggattttaaaaacttttatagtataataaaatgttctttttaatgaagtttcaaagaatcttaaaactcttagaccagcggtgtccaatcttttggcttccctggtccacattggaagaagaattgtcgtgggtcacacataacatacactaacactaacaatggctgatgagctaaaaaacaaattgcaaaaaaatctcataatgtgttaagaaagtttataaattgggttgggctgcattaaaagctgtcctgggctgcctgtgccccgacaggccatgggttagacaagtttgtcctagacccaaaccccacatttgaatatgggaaaaccagggcccagaaaagaagagctgacttgtcagagcgtgctagtggctggtctgggagaggctgcttgtcctgtgagcccaccactgagaacacacagttccaaaaatcaagaattctctgtctttcctgagctcttttgactgaaaattaaggtgcatgccctctccagatggaagcagcctgcaaagtcatggctttggccttgtccagaacttctgttaagctggcacagaagacaaggggccaaagggaatgaggaaccagtctggcagcagttggagaatgagaaagtccctccattcagctgagaagtatttttataggcagattgatagattgtttatgactgaagttcagatgaaaagaaattccagatatgcttatttaaatcacccttctacacttaagttctaactatcaacagtacaaatatcagatagggaagatttaattcaatgaggaaaactgtacacttagaaaaaagaccttaataggctgatgtggccaccaaaaattcatttgatcttaggtcatgttagttgagttaaagcactaacaaaggaggtgatggtggttctcttccctgtccttcttagagactaacggcccccctgaaactcatctcttccacccccagggcctctgtatttgaggtgccttcttcctggaatgattcttcagtgacagacttcttgtcattcaggcctcagattaaatttaacccccagttagtgtaccacagccaacaaacatttttcattttctttacagcatttactgttatctgaaatgacttctgttattgttttctgtgccccaattccacagattgacttttgttatctttttcactacaatctccagtgtctggcacaatatctagtctagagtatgtattaatgtacatgaaatgctatgtattaatattacatatgtagatgatgcattacatagtaagtgctcaattacttgctgattcagtgaaagagagatatattgtgctcataatggttatatttattattcaatgtctttgaagcctggttgaaagtatagagatttcacctagagaaaagaaggcccagagatgaaatgcaaaagctacttgcagctatctgagcgctgtcatttgaaataagagtagattcacatattcattcatttaacaatttctgagcacctactctgtgttaggcattgttgtatgtcctagggaaacagcaataagcaaaacagagagaaaaacagacaataaacagatgcatgagacagtatgtaaggtgtcagctgatagtacagtccatggcaaaaaaaaatatctaggagggtaaggaggactggatggcctgtggcggattgcagactggctatttaataaaggatgtcagggaaggttcaatgataaggttatcacaggttgtgaggctaactaagaccagtgggtgaactttaagcagtggttcccagccttacctgcatatttaagttacctgaggagccttaaaaaatgctgattctgggaatccaccctcagaggtgctgatttaattggtctgagttgcagcttggatagagaaatttttaaaatctcccaagtgactctgatgtgtaatgaattagagtcactgacagggaggcaagatttagtaccagataataagagccttctaacaattaaagatgatctgcaatagcttcccggtgttgttttgtgttccctggcacagaaagtgtttaagaataccagaatggcaatgagatactaatttgcactcattaggatggcaattataaaaaataaaacaacgaataaaaaataacaagtgttggtgtgaatgtggggaaatggaaacacttgtgcattgctggcgggaatgtaaaatgctacagccactgtgaaaaacaagtttgatggtttctctaaaggttaaatatagaatgcctatgtgatcccccaattcaatcccaggggtacacccgaaagaattgaaagcagggatacaaacagacacttgtataccaacagtctatagcagcattattcacaagagcccaaaggtgaacacagcccaagtttccattaatagataagtgaataaatagaatgtggtatatacatactacaaaattttatttctctataaaaaggaataaagtttgttgttgttgttgttgttgttgtttttgagatggagttttgctcttgttgcccaggctggagtgcaatggcgcgatcttggctcactgcaacctctgcctcccgggttcaagttattcttctgcctcgggcttccaagtagctgggattacaggaatatgccaccatgcctggctaattttgtatttttagtagagacggggtttctccatgttggtcaggctggtctcgaacttctgacctcaggtgatccgcccgcctcggcctcccaaagtgctgggattacaggcatgagccaccgcgcccggccaggaatgaagttttgatacatgctaccacatggatgaaccttaaaaataaatgaaacaaataaataagtgaaataaatcacacacaaaaggagaagtattgtgattccacttacatgaggattctagactcagaaaattcatagggaaattaaatagaaaagtagttatcagggactgggagcacaggtgaatgcggagttattatttaagaattatagagtgtttggaatgatgaaaaaattctggaagtggatagttgtaatggttgcacaccactgtgaatgttctttttttagctttttattttaggtccagaggtacatgtgcaggtttgttatacagggggtttggtgtacagattatttcatcatccatataataagcattgtttgataggtagtttcttgatcctcaccctcctcccaccttccaccctcacgtaggtcccagtgtctgttgttcccttctttgtgtctgtaatgtactcagtgttcagcccccacttgtaagtaagaacatgctgaatttgattttctgttcctctgttagttttcttaggataatggcctccagctccatcgatgttgctgcaaaggacatgacctcattctcttttggggcttaatatcactaaattatatgcttaaaatgcttattttatatattaataataaattttattatttatattttagcattatataaaaaaagaattcctggatgaccacatatcaaggtactgtacagggctcctatattgggggcaggctggcctggctgttttaggtcgcttttttgtctatggactgtgatttaaacatatccttataacatgaattctccatcaacaccaccaccaccataagaataatctttcttatactgtctttactcttgtaaaagaagaaaacagattcagagcgtctgtgatgaacatctctggctccagagaaggtacattttgaaccaagtgggaatgtcagggttagagagcaccaagttcaatgtaatggttcatttgtggcatgccaattaggagttagaaatagcttaactttaaactaggagtgacgagcaaaatttaagcatagaagaagctttttaaattaggcagaactgtccattgaactaaaagtaagtccagtaatgacaattaaaataaattccaaaccacttctgcaaaattcatgttaggtccttgggttgcctctgacaccctcaagcaatcctgtcaaccacaactggacagctttcatctggctgaagagctgtccactccactaaattggttcgttgacagctattcttatgagaaattttactttctcttcttttttgctttctccgtgatcttttgatccattaataaactccacaaacttgtgggctggttttgccattttctctgctcttcatgaaagaaaatataaagacacaaattctgggtaaatttccacataggttagtatatgtgaaaatggactgtgaatgataaagtatgataaataagtgattattgttattaataatgatagagacaatagcaaaggaaatcttaggttatactttgtcacacacacacacacacacacacactctctctctctctctcatactttctggagagtcaagaacattttttgttgttatttatttatttatttttgagacagagtcttgccctgtcccccaagctggagtgcagtggcacaatctcagctcactgcaacctctgcctcctgggttcaagtgattctcctgcctcagcctcccaagtagctgggattacaggcacctgccaccacacccagctaatttttgtatttttagtagggacagggtttcgccatgtgggtcaggctggtcttaaactcctgacctcaggtgatctgcccgcctcggcctcccaacttgctgggattacaggcatgagccaccacgcccagactttattgttattttttgtgggcttttgcactggttttgttcataaacagctgtatgacttcaaaaaattcacttgacttttctgagcctcagtttcttcatggatcaattgagaaagttagattaaatttcttattcatcaaatatgtattgagtgccaactatataccaaggactgtgctgagtactagattcaatagtaaagaaaatggacaaatttcctgacctcatggggttcatagtatggatggaaacagacataagcaaatgcacaattaaataaataaatacagtttgtgatcagttcttcccagttccatttcccaaatgttaatatttatattaatccactgaggatcttgataaaacgcagattctgattttttttaggctgaggcagggtctgggattctgcagttctcacagacccctaggcattgctgatgctgctggttcctgagtcacaggtggagtagcaaagtataaaaggtgtaaacatgacattatgatagaaaacacgctggcttagagagaagtgtgaggtggttgggaaacactggaggtgacagtcaactgagttctgatgtatgcagagaatttggaagtcagaggaaccaggataagtgcattgcattcaaagggaagagcaactgcaaaagccctgagacagaaaagatttttcatgttcactatcacaggggaaatgagcaagggactgagcatctgagatgagctcagacaagtagtcggaagccagaccctgagggcttttttgtgctctagggagaagtttatgttctattggaagatcaatgagaagacacagaagtgatgtaagcagagtaatgacatgggggcaggggtgataatatgccaggggtttctgcaggagtccaggtaaaagaagatggtagttaaaagtagcatggtggctggggagatggagagaagtgggtggaataaaggttttttggggagtaaagagatagataacaaaaatagattccatgagtgagtgggaagaagcacaaataaacgccatattttagaattgcatatctgaataaatgttggtacaatttaatgagatgggtgaaacacattaagtgtgagatacctataggacattcgagtgaagacgtcaagtaggcaattggatgtatgtgtgtctggagctcagagggatgactgggcaggagatacatgcttggaattgccagcacttctatgggatttagagaactgaggaaggatgtgatcacccaagaagagggtcagggtcttgatgaacagcagtactgagatgtgcagtagagaaggtagaaccagcagaggagactgtgaaagactatccaggatgttctggggacatcagatgagagcggtattttggaagccaagaggaacatttcaagtgaatatatgtatgtataatacatatatataatatattatataatatatatattaggaatatataaatatatatattcttgatacttccctggaactacttcaagatcactcctaagaatgacaggaagcaaggaggcagggaaactagagtactttttctctttatatttttatgtatcgaactttgcaataaaattatgttagaccagagggctccaccattgcaccaatgatctccgcagtaagtgtctcctctcccacctgttaggagtgtcatgtacacaagaaatattcttgaaaatatacacagcacatccacaaaagatcccatactccctatctaagtatttttttcacccttcctgcccagccctgcacagtcttttgcaaaggaattacatttaaattaaagaaaataatgtttcattttcttaccaatcaacagttaggagaagagtacaagggcattctgacttacaagagagcctgtctaaaattgaattatttttttctagtgagaattttattaaccttaaatataaggtccctgttggtttctatactgataagagaatgaatattaaccaagagggccttaacgttccactcagcttgattaaactttagacagccttcttcctgactccaggctctgaactcccttttcttagagcatttactttagaaaatttgtaattgcaaattctttctctaacactttgagatgtaaatgaaagatactcaccagttttacaagctaggactgccattctcaagaacttttcctttccctttgaaaggaaatcatcaagaaatatagtgctcctatctctcagtctgtaggatcgaacagcctaacttaggtggacaccttgctccaagttgtaaaaccgtcccttgtcgtgaagatatgagaaagtttacttatcctttgggtaaggctaattaggtagcacattaggtaatcccttccccccactctatttcttaaaaaccctcctgtcctttgttgtagtgaagttgaagtcagattgcattctggtctctctccctattgccatagccttggaaaagaaaaaagtcatctttacctgcttaacttcatccagtgcaatttttgttttgacagtatacatcatttattacaagtacagatgttcctagacttatgatggggttacctcccagtaaacccattgtaagttgaacacattgtaaatggaaaatgcatttaatgcacctaacctatagaacattgtaacagcctagcctaccttaaatgtgctcagaaagcttacatgggcctagagttgggcaaagtcatctggcagcagactactctgtagagcgtaggttgtttaccttcgtgatcacctgactgattgagagttggagctcactgctgctgccaggctaggtaagatggtatcatacagcatattgctatcctgggaaaagatcaaaattcaatattggaaatacagtttccactgaatgcatattgcttttacaccatggtaaagtaaaaaattcttaagtcaaaccatcatgtcggggaccatctgtaattgtatgtgtgtggcttcttcattacctttattactggccatgaacaaaatctgagtttaacatataggagcgataaactcagataataatcacattgctaatatgacttatgtaaattgatttttcaaatacttctttatttaaaatagaaataacagaatccatgagtatgttgtttttccttataacaaataacctgagcaatactatgtaattgttttaaagtatatatcatttcctttaaatatatgcactctttccccctaggtttcttgagagactaaacatacaaatggacaatggccagaccatgtgtaacaataaaactccgatggacaatctctggcagccagcccagaacgatcaggacttgttcaatgactgcgagctagcttcccccttttttaaccctcttacctgcttccaactcaagactaacaacagaatgccaaagacactgctccccaaagcaattacgtaagatgcctcactgcttgttagtgcacctcctgcttcaatgtgccaacaacctccaatcagaagatagcagaagccttcttttccccgcttataaagcttttttactcccctgcctgtctttgagactttgctaaattccaaggatggtggctgatcctcttgctttatcatgctctgaataaattgcttgtttgttctcatctgtgtggtcttcatttgtttccatattctaggtgtgttctagatgttacacttatttgaaatcctatattttgacttaagtggaaatcctttctgaggaagaaaatatttcttatgatttggcttatattactttgggttcttgtactaagttctcaggtctcccagttaacgttttttcttttcttttttcttttttacggaaagctttttttttaaaaaaaaaaaaaaaaaaaagaggaggattaaataagatagtttgcatagccttattccataatatgaagcatcagagcagtggtgcttcaaaatcaccagcaaacactaggatcatctggagggctgggttaaaacacagactgctgaacccacccacactttctaacttagtgcatcttgggtgaagaccaaaattttacatttttagcaagttcccaggtaatgctgatgtcgatgctggtcttgggaccatactttgaggaccactgacctagaaccttacaagggatgcccttaatcttaacctccattctgcctttgcaaattattttcttctgcttctcactttgaaatgtcttccttggaagtgggttgattttgacattgatgtactgaacacctaccatatggcaaacaatgcacctggaagatttttcatgttggcgaattcaatcttcataattatcattatcatgtgatgtaatatcatgatgcccccttttcagaagaggctggagctcagcatggttaagagacgtaatattttgtaactattaagtggtgaagctgggatttaaacccacatatttttattgcaagtccagtatttctcctactaaattttaaacatgcttacttagaagtgaatatatttcctttaaaaaaacacatgctaaaattttgctttttgtctagaaacttaagactcaaaatactgatgatgacagcttaatatgtgttgtaaaatgtgctggctatagaaaatggtaggagaaaaaaggaataaaccttgtaggatggaaattatatataatggagtttttatgtaattctaaaataattttatttgattttttttgaaaaccctatagacaaggacacgagggcagggaggtggttggtgcacagctggtgaaggttaggtagttttgaactgcaaacatgcagagtaaaattcttgaggcaaaatcttaatagacttttcaagaacctcaaatatcacacatactgggcatgaaacaaacttcaaagcccaaagaggatctctctgtacagagtataatggagttaaaagctgtaaggaatacaaaggatttcaggatgaaagacactgttttctgaggccatgcctgaatgtaaagccaaggcaggatagataggcaaggtgagatctacatctggagagatacccactgctgcacagcatgttaatcattaaggattcaattcttcttggaaatgaaatgccaaataatagtgctagtcaattagacctcagaggtggtctctctttaagaaaacccattttccaaaagtggaactgagtcaacagctacagagatagatttcttttctttacaagatcattttttctttatatgtgcacagtctagcgtctctggtttgtgttgaaaacattttttttttttttacacacacttgttaaggaatacactcaccaggcacagaaatgtcttcctttggggtaaaacacatgacatgttttcaatattcggctgatcatttcctcaaaattattcctgtgattatgagaaattcagcacagggaaaaaatgtggaccacatatgccctctccactttggtaaatcatttaccctaagcataagcactcaaggaaaagtggactttcccatactctgatagtaacctgctctccattcctttgcaacagatggcctctgtcactaggcccaattgccagtggatacagctctccatattttgccaggatcttggtttgctgttgccaagtactatggtttctcttcttacttctgcctctgataatgcaaaaaatcctttgcccaaaggagagatgaaacagctcaattttatgctgttgcaggagtagtcaaacaatggccattgggccgaatccagcctgctgtctgtttttgtaaataaagtcctagtggaacacagccacactcaatcatttatgtagttcctctagctgagtttacactacaaaagtagagctgagtaattacgagagagatttcatggcccgaagagaaactttactccctttatgaccctttatgaaaaagtgtcatgacccctgctcttttgtaaccagagatgtttggtctaaagaagaacatggcattaagacacaaagacctataagagcctaaaaggagcctatttactgggagtcattcattcctctggattctttcactaagtggaaagcaacacccttccggttgaccacgccagaaactgagcatcttgctcatttttttcttctcctttacctaggtcattatctactctgaggatctcttaaatcccttcacttctctccaatctgctgtcaataccctaggagagggcttcctttcatcttctcctagactatcacaaccacttttatcccactaactactttgtctttgtcttcaaattcttagtatatgagacagcttaaatttaacatgttcaaaattgaactcctgatttccctaacctcaaacctgcttcccatatgaatacatagcaaatctatttctccagttgctcaggttaaaaatttggaagccacttttaccaggtctctacctcttctacctccagtacatcagcaaatcctgatagctctaacttcataacgtttcctgatcccaaccctttaccagccattcaatgtcataccattctagttcctactacatcatgcttcacttggtgactgcaaagtcctctcaactggcatccctgcttccatcatttctcacatacaatccactcttcacccactagacagaatgagctttgaaaaatattgagattggaacatatcacttccatactcactgcccttaagatggcttgtcatctcactaggagtaaacccagaaccctcaccatgacctatgtaaatttacaaagctggccactggctgcttccatcatctcaactctcaccactctctctttcccaggctgctcccgctaaggagacttcctgacttccacactgttcccagatggtgccaatcatgcatccacctccaccatccacctctcacctgatgctaccaccatctggatctctccattcaagtgaccagagaagctcacccttcacttcattcaggtgtctgctcagattcatctctgcagagaggacttatttaaaaaagaacctcccctcactctctattctcttgacttgcattattgattttcacagctgttaccttttacgctcccacacacactagaataacttgaatgtaaaatcactgaaagcaagaacttgggctgttatattcactgaagtattttccagcacctttttggtactgttttacagtacctagcacatagtagtgctgtgaaagtacagttggttctctgtatctgtgggttccacatccgtagattcaaccaactgtgaatcataaatattctttaaaaaatagtgcctgtattgagcatgtacagactttttcttgtcattattacgtaaacaatagatataacaactatttgcatagtatttaccattgcattaggtattgttaagtaaccttgttgaagtatatgagaggatatgcttaagttaaatgcaaatactacatcattctatatcaggtacttgaacatccttagactttggtaccccaaagaggtcctgggacaaatcccctatggataccaagggacaaatgtatctgtggaatgaatgactgactgaatgaatgaatgaatgagctacttcttaattagttattctgccttggcaattactctttcccaacactctcaacactgaagtcaagatatgttcttcccccaaaagaaattagctaatttctccctcttgttcaaaatcttataatgtcttcccattgcaattttgatacaatagcacatcttgacctggtttaaactggtccctacttacctctctagctttatttctgacactgttccataaccaacactaaatgaagtgcccaaattctcactcagtgagatgaggcacgcttgttaaactccttcctctccttcccattctttacctggcaagctctcgcatgtccttcagcactcagcttaaacatcttattgtctgggaagccatcctgacctcaatattgtccctgtcgtatatgcttccattgtaccctataattatatatcatagcttttatcaccctatatttaattgttatttaaagatctgtgcctcccaaccacactaacttactgattttggtatcaacagtgcctagtataacaaatatatgttagacaagtaaactgatatacaaggtagcccttgcttgaaagaagtttaaagtagtgatcaacacaaagggatttcccccttcattcagctcaatagttctgttaatcctgtctctaaaccactcccccagacaagtgcatttgggccaccaatcctcgctttgaattacaagttatagctgttaacatcacatacaaaccactaaagagttaacaagtttctccagagaatatcagaagcctttcccacattgtactctttaggctaataatacttttaagtctattttctagtcatgtcctgggcaccgaagttgttataaagattaataaatttggcccgatgtggtggctcacgcctgtaatcccagcactttgggaggccgaggtgggtggatcataaggtcaggagttcgagaccagcctggccagtatggtgaaaccctgtctctgctaaaaatacaaaaattagccaggcatggtggcaggcacctataataccagctactcgggaggttgaggcaggagaatcacttgaacccaggaggcagaggttgcagtaagccaatatcacaccactgcactccagcctgggcaacagagtgagactccatctaaaaaaaaaaaaaaaaaagattaataaatctaaatctaaaacacttacaatgttgtttggcatgtagtgtctgttatcttaatcctagctattaatattcatcttttctgttcatttcaaatagacacaaatgacattaacactggtcctggtcttctagctcacaatgtagcaagaaactaagcctgatcaatgactgatcattatgagagcatgttgtaatttcaacagctgggggctgttgaaacgacaactataaatagcggccagagaaaagagataatgagtaagaatacactggagtttttccagacacaactggtagaaaacacaatttaatatagcagagaagaaataaaggtgctgaaactcataggagtggagatggggtttagaaggtggtaaacgaatgtgaggggcaagaatttgggaggatttgaggctggcataatcataagagaagcagggagtatccagtatcttgatgggcataaggattttgaaaagaaaggctctgcattctattccacaaccaacatgtatacactcacacctacacgccctgccatgcacccaacatataagagaagatgagggagtgaaggtgatgggagaggcaggtggagaataatggtggggttgcccaaagatagacagactgaagttcagattctctacctggattagaccctctatccactacttctcctcctgcacctggttactagtcatctctagagccaaagacagaatcatgtaaaggaggctcatttggaaaagctggctgtggcattccaacctggcaaatctaagaactgtattgcagtacttgtcaatgcatatccagatgatgcttgtgacaaatgttaaaaaagccttaaaaacattcatgctccaaaaattccaaaagaaataaatccttatagctgttcataaagatttctgtacattattactcacaaccatgttgttcataactggagaacatgaaacatctaaatgtctatatttgggtattggttacataaacaatttattaatacacagccattgaaattcaggtttaaaatatttaatgacaagggacatttctcctaaataccatccaaagttaaaagcaggtataaaacagtaaagcacaagctcaacctttgtaaaaatatgtatttatatatgggtccagatactatagtgaaagattaatttgtgaccttttttaaaaaattacaaaaatactagaagaaatgagtggttaccttcttcctccatctcaagaaaataactaagatttgtataactacaagctttgaagactccagtgtcaagcttgacagggaagcaacagagcctcttgccttcaagggatctgtggacgtggtggtgaccaggacaaagtgaaaagcaaaaggtccagcttaacggagaaagaggaagaggtccacaaaatgtctgagattgaatttaccattgagacccagcttgaggagctcacagaaaagttaactaatttagagattaaaagaaatttggcatttcgtacatctgaatgttgtagagtaacactgaaatgcaaatctggtatatgtatgtgatacacatacacatacatgcttacatatacaaacatatatatgtacaggtaaatgatacatacatggtacctaatatttatacgtatgacatacctgtatttattacatatgactccatatattaatattatctatatccaaaatggttatctctaggtgatattaatctaaaaaaatttgaattatttcttcatttttttttttactttttcccagtatttcccatcaaatgtgtattacattgctaatccacaaaaaattgtgttttttttcaaaatgcattgcctatgtctggttttgctcataacagtgccttaataattatatgaaatccgcacgtattgttcctctcaccagttattaaacttactaattggcgtacttcattttaagaagtttttaattgcaaatgtagctataaactgtggtgtggtgcttaatagatgaaattttcttagtttttgcccatccacctgaagctgctacaaagaaagaataacttcaataattttttttaaacaaagttctctccccttctgtggatgttttggagcttacaactttgtcctgaatctaaccacttctcatcagtggtgccactaatattagtgcaagccactattatctctaacttacttcttacaagtttatttcttgcaataaaatcttgtcttcaatttcctgcccttatagtctatgtgctacacaaaatctagagttatacctctgaaatcaaaggcagacaatgtatgttttccactcaaaattattcaatggcttcccagctcatgcagaatatcccaagtttctaccgagacttggtagaatataccaggatataaggaacctggtaccagctgcccctttgatctcgatttccaccagttcttctcctccctctgctccaggcacaaacacctcctctgtatttctccaatatgtcaagtgcgctctgacctgtgcgcctgttgtgttttcttcctagaatattcacttccaaatatccactaggttccctttttgtcttcacttaggtctctgctcaaaggtgtccccatcaaagagcattttcctgactattctaatgaatgtagcatactttgtcattctcagattcactatgctgctgtatttttcctgatggtatgtatctaacatattgtatatttctttgttttctagtgtctattaactgtctcccaccaatagataagtgccacgaaagcagaggctttgtcagttttcttggcccataataggtacttaacagatacaagttaagcactgaatggtgccactgaagactatgttggaaatacggttgtatcacctactactacaacatgtgattatttatccactttatccaaagtcctgccttcagatacttcaatcttctactgcaaatgaaatactctatcttttcctcaagacgttatatatgttacatccaatagagaccataagtctgtcctctccagttccattatttgtttgttttgttttcagaactcagttgaattgtttctattttaaagtttagggtttttggccacactaatccccattttttgttcttacataagcattgcaattttcattttttacactgattatttctagtttagattaccttatccctttagagaatttttttaaagtatacatagggtctgataattaattaacctataaatcaatcaactaacgaaccaatcaatatttattacttatttaccatgcttggccatggagctatagttgacagggagacagataaggtccctgtcctcatagagcaagtggtaatgaattacatattgtagaatcactcttctttttacaaattgtccatgagcttaactaaagacacacacatttataagtagccaggaaattgtaacttcaaacaataagatacaatttccaccagtcagactcaaaaaacaccaaattgccaatcttttgaattgacaagggtgtgctgaaagcatactctcaggactggttatgggaggacacattagtaaagctttttggatgctaatttggcagtatgttcgaaatttttgaatgcacatttttaacatatctattctagggaaatgccccaacacttgcttaggtgtccagagatgcatgtagaaggttgtgtgttgctatagttttttgtaaaactgaacacttggaaatggtacaaaacttcacaaatctattagtgattaattacatcatggcacactgatacccttaaaaaatactatgcaggtgttaaaaagaatgagaagggatccatatacatataataaaaagtatacagccatgcataaacaatgaaaccagggaagtagttgtagggtcaagacagacagaagagttttttttttttatcagaaggagatctgattttcatcaggaatatatctgatcagcagagagttcagtcatatttgtaatattttatatcttaagctgggtcatggacacacaggtgttcttttatgttttttctcagtaccttttgttatatctaaaatagagccattaacacaggaacagaaaaccaaatacggcatgttctcacttataagtgggaactgaacaatgagaacacatggagacagggagaggagcaacacagactggagcctgtttgggggacggggagaaggggagtatcaggaaaaatagccaatgcatgtgaggcttaatgcctatgtgatgagttgataggtgcagcaaaccaccatggcacatgtttacctatgtaacaaatctgcatgtcctgtgcatgtatcctggaacttaaaataattttttaaatgactttttaaattaaaaaaatcttattttaaatacattttattattttattgtatgtatattatatttatcttatttattattttattgtacagaagttgtgctatacttacaataaaataatataatgtatccaaaacatgagtagattaaaaaattatacatcaatatacattatatgatatcataggagtttgaataaaataaaaactgagaagaagagggagacagaaatgcatatgtatgcatacatatacacatatttaatataagtagatccagaggtcatggccataagaatgcacacccaattgttaatcataaatattttgggcagggtattgaagatgatgggagacttcttcattcagaatattactagaactttaaactacatgaatttgtatgcttatgggttacttgtttaactgaagaataaggaaagacttttccctcacctgtgaatcccatcttttgcactctggccaacacctaagtcttctcactttgcactagaaggataatgtactgctcttgccaaataggtcatacacaagagtattaatttctccaagcagctgggtgtgagcccagctccaagcagaaaacaaacaaactctctgactcaaaaagaggcttggccaaggaatgtcaggttagatataggcatatgtttgtccatttgttcattcaaccattccttcaccaacttaatcatatctagatgcactcaacagagtatttgatagtccactctatttcaggcactgagaagaggaagcaggcagtcccttccctcagggagctcagaggctactgaaggagacagacatgaatccaataactgcatatacataaaattacagctatggtggatattataaagggaggtacacaaggtaacattgaccctgatgggagaacagaaaacactttcttgaggagatgataattgagctgcaacttaaagaggaatagaagttgacagaaaaaaggcagaaaacactggggactgaggctggaaagtgcagccgtgagagctacataacttcgtccagcaactgaaaggagacaaagatcactggagtgcagagaatgaggggatgcctcatgtcagatgcggccagcaagggtcacacatcaggagggggttggaagttgtactaagtatttatgtattatcattaattcggtgattgttttaagaaggttggcactgggggtgacatgattagatttgcattttgacctatctggtgtataaaagagaagggacaagagtattttttgtgttgtttatgtgtgtgtgggtttttgtttttgtttttgttttattttgtttagggtggtcttagtaatttaaaaatattttccttgtatcgataccagtcaacctatctagaacctagttattggtggaagtggcaccatctcctaggggatgtttgagatatctttgggatactgggttgtagttatgattggggagcacaacacaaatctagaggaaggacaggtttcacattacaacatgagggacaatccctcataagaaaattatcattctacaggccacattctccatgattctagaacatcctaccagccacttgtgtaagtgaaaaatttgtttgtaattatctaatctagaacataactccttttacttataaataaaaagaatcttgcatggtaatttccatacactgaataaagggaagggtatgctttcatttggttcagaacaaatattcaccctgtcacctacatacaacatgtctgcgttagactttgttggtagttgtcgtgtccatggtggtgacttaatgtacaaatgcacatatctgactgctttattatgttctgttgtagatgagcctagcatttatacaatgaaatgtatgttattttaccaaaattactctccttttattgcttctttgtatttcagttaagacattatattgataattgttcattgtgtatagatacgttagattactcgtggatttcatttcagtattgtaaaggggtattacaagctatttgtttttaaaaagagagtagcagttgatctggggtgattgagaattactggcctagaaaaatatgactttcaagagctaggctgtttcgatagacaagacacacttcaggtgtcttgtctaaatgaatgcactggagtgttcctgatttatcagtactggatgcatgcagttaaagaagctcagagaatgtcaaaggttggagagagcagcacaggggcagaggtggcacactagttccctatcaagaaaattagaaagatctgctccagcttcaagcttttctcaaagtcctgaaggatttttaacacatcttccataaaaagctgtaatttattatctcatgaatatctaatttgacaatatttgcaaatcaagtttgtggaattttggtgtgttcatttgagtgtgtgttttgttctttctcaaaataattcttaaggtagaaatgtttctatgtgctagaaatgctgagataaaaaaattaattttgtggttagcttgaaaataaatggtgggctctaatatgcaacgtaatgtaatataatataataagggtatccccttagggttgactgtggcagctttccaagattttaggccttgtcagtttctctgctttgataataatggaataaagaacagttattctcattatctgagtgctactatatgccagaaagagtcatatctgttttttatgcattggctgatttttatcgtcacaacagcctatggttatagatattatgactatatccaatttacagatgaagcaactgaggctcagagacttgaactgatgtgcccaaggtcacatggctggtagatagtccagaacaggatatcttaatccctatgatagacaaatgtaataatattttaatttaatcaccagtggcataattatgaagataatctaacagtaaaatacataatatggaatacagatgaatagaaatgtttgcctcttaaaaaaagtctgataactcctttgagaaccaagcctgctctccttcaatgagcttgtgctctgtacttcctcagttactcactccaatgttcagtccatgagttcgtcattaccaatagttgtaactcccaacaatttcagtttaaaatatctcattcttaaaccatcatttcctgtctctagaacccttttctttagtactcttgactccagtaattctttgaccatctcaggatattcaacctattgattctaacatgttttcactgtccctcaccctcctcatgtcagaacatgacaggccacaggcaggctatggattctaaaagatatcgtgaatgctaaaagtgctggaagattaaggataccctgagaattgtcatggataatgataatccagtgatactaaaacatatctagacaattaaccagaataatgaaggtttagaattattccctgtggcacaggtagagcagctgaggaaatggagatctcattcgagagaccaaacagctcagaggttctggagcagctaattccaatctctgaacactgtcatgcagttctaaagagtgtggctggatcctagtcagggaagatactggaaggtagagttcagctcaaactaagagaaaatgaaaggtacttttcttctcatactacaactacaattcaattgtatagctgaaatgctgtattgagaaggtttctgagaatgggttctcagtcaccattgtctcagtcagattgggttagattatactctgggaacaaagaactcttaatcctcagtaatgtaaaacagcaaaggtttatttttcactcactgtacatgtctgtgtgcattgtcaggaggctctgctcatctcattccctctgtgatccagaaagatggagtggtcaccatctcaaatgttcccattttacatgctagagggaaatagaacgtggggggttaaagtgtgtgtgtcacaaactgataatgaaatgttccagcctggaagtgacttatattatatctactcaaaaactcattggccagaactagtcagaaagactcacccaactataaggaggatggggagtgcaaatctacaatgaacaacataatgagcaccagaagcagtggcatgagcagtggttgacctcctgggtctagacaaggcattctagcatttgtcttgctactcctcatccctgccctaatcaccagagctgccctgcaaagccttacaatgtagtgagctccctaacaccagagtgttgcaagcaaaagttaaaggagtgcaggttaatgacaccatagaggctattcctttatctagtagactaatggtctacctggatctacacgagtctcttaccactctgaaataaacagaactaggaattatggaatactttgctaagtgtaccagatatttggagaaaaattaccagttctcaggccagctaaacaaccaagcaatggggtgaattttgctcatttaaaacggagagaaacataggctgaccattatagtcccatcattgctccttttcccgcaggagggcaaagcacattaactctctccccagcaagagacaatgatcagaagaatcaacataaagtgagggaaaggatttttattgaaaaagctgctatagcaaagtttgtggtgctaaatatttctttataaaaaccagcacttgactatcagcctccctattcagctacagacaggacagcaaatggttgggtgagaaaatgcactgctattcacccaagactgttaggctaatcagcaatggaaaaaacatctgaaaacacctgataaaagggcaaatatgctgtaaggctctcgcgcgctctctctctctctctctcactcacacacacacgtgacagattttaaaaatcaacatctgaatgcagccttcagttgtcaaaagctttctttatgattcctatttaatccacaaaattcagggaggttagaattactattataaatgatattttcagataaataaattcagattcaaaaagattaatttgattcactttgtgtccaagtgggtctacatctgtagtacacaggaaagcaccttgaatggatgtgtgacaaaaactgacttcttaatctttcaaagctgacctcatcacaccaccactacttgctggggctggtgacagaacgtcgggcttgagggaccacagttcctgtaatatacggtgcttcttacatgctcagggaaatcatttatcattgacattctacagtaagtgaaatttccacccaccacagaattcattttatttttcatattgtcaaatgacataaaataattttctctggtttctgctgctaaaatgtccttatagtggagcttataataacccaagaggaagcaagcatgataggataactaatgagttttccacataagagtcaacctctaaacacactagaaaatcagccaaaccagctggagataaaatggctgaatggctgattgaatcatgtattcctcactggtccagttgagaagggcttctgggtacatctcctttttactttctgcctgcctttacctcttttctccccaagttaaaatcattagaggctcttctcaacctccaattttgaggctagtgtaatccttaatagaaggagaggtaagcatcccctgatcaattacaagaggtctatacctcaacacggccttcctgtgacgccagttaccctgtccaaacactgaagttgcacattggctcagaaactggattcctttctttttctgttccttatttctttctgctcaccccctcccttctccctttctttctttttaattaaatgagtaaaacatgaacacattcttattgttaacaaaattggattaggaataattactgtctggcatggccatgtgttgacagagatctggaaccattatgaactgctgtgggagcatcaccacattgacagaattttggtactacctagtaaagtagagatgtatacacctgctacccactcctaggcacagaacctaaagaaactcacacatgtacccaagatgacattattatttatggactcattttctataattgcaaaacactggaaattatctaaatattcattaatagaataatcaaaaaataaactatagtcataaaattgactgctacataggagtaaaaaagtttaaataaactaaacatatcaatattgatacatttcgcacatataatgagtttctgaaaagcaagcattctccttgaaaaccggcccaagacaaggatgccttgtctcaccactcccatgcaacataatattggaagtcctagccagagcaatcaggcaagacaaagaaataaagaacatccaaataggaagagagaaagtcaaactatctctatttgtagacaacatgattctatatctagaaaaccccacagtctcagcccaacagctccttcagctgatcaacaacttcagcaaagtttcaggatacaaaatcaatgtaaaaaatcgcgccactgcactccagcctgggcgacagagcgagactccgtctcaaaaaaaaaaaaaaaaaaaaaaacaaaatcaatgtaaaaaatcattaacattcctatataccaacaacagccacgccgagagccaaatcagaaaggctatttcattcacaattgccacaaaaagaataaaataccaggaatattacttaccatggaagtgaaagatctctgcaatgagaattacaaaacacttctcaaagaaatcagagaaggcgtaacaaatgaaaaaacatcccatgtgcgtggatagaaaaaaatcaatataaaaatggctatactgtccaaagcagtttacagattcaatgctctttctatcaaactcccaatgatattcttcacagaactagaaaaaaactattttaaaatttatatggaaccaataaagagctctaatagccaaggcaatcctaagcaaaaaacaacgaagctgaaggcatcatgttacctgacttcaaactccactacagggctacagtaaccaaaacagcatgatactggtacaaaaacaggcacctagaccaatggaatagaatagagagccctgaaataaggctgcacatctgtgaccatctgatctttgacaaagctgacaaaaataagcaatggggaaaagactccctattcaataaagggtgctgggatcactagctagccatatgcagaagattgaagctggactgctttcttgtaccacatacaaaaatcagctcaagatggattagaggcttaaatgtaaaacccaaaactataacaaacatggaagacaagctaggcaataccatcctggacaaaggaatgggcaaagatttcatgacaaagaccaaaagcaaacacaacaaaagcaaaaattgacaactgggatctaattaaacttaagagcttctgcacaacaatgacaaaaaactatcaacagagtaaacagacaacctacagaatgggagaaaataatttgcaaactatgtatctgacagaggtccaatatccaacatttaaaaggaacttaaatttacaagagaaaaacaaccctattaaaaagtgggcaaaggacagggccatccattttccaaaaaaagacatacatgttgccaacatgcatatggaaaagaagctcaatatcactgaccattagggaaatgcaaattaaaaccacaatgatatactatctcacatcagtcacaatggctattagtaaaaaatcaaaaaataacagaggctggtgaggttgcagagaaaggggaacacttgtgcactgttggtgggagtgtaaattagttcaaccattgtggaaagcagtatagtgattccgcaaagagctaaaagcagaactaccattcgacccagcaatcccattactgagtatatgcccaggcgaatataaatcattctaccataaagacacatgcacacgaatgttcattgcagcaccattcataatagcaaagacatggaatcaacctaaatgcccatcaatgacagactggataaagaaaatgtggtacatatacaccatagaatactatgcagcctatataaataataagatcacgtcttttgcaggaaaatggatggagctggaggctattatactcagcaaactaacccagcaacagaaaaccaaatactgcctgttcttacttacaagtgagagctaaatgatgagaacttatgaacacaaagaaggaaacaaaagacactggggtctacttgagggtggagggtgagaggagggaggagagcagaaaagataactattgggtgctgggtttaatttctgggtgatgaaataatctgtacaacaaactcccatgacatgagtttacctatgtaacaaaccttcacatgtacccctgaacctaaaataaaagttaaaaaaagtaaatacgtaaaataaaaaggcaagttgtcaaatgatatatgaagtatgttatttatataaaatatgaaatataaaatatactaaatatcattttgtaatacatgcttaatgtactaaaaagtattaagcaaatgcaacagaatgataagactacaaattctgggagacaattacctctgtgaggcgaagtgaggggatgcacacaaggaggggtaaactgtatttgtcgtgctttgtttcctaaactggatgatgcagatttgttctgttgtgcagtgttattttcttagtctgaactattttgcaataaattataaacactctaggaaaaaaaattcaaatatttcagtaaacttaaacctcattttgaccaccacccagcacctagtcctaggcatcctgaagagttatctactgttagttattagttcttttccactcaatataaatagcattgtttgaacaaaggtatctctttcctttttatataaacgataatctaacatgcatactttcaatgaacatcatgtcttaaccatataaatgcacttccctcttcaacaataacgaattttcctggaacttaagcattttctttttgaggcagacggtataatcgctaaaagcacagtctttagagacaaactgcctgaattcttcaaatcctggagtcaatacaatatttacccagggcaagttattttctgtgcttcgggtgtcttatctataaaactgataatcacaatacctacgtcttaggattgtttgaggattccatgagtaaagtcatgtaaaacactcagagaagtggctggaacatagtaaggccttgataaatattatttgtagctacagtctttgctataacatattggaaagggcccttacaatggtgtccttacaccaagtccaacttatggctactctagaaaaatcaggatgttcttttgcccacttctcctaattatgctgagctttggaaatcagtcatccttcagaaactctatagaacctgtagcaatgcccagtcttttgatttctgcacactaagttctatttgtccaaattccaggcattgttttcttataggagaatttcttcaagtcactcatagctgtcagtttctgccaatttaatttggcaattaaggaactgtacataagtgtttatatgtcaccgttctttctttaagttgagcctgggggcacagccaatgtttcttttttcacattcatgctaataatacgttggttgagttgcacatagcatatgtaaatttttggcaatttatttttctcatagttctcagagtttgcttcaaatttatcacatcatctacgttatacttgcagttagtctacttctcacctaatatcaaattttggatttgcgtaattccctacgttaagagagattaaaaacaaaaattttagagtcagccagacctgagttcaaatcctagctctgccatgggttaggcatgtggcccaagtaaacatattagttttctatagatagataacaatttactgcaaagttagcagtttaatataacacccattcattatctcacagtctgggcatggtgactggattctctgctcaactctaaaattaagatgtaggtagggatcactgctgatctcatctggagctcaggattcccttttcagctcacatgattgtgggcataattcactgtcttgcagttgtaggactaaagaccccattctcttgctgctgtcagctgaggtaacttgcagctccagcagcagcccacattccttgacacatggtctcctccatcttcaaagccagcaagagatttttcccacatatcaaatcactctcaaattcacatcgctgatttctgcatctctttcctctggactcagatttaaagggctcatctgattgggtctggcctacctggataattttcctattttaaggtcagctgattttggaaccttaatattacaagccaaattcctttacatcagtacctaggtgagtgttttattgaataccaaggagaaggagtatgtatgtactccagggagcaggatatcttgggggacagcttacatttttgccactcacaacaagacatattggctttgcaatcctcagctataaaatgggaacaatggtgctcactgcagagaaaaagtcaattagatacagtgaaacaaaaaaagcttccaagtactgattatgctcaggattaggctgcctgttttcattacttcattgtcccagtaatctttttcccccagttttactgagatacaactgatatgcaaaatctctacataattaatgtatacttggtgagtttgaacatgtttacactcatgtcgccatcactataatccaggaaataaatgtatccatcatgccaaaattccccctttttactctaatgagagctatcctattaaccaatgagtaagtgcactgtatcttattgttaactgcaggcactattttgtacagacctctagaacttactcatcttgtataactaacattatatctattgaataacaactcccttggtaaccatcattttattatctacttctatacctttgactgttttagatgcctcatttaaaacgaaacatacaatatttgtctttccgtgaccgacttatgtcgcttaacataatgtcttccaggtttatacatgttgccacaaatgttaggtttttcttctttttcaaggctaaataatattcaactttatgtgtttaacacattttctttgcctattcattcatctgttgatagacatttgggttattttggctactctgaatattgttgccatgaacatgggagtgcggatatctctttgagaccctgatttcaattctttgggttatatagccagaattgagattgctagatcatgtggtaattctatttttgattttttgaggaccctccatactgttttccatggcagcagtaccgttttacattttaaagggttcctgtttctccacaacctcaccaacatttgctgtctttttttttttaataatagccatcctatcaggtgtgaggtgatatctcaatgtttttgatttgcattgccctgatgattagtgatagtaagcatctcttttgtttgtcatttgtatgttttctttggagaagtgtctattcagatcttttctccatttttaaatcaggttatttgatttttttgctattgagttgtaggagttctttatatgttttggaaattaatgcattatcagaaatatggctagcaactattttctctcatttcataggtcgccttttcactctgatgtttcctttgctgttcagaagtgttttcgtttaatgtagctctacttataatttttgcttctgttgccagtttttgggtgccatatccaagaaattattactgagatcaatgacaagaagcttttcccctctgttttcttccaggcattttatggatttagatcttatgttcaaatctgtaattcattttcagttaatttttgtgtatgatgaatgacacaattttattactttggatgtggatatacagttttccccccaaaaaattattgaagagactgtccttcccttattatgtattatcagcatccttattgaagattaattgaccgtatatgtgtgggtttacttatgagcctactattctgttccattgatctatatgtctatttttatgccagtctcaaactgtgtaaattactgtagctttgtaatatattctcaaatcagaaattttggtagctccagctttgttcttactattcaaaattgtcttgactatttaaggtcttttgcagttgcatgaaaatttaagaattgttttatttataattataaaaatgtttttaagatttagctagggattacattgaatctgtaagttactgtgggtagtgtagacattttcacatagaatgtatttttgggaaaagcacacaaaatccacatttttatctaatttctttcatcagtattttataattttaagcattcaaatgagtctttcacctccttagttaggtttattcctaggtattttattctttttgatcctattgtaaatgagactgttttcttgacttttttttggatagtacattgttaaagaatagatatgcaactcactttcgtgtgttggttttgtattcttcagctatactttgtagcctgaattagtttattagttctaaccttttttatatttttagagtctttagggttttatacatataagatcatgtcattccagagtctttttttataatttcaaatttgatttaagatgcaaggggtacatgtgtgggtttgttacgtgggtatattgtgtgatgctgaggtttggggtaggattgatctcattaccctgatattgagcatattacccaatagttagtttttcaaccttgtcctccttcatccccccttcatccctccctcctctagtggtccccagtgtctattgccatcttcatgtccacaagtacccagtgtttaactgccacttagatgtgagaacatgcagttttctgttcctctgttaatttgctttggattatggcctctagcccagcagcccttttaaaatgagcccaatacagagtctcctttggtgactgatgctgattaggtctccaataattattctttatataaaagaatggtgcaattgtgaatgggagttcactcatgatttggctctctgtctgttgttggtgtataagaatacttgtgatttttgtacgttgattttgtatcctgagactttgctgaagttgcttatcagcttaaggagattttgggctgagacaacggggttttatagatatacaatcatgtcgtctgcaaacagggacaatttgacttcctcttttcctaattgaataccctttatttccttctcctgcctaattgccctggccagaacttccaacactatgttgaatagcagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctgttgagataatcatgtggtttttgtctttggttctgtttatatgctggattacatttattgatttgcatatattgaaccagccttgcatcccagggatgaagcccacttgggggaggggggagggatagcattgggagatatacctaatgctagatgatgagttagtgggtgcagcgcactagcatggcacatgtatacatatgtaactaacctgcacattgtgcacatgtaccctaaaacttaaagtataataataataataataaataaagttaatttgatattttgcagaaaaaaaaagaatgatgcaaaggctaataatactcatattttacagatgaagaaactgggacttaaagataatatctaaaagcagttatcatagttacagcctctggcaaatagaaaacactcattaatactaattgccatcatcatcatcatcatcatcatcatcatcatcatcattattatcatcattttatattaaaaagaagaaacacaaaagtgtccagtagcacctaccacacacccactcctaatctgggccatgtaaaaactgtggagatgatgagtcctttgcaaggcatttccggggagctcctgttccctgggaagctgcctggtcatttttcggctgcttttttaataccccaaggagggctgtggttgaagctctagtcctggaactgacaacaccagaatccagaatctcccagtttcttaataccaacttgatggtggaatttgcattgtctagtgcaaaatgcagcccttttaacatttacatttgatctttatcttctggttatacagattacttcatctaattttacctgttatttgttttaaagcttttcaccccatcttacccaacttttagtggagaaaggtaatactcaaaagctctctcaattcttataacagcatataaaacatttcatgctcattaaactaacacccttcattctctcattcttttcaaatgtcaatccttaagtgacataaataaggttagcaaaaccttctaagagattttagactttatctagtacaaacaccttattttactatggagaaactggagctttcccccaaaaaaggattttcttaaggtaatcagctggtggcagagccaggactagacagatggacatcaggagtccagtcacccagtgccacacaccttccaattacatgactccacttggtgcctagtttatgacctccaaagctctgcttagtgactactttcattttctctgtgtatttatatataaaaaaactcaaaggagaaattacaaagtaaaaatagctcattataacttaacagtacccctaagcaatcagacattctgtaacaattcaatggccaggctgtcctattaggtactgcagacactgataactaccttcccaatagccattctctcctacttcctaggtgacagaccccagttttgtttgggggcaccaatatgcccaactccatcaagctactctctttttcaacctccctggctgccaggagcaacaagatatagtttgggccaaggagttacaggcagaagctgagtaagcatttggggaagacttgtttttctgagtaaatgaataaagattgctggcatcacatcttcccttttcttctctttgaaccaaaattgatatctagagcaacagtagccacctggaagccatacacagagacaacaaaatggaaggctagaggtacgggtcattgatatcactggctggctgcaccagacctgaactattaattactgagtatcttttcagtaaaagaaacaataactcagaaagcaacatggtatagaacctaaaagcactgcctgggagtgacagacttgggtgtgagtcctggctagctgcctgaccttgaaaaagttacctaacttcactgaatgccagttttcccaattcacaggattgatttaaacattaaataaaagaatgcatataaaatgcttaaaatggcacattgcaagccctcagtatatggtagcctggttcaatgtaggaatctctctctgcaattatctgattattatccattgtttatccagggaatgtatgcagaattgatctcattggtcagcaaacaacatgtattacactcacaactttatatgtagattggtcatggaaggcacaaattaccaaaataaaactaatgaatattcatcaaagattgccttagaatcctagaacgctaaagctagaaagatagcttaaccttcatccaataaatatttgctgagtgccaaatatatgttcagaaccatgctagtcactgttgatatatgaatatatcattgaagtaagattcctgttctcacgggatttatcttatagtgggggcatttcctaatgtatatctaatatgaccatctcaatcacagctgaagaaactgaagcccagagatgttaaatgacttgcaggcatacctaggtcacacagcagttaatggcagatgttggagtaaaattcaagcctcttgactcctattgggttggtcttttgtctatatcctgaaattcctgatttacatttttgtataccgtcagaaagtattccttgctgtccaccaggatgactgagatagaaaatctgatccctgagtttccttcatttcctaccactctctcatttccctatgctccacgaagtatagtcttggtgtgatttcctcaaacatgtcaaacttgctccttttacaagactcttacttctggttggccttcatccctagttttatttgtatggcattcattcaccatttcagcctcagcttgagggccatttgttttgactgtcccttaaaatgtatcattatcattctctacctcactcaccatttctttcagctcatatatataaccagctgaaattaacttactaactttttttccacatgtttgttgttgggctgcatgagggcagacaccttatctgccttgctcactgctgcattccagaggccagaacaatgcctgcaaccagagctggtacccaataactacttgtcaaaagaacattgggtgatgctgttagctctagaattctaggctcctgagacaatctttgtctgataaatatttgtgagctatacttggcaatctatgttgaacaaatgaatgaataaatcctggagccattttgtatttagctttataagatactagatcctgaaaagatcctgaagcaaagttactcgaaccctttaatgtaaaacaggagtatattagtccattttcacacaaggcacttcttacatggcggcaggagacagagagagagcgaaggggaaactgccacttttaaaccatcagatcttgtgagaattccctcactatcacaagaacagcataggggaaaccacttccaggatcgcatcacctcccatcaggtccctccctcgacatgtgggggttacaattagagatgagatttgggtggggatagagccaaaccatatcaaggaggaaagtgaagttgagtacttgccttgagatctaattgactgaattaactgatgtgtagacagggcgaagttgggggtaaaatctatccatggctacctctctaaaaatctagaataatagtgaatgagatagcaactgatgatttgactatgagatggtccaacttctctcacccactcctttactctctgctgccctaatcctcttaaacctcataggatgcatgcctgaaattccatcacagattttctttttcttttatctggggctgcactctgatggccctgggcagcacagtgtttctgaaacacttgcatgtggatgcctctaggtgaggcagacactctccagctcccctgaacccccactgctccctattgtctcacctctggctgctttagaaacttatcgtacctgctggacctctggaaccacgtttgttttagggctaaagtgcaatttcttcagctgctatcaatagattacatttgaccatgagtaaatgacccagggctaattttgttgcatggaggacaatatcttgaagatatttatagtcgcatagggtatcagaggtaaaagaaatttagacatagtcttttctcacctttttcacttgagaatgaagaaacaggcttaggaaaggtagatgacttgcttaaggtcacacagcaagttagtggcagatctggtactgaaatttagacttggtgaccaaagtggtctggcacagagcaaggatgctttgaagtacttgggcggagggttgggggggtggtgaaagaaagctgggatggctggtggtggaatttagaacatcttcaagattctgcctgggctgagcccacctttctcaggcttttcctcccagtagaactctggaaggtaggatacttgctcctcccatgtaatgatacacttgtgccttcatcctccttcactaatttgtgtctgtatcttttctgtcactttatataactaattactgtttactctttccaagcagggtgtgtggggatccaaactgtgggagagaatggtgttactttggggaagcctttgcagaaacaagacagtctggaagaaagggaaactccagctgcagaattttcttctcttttcttgctgtggccccatcctcccacctggctctaggggaaagtcctatttaaaagtgagagttagtaacttagcatctttcagcagatatcacagttgcctctggcacagcctcttgcaccctcgtacttcctctcctggctgtgcctgcctcagcatggggataactgactgccctcagttttcctcaccctgctactagatttgtagctggatttggggacctctgaaggaattttaaccacatagggaagcggtatgatcaagtggaagaaatgaaaacaccaaggctcgtaagattgagatctaatcctgctctgccaccaaccagctgagtctcccctgctgaaccatcagtcagctctgtggttgcaagaccgatagacttttctcagcactggtctcatttaatctctgcaacacttgcattgttgaccaacctctttaacaatttttaaaacaatttctaattctgaaatgttccaaaaagtacagaaaatattacataatgttgagcaaacaaaccgtacaatcagacctgagcaatgattatgagaaaaagctcaggtggccaaaggttaaattctgggagggtcttagacttggggaatggagaagaaccagggggaagaaaaagcctttactgctttgctccctctccccagaagttatcactacactaaaagtcagtgtatatcattcacagtaggttttaattcttttttttttttttttttttttttgagatggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagggttttaattcttttattataaatgtataataaatatacaaatatgtgtaatatatataaataatacacaaatattatggtcaaaatatactattttaaatgtttttatgttttctgtatgtttacgtttatgtgaatgatggtatccttttgaaagctgcttttttattcaatgccattcttttgagattgtctatagtatatgtatacactgagtccatcttaatcgatactccactatatgaataacccacaatctatttttttctcctataagagatagataatttgcttctactattttgctaccacaagcaatctgcaataaacatacctgtgcacaagttcgagtttttctaggtcaaaaatctagaagggggcttgctaagttattaggtatgtattcattttaaggttcttcagaatagttataccaaaattctgctaaatacttagatgaaaattctgccgaattgctcttcaaaataattataccattgaactctcccttgaataagagtttctgtttcctgacattctgccagcccttgttgtctttgatttataaagttttgccaatatgatgagtatcaaatggcatctcattgtgctagcatttccctattttcttgtgagatcacatagcttttcatttattgtattgaccactcagttttcttcctctaggaattgtcttgtttctcattttctggttgggttgtttggtgttttctcttagtgttttgtaagaaattttatatcttggcttgtaatactttatctgttacatggtttacaaataatttctgtagttggcttttttcactttgttttgggcatattttgccatacagaagatttaattttattttcccccagctttatggagatatactttacaaaaatatataatatatatgtatttatggcatacaatatgtgatattttaatatacatacacatttttaaaaaattaaatcaatctaattaatatgccacctcacaaacatcatctttttggtgttgggaacatatgagatctactctttcagcaatttttaagtatacaatccactattattaatcgtagtcaccatgctgtctagtagaactccagaagtatttatttatcctgtctaacaaactttgtaccctttgcccaacatctctcctttccccagcactccctaatccttggcaaccaccatttcactctctgcttctatgagtttaactttcagaagctttaattttaatatagtcaaagaaaacaatatttcattgttggattacaatttttgtgttttgttgaagatgttctgcctaccataatgccatacgagaaacttctaacacccctgtaattgaaaatggtattcttcctccctcaacccaggattttagttctaccttgtttttattattctaaatgactggtattattattttcttttttcttttcttttttttttttttttttttttttttttgagacagagttttgctcttgttgcccaggctggagtgcaatggcgtgatcttggctcaccacaacctccacctcccggtttcaaggattccctgcctcagcctcccatatagctgggattataggcatgcgccaccatgcttggctaattttggatttttaatagagacggggttggtattatttttattttatttttacagaacagcagagcaaatactttctcagcgctacccacatgttcattaaatttttggggtatatcacttcttgaattatatttctactttctggtttaatttcctttttcctaaactccatccttcatacttaagtgagagactctatgtaaatgctcttagtcttgtttaaaaacgtatttgtttcaacattgatgttgaaatatttttctttatagatgatacgtagtgtacaaatattttctcccattctcccaaaaggttatctgtttattctgtgtatagtttttttttttcctgtgaagaaactcaagtttaattacataccacttgtcaatttttgcttttgttgcatttgcttttggggtctttgtcatgaaatctttgcctgttcctatgtccaggacgtattgcctggcttggcttccagggtttttacagttttgggttttacatttaagtctttaatccatattgagttgatttttgtatatggtgtaaggaaggggtccagcttcaatcttctgcgtatggctagccagttattccagcaccatttgttgaatggggagtcttttacccattgcttgtttttgtcagctttgtcaaatatcatatggtcatagatgtgcagccttatttctgggctctctattatgttccattggtccatgtgcatgtttttgtatcagtactattttgttttggttactgtagccttgtagcatagtttgaagtgagtaacattacgcctccatctttgttctttttgctaagaatttccttggctattagggctcttttttggttccatatgaattttaaaataggtttttttaatacttctataaagaattgtcattagtaatttgacagaaataacattgaatctgtaaatggctttgggcagtatagtcattttagtgatactgattcttcctatccatgagcatgagatgtttttccatttgtttgtgtcatctctgatttctttcagaagtgttttgtaattcttattgcagagatctttcacctccatggttatgtgtatttctaggtattttattctttttgtggcagttgtaaatgggattgcctttatcgcctcattaaaaagtgggcaaagaatgtgaacagacactttacaaaaggagacaaacatgctgccaacaagcatatgaacaatactcagtatcactgataattagagaaatgcaaatcaaaaccacaataagatatcatctcacaccagtcacaatagctattactaaaaagtaaaaaataacagatgctgcaaggttgcagagaaaagggaacacttatacactgctggagggagtgtaaattagttttgccattgtggaaagcagtatggtgattcttcaaagagctaaaagcagaactaccatttgacccagcaatcccattactgcagcactattcacaatagcagaagacatggaaacaactgaaatgtcatcaatggcagattagataaagaaaatgtggtacagatactccatggaatactgtgcagccacgtaaaagaatgagatcgtgtcttctgtgggaacatggataaagctggaggccattatccttagtaaactaacataggaacaaaaaatcaaataacatgttctcactgacaagtgggagctaaatgataactacttatgaatacaaagaaggaaacaacaaacactggaatctacttgagggtggagggtgagaggagggagaggacaagaaaagattactattgggtactgggcttaattactaggtgatgaaataatctgtacaacaaactcccatgccccatatgtttacctatgtaacaaaacttcacatgtacccctgaacctaaaataagagttaaaaaaagaaatttttttttactgagaatagatgcctaaactaataattatatcctctcagctctctaaggataaaagccccatgtcttctagtctgtactgttgctgaaaatttgctgttgctctgcaaataagcagactcttccctctaataatattttgtcttctatgtctttgatatcatgcagcttcaccaatatttttatatatgaatttactttcattttttctacttaggactcattgttattattatatattaatattcatgtacttcatttattctgaaaaaattccagccatcattttttgaatattgcctttccccaattcatcctatttgatttttgtgtctcatacgaaatataaactaatttattttcctctgtgccctatgtcctttaaaatttcagatattatttatctctgtactaccactttgctaatttcctcacttcagtcttttagttcattaattctgccttcaactattgtttacgtaatgttttattttcctttgacaattttaaattttgattactatgtttttctctttagaagctgtatttggctacattggtttattcttcatcataatgtctcatggctgtcttatggtttcaatttattctattgtttattaattttaaacaattatgttgtaatctctcaaactggtatgcaatctgaagtacttatagttaaaatttttctgcttttgggtcctctgattctgactcaaagcagcttttactcccatatagttttccatttttggttgtgagttcctctttcatgggacttttcctgtgagaattctggacaactttggttcagtgtgtgtcccttcagaggagtatcaagttttcttccggcaggagacctgccagggcaaatttcatgatattttcttggcttgtgagttctcagatcaatgacagtagtataaatttgaaccacacatattcattacaaaatggaacttttcatcatttgttctcaaagctactctttctctgattttgttccagtcagctaaccaagaaggaaacacagcatcatcattaatgtctcatattttcttactccctaatccaaatatgtgactcctgtggcttctatctcattactttttctgaaatgcctcaatttctctccacctttaatgtaattaacttaattctttgatctcatacctgaaataaaccttctaattactgcttctgccacaagacttaaccttccctgattcattacaccacagctgaattgatattttaaaaattcaaatctaatcctgtcattctatggcttaaaaattattactgcacctccatcactttcaaaataaaaataaaaccttgaattctaagatgaaattcaagtttattggcaatctgagctctgtttttggcttttatctcttgcaaatttctcttgaatgcctttatacaaatgaccaatgcttcaaccatactaaattttcaatgtgttcaaattcccagaatatttttatatgctagagaaatcaatgtgttgatccataaaatccagatgaaagcttctcagcatgaattattgtcacatcttttctgatgacaaaaattgttattctttattatacgtcattatactaagcatatttactatgcttcgtagtgaaagtatattaaattgtagtcagcaacaatattcttctttttaggaattgcattcatttgtttatatttcagtagcagtataacatatattcctaataatatgacagtgtatgcgtttaaacatattgtcaatgacaaatataataatagaattctcacagacaggtaaatgcttgtcttaagtgagttcttaaaggcgaactgagttgttagataatacggttagaaattataagaataaaaagttgagatcaataagttcttttctggctcataattttacaattctgggtttcgtgtgtgtgtgtgtgtgtgtgtgtgtgtaaagttacctaattgacattacagtaagtgtaattcattgggaaaagcaataaaataataaaatattatagctgaaagtgaccttaaagataatttagttcaatagtttctgaaatatgttactagccagaacattgcttccaaagaaaaattttgaaatccaacatgtgagacaggtacatgtgggcctcccctgacttcatttagagactttaatactgcagccctatgcacaagtaatccttccttctcctatctacccgcaacaccgaggttacacagaactaagtttaaaaatcactgatctaccgcaacccagtcactgttcaaatgaaaaactggaagcccagagacccaatgatgtattcaaggtcaattagccatggacaaggctggctttaaccctaatcttgtaagtctccatgaagttctatggctatgactcttattttttacaataagttcaacccaatctcagaaagccaatagaatttctcatttctcatatcccataaatagattaatgttttaatgtaacaagttttcccatgtatttactccctagaagctttgacataagaaatagttgctcattgcagaaaatttcaaaaataaagaaaaacaaacacataaaagatagaaatcttcagaaatctctgctggaagaaataaccattgttatacttttttctctgaaaacagtttttttttttttaaccaaatgggattatacaaggtgtatcagtgagcatttctaactgcaaatagcaaaatcctctttagctaatacagacagaaaagacatgtattaaaggatattaggcagttctagaatctctagcaagatcagagagtcagtgttgaagtcaatccaaccagaaaataatactcaaacattacaggacttctccagagaaaattctagcaccaccacgaccaatggacacagatgccccagctcacactctagaatgtggtgtaggcccaagatccaacaccagcccaaagtgagattctccactgcctcccaaaaattacaaaagaaattttcccatgtcatctgcttcatcccattttcctctcttcttgacgagactgatagcacccaggacacaggacacatctacccaccaggagcaaatcatgccccaaacatgagaagggtgtgcaaagatcccacaatgcaatgacataacatttgtaacaggaaaagtcttcatatatttgtgttcttttaatttatatattatattaattattggcctgacaagattgatacattgaccattatatgcaaatcatcttgccgtaagcaatttgtattgattccaaatataatgaataattcaatttatcctttcctttttcttgtcctccaaaaaagtattttaaaaatcttttccaatttaaatgatataaattataaaaatgatgcaacccatttataaggacaaaaatccataaaattttgggccgcatgaggagttagtgtagtgacacacttatttactccaatgactaataattattgcaacatcatgtttttatctctccaacttagttaaaagtatcgtacagatgatcagttgcttcagacaccaatcagcatcccacggacttccgatcaaagactgtggctgcaaatcaattgcagcatatggcgtttgtgcttctattacccagagcagtagctgaggacatagtaattaagcaaatgctaatgagaagtctaaaatattcacaaatgtatgaatgtatggattatagttatttggcaccaattttaagtaacaagcacaatctgtgtcaaaatgcacttgtgaaagtcttagtatgtgccgataatatcttactactagtctctgaatgtgtccaggaaatctatttttacaaatttaaatgttgcaattatcactacctcactaataaataatcctgattcatcttccagaagcaaacctcaaatttggttactctccaacttcaactctggataggctctcattgtttattctttaaagttcacagttcttacccaagcattcaaagctctctattaactcacctcaagcaactttttcatgtattatccccccattcccgttgtctctagctcagcgtttcccaatgctggcattttgggggctggggctggctttttttggagagctgatcagtgcatattagaatgtttcacagcatcctgacctctaaccattaaatgtcagaagcatcaccacccccttctgctgcgacaaccaaaaacatctctagacattgccaaatgtcccctggtggtggagggaggggggtgggaggtgccccagttgagaagtactgctctagcaaaactgaattactcattcttcctacacaaactctgatttttcctgcctccatgtccatctttcattcattctgcatatattttactgaacattgactctatgaaaagcactctaccaggtgctaaaagttcagtagtgaacaagatggctatggccctgactttgtgtagctaatagccttatgaaataagccagatcaagtgtaataagccaagaaggcagagagttgagtaagcagcccctgaagaggtagagtgaaaagtgctgagagcagaagcctccactcacctgagtaggacatcctttccagaactcagtgtatacaaattctacccaccccctgaagcccagctcagatgctggctttattcagccttctctgatagcttcatatagaagtaatctcctatcctctgcatagccagagcagacattctctatggtacttggcaccctgctctgtattggttattattcatggccccattattgcatacatctctgactacatgaacctcttatgtataggatgcatgtcatattcatttctgatttatccacaagaaactcagttctttacacaaaaagaaaagctaaattcacatctactacaggctccaaccagggtcttttccaaagggcagtgagggtaatgtgtttaaaatgccatacatcaccttagaacccaagttgaaacagtttctcatcactcttgggattaagaacaaagccttgaatgtagctaccaaagtccctaatgcctgtctcattcttcttcttactccttacctcttaccactgtgccctttactgtctgtgttccagccatattcactccttttcaattgcttcaaggtgccatgatctctcctaaagcagggcctttgcactgctcttttcactgcctagaatgctccccaaccactgtctagcctctgcatcgcacctttcaactgtcactttcctacatagccttatctgaccctccagccaacatgtggttttttggaaacatgttaaagaatcaatttcttttcctgcataagttatttagcctatattatatccttgcctctatgattgataaaggcttatcgccttcactatatcaccagatcagtgagaacaagtacctcctacactcataacagtgactgacacatagaaagcattccataaaagattttgttaagttgatgagcaaatggatttttaaaagtagttaaagttttgatgaagatgtccataattgaacaatcaacattctgagcacgtttatgaaaagggaggcaaaataccttcattccagaatgttggaggaagaaaaggtttatctgggattacttaagtagccatcagtgaactctgagggaagattctgggattaagaggaaagagtaggaccataaaaagggtatgtgcacaggagagtcagaagaaatgaggaggagctgagggaaggacagactgatttgggggaggttggtggtaaagaaatgagacagaaaagtgatgctcagaaggccagtagttgaggccaggcacagtggctcatgcctgtaatcacagtacttcaggaggctgaggcaggcagatcacctgaggtcaggagtttgagaccagccttgtcaacatggtcaaaccccatctctactaaaaatacaaaaattagccaggtgtgatggcacacgcctgagtcccaggtactaaggagtctaaggtactaaggcaagagaaacacttgaacccgggagatggaggttgcagtgagccaagatcttaccactgcactccagcctgggtgacagagtgagactctgtctaaaaaaaaaataaaaaaagccagtagttgagatcagaaaaagtaaaatcagtgaaggttagtggtcagtaagaaagaccttcaagccatgaagtctagcactttaaaaagtgtcttggaacacagtaggtactaaataaatatttattgagtaaattctgaccaaataatcttctacttaaagtaaatctactttttagtattgtgtcagacttatttgtaattgcctgactactagccttccttccgctaacaaaattcatgttgaaagaatggctggtgagctatctggagttgtaagacacagactttaaaataactagttaacatgttcaagaaaatagacgataagatggacagaatttcacaagtagattttaaaatattttaaaatcaatgtaaattctagaattttaaaatacaattattgaaattaagtaagttaattgattaatgtaacagcaggatatgaattacaggacatagataaagagaacattaaaaaacaggaagatagtcaagtagaaaaacacactgactagataatagagataaaaaagaatggaatacaacaaaaggaaagtatagccgatagatgagatacattgaaatggtgcaaggtatatgcaattggtagtccacaagatgcagagaaggaaagggcaaaagcagagtttgaagaaatttctgaaattgctgaaacacatcaaatcacaaatcaagaaatattatgaccgcaaccaagatcaatacaaagtaaaagtaagcctaggcacaaaataaaaagaaaaatctgcttaaaactccaatgtaaatagaaaattttaaaagcagcttgggaggtggggaggaaatagacacatttcttcaaagaaaagacatctgacttttcagcagtaagtatggaagtcaaacacaatggaatgaacaattcacaatactgaaagaaaacaatactgtcaacctggacattttatatccattgaaattatccttcaaaagtgaaaaaaaatgaaaacactttaaggcaaataaaaacagaatttgtcatcatatctagtactggtaaattttaagagttctctttacgaagaaaaatgatcccagagaaaaacatgggaatgcaaacagaaatgaaaaacaatggaaagggaaaatatataagtaaattcaaattatttattactatacaaacaatatattatgttttttgcagtttaaaacatacctagatttaatatgcaaaacatctaagaaaggaaggagataaatggagtcagagtgtttccttagcattgtctgagaaatggtaaaagtaaaaagttatattaagctaataacataagcatattttaatctctataataaccattaaggaatatacttctaacaaatcaataaaggagaaaaagcaataataaaagacaaattggaatgtacttctaacaaatcaataaaggagaaaaagcaataataaaagacaaatttttagtccaaaatatggtgggaaggcttataaaataattataaaaaaggacaactagaaaataaaaattaccatactagacatacattcaaatatatttgaatgtaaatattttaaataaactcatgaaaaagaaagcattgttaactgggttccaaaagtgtgtgctgctttaataaagttagtttaaatataaggacaaataaaatatgaatatatcttcatatatatacatatataacatatatacatatataaacacatatatattatattatatattttaatatatgtatattatttatatatatatatttttttttcacacatgactgggggcctaatcagcaccagtcactaaaggaagctcttaactaggcttatttcaacaggactgatagggatgacatattcctatatgtagaaaaccctaaatactccagaaaaaaaatgttggagctaagaaaggaattcaggatacaaagtaaagtttcaaaatacaagatcaacacacaaaaagcagttgcagttttatacactagtaagaaactatccagaaaaaacaaattaagaaaacaatcccatttacaataatttcaaaagaataaaatatttagaaataaatttaaccagtgaggcaaaagatccgtacgctgacaacaaaaaccagtaatggaagaaattcgagaaggagaaatggaaaagatctttgactttagttctggcaataattttttttaggtatgacaccaaaagcagaggcgacaaaagcaaaaatgaacaagtggcattgtatgaaactaaaaagctcctccatagcaaaataaatagccaaataaatgaaaatgcaacccacagaataagagaaaatacatgcaaaccacatatttgataaacggttaatattcaaaatatatgaggaactcccacaactcaatagcaaaaaaaaaaaaaaaaaaaaaaaaaaacaaataatgcaattaaacattggctaaaggatttaaagagacatttttccaaagaagacataagaatggccaagaagcatatgaaaaggtgttcagcatcagtaatcatcaggaacatgcaaatcaaaaccacaatgagataacacctcacatcacagaattgctattattaaaaaaaataaagataagtattagcaagaatatggagaaaaggaacccctactacactggtgatggaactgtaaattggcacaagcattatggaagacagtgtagaggttcctcgaaatagtaaaaatataactaccatatgagacagcaatcctacttctgtgtatttatccaaggaattgaaatcagagtctcgaagaaatacctgcactgtcatgttcaccgcagcatttttcataatagccaagatggaaaaagctgcctaaatgtctattaatggatggataaataaagaaaatgtgataaatatatgcagtggaataacatttagcctttaaaaagagggccaggtgtggtggctcactcctgtaatcccagcactttgggaggctgagaggggtggatatcttgagctcaggagttagagaccagcctgggcaacacagtgaaaccttctctttgctaaaaacacaaaaattagctgggcacagtggcatgcatctgtagtcccagctacctgggaggctgaggtgggaggatcattggagcttggaaggcggaggttgcagtgaactaaggtggtgcggccacactccggcctgggagacacagcaagaccctatctcaataaataaataaataggaattctaccatttgtgacaagataggtggactcacaggatgttatgctaagtgaaataagccagacacagaaatacaaacactgtgtgatctcacttctatatgggatctaaatcaatcaaactcagatgtagaaagataatttttcagaagctgggggttggaaagatgaggagataatagtcaaatggtgcaaagtttcaattatacaaggtaagtaagttctggaaatctacacacagcatagtgcctacagctagaaatactccattatatacttaaaatttgctaagagagtagctcttatgttaagtgttcttaccacaaaataataataataataaatcgggttggggaaaagtttgggaggtaaaggtcgtgtctatggccttgagtgtggtgatggtttcacgggtgtatacttactcccacactcatcaagttatggaccataaacatatacagctttttacatgtcaatgatacctcaataaagtagtttaaaaaataactggggaattttttaatatttggaaattatgcaatatccttctaaataaaccatgggtcacagaagaaatcaaaatgggaattttaaaatgtttcaaactaggtgataattaaattatgatgtgttaatatttatgggatgcagataaggcaaggcttagtgggaaatttataaccttaaatgtatacgttataagaaaaattgttaagaatataattttttcaaaacagcttaaattacataaataatcaactaagaagctagaaattgaaaagcaaattaatcccaaaaaatagaatgaaggaaatagaaaaggctaagcagatgttaattaaattaaaaccaacaacacagaaaataagcaatgccaatacttgattccttgaaaagagtaattcaattgaccctagacaggcttattaaaaaatgtttaaagagagaaataaggcacaagttatcagtatctggaatgacaaatggcacataccagagattctacaaacatcacaaaagtaataaacatgtaagcaactgaatatccataaatttaaaatttagatgaaatggagaaattcccagaaaatcataatttaccaaatgtactcaataagaaaaacaaaatctgtaagtaaaagcctttctacaaaatcttcaggcccagataacttactggtgaattcttccaaacacttaagaaataaataacaccaacttacacaaaaacttttaaagaaaaaagggcagaatgaccttgataccaaaatccaaaagggcattacaagaaggataaatatatgcatatttatctcataaatattgatctaaaaattgtaagcaaaacatgaacaaattgaataaaaccgcatctaaagcaacaaataatagttatttcatcattgtgaggttagtttaacaaatataaatcaatgcaattctccatgttaataaaggagaatattcataccaccacctcaaaaaaagcatttgaaaaaatgttataattacgatttacaaagaaaaaactcagcaaactaaggatagagggaaatttttgtaatcccaaagaacaccttataaagatattttacacaaaatactatacttaatagggaaatgctaaaagctttttcataatatcaaaaatgggcaaagatgtccactttcactacttctattcaacagtgtgctggaggtcctagccagtatgatgaggtaagaaaacaaagtacaaagtttgaaatgaaagaagcaaaactgccattatttacaaaacgcatggctctatacatgaaaaatttcaaataatctgaaaacaaagtgttagcattaataaactaatttagaaaatatactagatacaaggttaatttccaaattaattttattttgacataacatcaacaaataattagtaagttaaattgaaagtgatgccatttatagacatacagtaacacatgaaatgtcctaaactacaggaaataagatagggtgatattggtataagagttgactaacaaaccaaagggacaaataggatttggaaatagccccacccgtaatcatcacggacttaagatacagagtgcagtggagaaaaaagacttttcaatgaatggccctaggtcaatctgatatctatatatatatttaaaaactcatcataacccttaccatataccatgtaaaaactcaaattcaaatgaatcataaatctaaatgtgaaagataaagtaatatagtttctagagaaaaacttatgggttttctcttcacgaccttgaggtaaccaaagatttcttaaataagatgcaaaaaggcactaaccataatagaaaccattgataaattagactacattttgaagagcttctgttaatcaaaagtcaccttcaaaagagtgggagaatatatttgcaacatgcgtatctgaaaaataaatggctttattcagaatacagaaagaggtcataacaatatgaagagaagcaatcaattcaacagtaaaatgaacaaaagacttgaacaaaatcttcataaaaaaaaagatatcaataccagcatttgccaggatggggagaatttagatctcttatactgttgctggaaaactgagagtatcttgcaaagctgaatatacacatagcctgtgatctaagcaaacctgctactaactcaatgtacagtagaaatgggtacacatatgcaagaaaaataaaaagcaaaaaaacttgtatagcactcagtgtaagagtgtaaaaatcaaaacaattcaaaggtccactattaaaatgaactttaaaactgtgttgcattcatccaatggaatagttagccatgaaaatgaattaatcacttttgcaagcaatgaaatggataaatctcaaagatataatgatgaatgaaagaggccagacactaaacaatatagaatgtatgattcaatgtatatgaaattcagaactgatatatggtaattacctttgcagggtagaggtagggactaagcacttcaggtattggaaatgttattatttcttgacacagttgttccaataaaaacatttttttcaccacctacctggaccagtggggtaggaacacagtggagaagatggctggctacctatatactaaatgagataataaagggaaaacattttgtacactgtaagccactacgtaaaataaggtatctctgtatacctattgcatttgatggctcagacagtataggaactgactgctatatctcacataagcacagtacagctcgtgttggctcagctggtaccagggtcaactggaagcagggatgctactgtggccgggacattcccctgcttggtctcttgggtctctgcttttttcagtatgttcaattctttctatgttaccacagattgcattttcttttcttttcttttctttttttttttttttttttgagatggagtctcactcttgtcgcccaggctagagtgcaatggcgtgatctcggctcactgcaacctccgcctcccaggttcaagcgattctcctgcctcagtctcccaagtagctgggattacaggtgtctgccaccacacccggctaatttttgtatttttgtagagatggggtttcaccatgttggccaggctggtctcgaactcctgacctcaggtgatccacccgcctcggcctctgaaactgctgggattacaggtgtcagccaccatgcccggcctcacagattgcattttcatgaggaaagcatgctctagatcttcacgttccgcagttactacctatattgaaggacagagcgggccagggatccccttcaggacaaattatctatggccctgaagtcaggatcatgtaacagatttttatcaccattgtatagatgaagaaactaaatgtttctgtgatttaaaaaaaaaaaaaatcggaaaacaaatcaacccagactgttacagctgagatctttaaacctacagagtgtagcagtctcttctttctgaatggcctgtacaacacttggtatattaactgctaccaagaagcatgcaaaatctttgatgcggattaattaacacaactcaattctacagatcctactatatgtcaggatctgtgctatgcttagtgggggataatttgataaataaggcatggccattgccctctgggtctcagaatctggtagaagagaagttcaacagataaatgattttaatatatatggaattttaaaaaatattcaaaatacaaacagaaagaaactaacagattaatttggaattgcagagactggagggaaaaaggagtgtagagcaggtgtcctttcaaatgaatttgaaatatgagaagtactttgaaaggcagtgatagggaatgaggacattattgggaaagggtagaaaatgagcaaaattagagctgagagaatgcaggaaggatttgaggaactgtagtttacatgatacagctaggacacctggcatacaggcaggtgtaaatatgaggtataacaagactgcagataggctgacacacttggaatgtcaatgtgagaaatctgaattttcatgtgaacacagttgaaggtgttaatgcaacatcacattggtttcaaaaaaaaatggagctatgtacatatttaaattgtatttactagctctctgaccttaggcaagtggcttaactccaccaaaactgactccttagatgaggtaatagtgcatgtagaacatttagcactattatatattcagtatataatatgtgctttgtaaatgttagctgccattattattgtttctatgaaggagagagaatcatacatattcaactctgtatgatggttaaaaaccagcttctgagttattttaaattttatttagatttacgtttgtgatgctgtggcttaaatccatacaaaatatttggtgataggtcccattgttctttgatatataaaataggtctataactgatttgtcacttctatgaattagcctcctgtcaaaaataacactttattggaagttgtctgcaacatttaaaagatttggattctttaccgtgaaacagcaatgtttcaaatcactataggtacaaggtttaattggtaattgttttatgtccctctaacttaagcaatattactgtagattatttctggagataaaggcaatccttttttcagttaaaccttaatcataatggtggaagtaaaaaggtattgtggggaagcactggctttggcattggcttgatctaggtaagagtcttaattctattccttcctctttgtcttcagagaaattgtttaacttcccaggaacccaattcctcacttgtaaaatgagataaagatatttatgttcttaacacaatgcttagacacatgataattccttcttttccatgctcccagatcacagcacaagtactgcttaggggggaaaaatgtagtgggcacagactggaccagagttcagatacttcggtcaaaaagttgagatacttttcaagcttcaatgttggcctagcctgcccatgctgtgattcgggcagcagtgatgcatgctgtacagggctcatgaattgactgaagatacttgaaggaaataaaattagtcattttttatgggtctttgttgtttttatacccatcctcccaacatcatttccactttcttttcctaagaaggccccaactcaactttgatgagcctctccattcccacttgcagttcaagtgccctgggtgggcaccatgtgcctccagagatggagcatgtgacccagtcccagccaattggagcactaagtttctctgaccacagtaattagttcatcacaggaaacatgatccaagttggtccaatcataagaataaagagatatgtgtagtagctatcagaatattctatttttctgtctgtcccactggatttcaatagttggagcctaaaacataaatgtcccatggactaagccccacaatactcactggctagagtttttagggaagtcaactttagggaagtcaaaatggagaaaccatgaaagttatttatttatactttcaaatttaatttggcaatgtcgtatactgccaaatcattgatccctagagaatcccaatcagaatactggagggcgacggctaagatgaggaatggtgcaggagcttagaaccttgctctggactatctaactgcaactgtaaacttaggcggaatgaactataccccaaatctatccaaaaatacattcttgtctggatgaagagctggtttatcaagcgataactaaggctactttggagccaacagtgtaaaccgtgcttactttcacattcactcaacaaatatttattgagtgtataccgttctaagaaactgggtaaaataagcagtgcctgccttcatgtatcttaaagtcttgcaggggaaacaaacaaacaggcaattatcatataatatcataaatattataatgagaagagtatataaaatattaaggggacattttagagaagcagctaatctaggctttggtggtccacaaaagcttctgagagattgtgccataactagccaaatgaagtggtgaagaagaatgctctcagtagcaagagaatgccatttatggaaaaatggaagtaatgcattagaactggaatacgggccgtaaagtagaaagtggtatgatacaatatagatggaacaggggccaaatcacaaaagcctttaacagccatgttaaaaagtctggattttaatcaattgaaagcaatggggaactactgaaggcttttaagcagaaaagcagcataacaagattgacattttagaagcatcactccaaatgcagcatgcagaatggattggagggagacaagagaagaacatttctattagccccttagtgtgaccaacaaggaggatattgcagtaacccaggtgagagatgatactgttctaaatcaagccattgtcagagagatgtaaaagaatttcagagggattaaggaggtcgaagcagtagggtttattattttattggttctgaagcttgcctgatcttcggccatcaactcccagatggccagtcaggatgctacatattctatcaggagtgttaatagaagagattcttacaacagacaagggactggttcatctcacttaggatccttttcaagtttgcagtactttgattctgtgctgaagatagggaataagaatgaataattacttaattaatgatttattgaatgataggagtggggaccccctcgttgcctaaaaattggtaagatattggaaataaaaagaaagcactacttataatggcattgcattgcacacacagctaacctattctgagagagaaagagaggacccaattgaatattaccggcaattttgttcagtgttccactgattgatcacatgcccccaaataaacatgagacaagagctgggtatcttctcttccttcagtcaactcagttcccactgtccttcactggggacaaactctggcattcttcttctaattctggtgatcaaggatatgaatttttgaattttcaaacatcatggctccccaaaatataaggcaaatacttattacagttctcaagataatgtgttccaatactagaaaaatggtgatgtggatttattgagaaagggcatattaggccccacttttgtataatgtgcttgtgtataaggaatttttaagggtttttttttttttttgagactccgcccaggctggagtgcagtggcgcgatctaggctcactgcacgctctgcctccagggttcatgccattctcctgcctcagcctcccgagtagctgggactacaggcgcccaccaccatgcccggctaattttttgcattttttagtagagacggggtttcaccgtgttagccaggatgttcgcaatctcctgaactcgtgatccacccacctcagcctcccaaagtactgggattacaggcgtgagccaccacgcccggcccatgagccactgtgcccagctggtatttttttttaactgtgaaaattcaccttaaatattaatcttagaaacttttgagtgagatttgactccagagaagaataaattaatggaaattacactatcccagaagttgcagaacttgaaaatacaaattttataagttccagaaggatcattggaagccagggcatttcagaacaattctaatatgatgttgtccttccaataaaacattgctcatcacaactatctgagaaaaagagtgagtggaggccttcttcagccctcatagtcttgtggatagaaagctcctaaaggtggtggaggagccaagatggccaaataggaacagctccggtctacagctcccagcctgagcgacacagaagatgcgtgatttctgcatttccatctgagctttgaagagagcagtggttctcccagtacgcagctggagatctgagaacgggcagactgcctcctcaagtgggtccctgacccgtgacccccgagcagcctaactgggaggcaccctccagcaggggcacactgacacctcacactgcagggtactccaacagacctgcagctgagggtcctgtctgctacaaggaaaactaacaaacagaaaggacatccacaccaaaaacccatctgtacatcaccatcatcaaagaccaaaagtagataaaaccacaaagatggggaaaaaacagaacagaaaaactggaaactctaaaaatcagagtgcctctcctcctccaaaggaacgcagctcctcaccagcaacggaacaaagctggacggagaatgactttgatgagctgagagaagaaggctttagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctccagaactatgtgaagaatgcagaagcctcaggagccgatgcgatcaactggaagaaagggtatcagcaatggaagatgaaatgaatgaaatgaagcaagaaggaaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaatttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttactctcaaagggaagcccatcagactaacagcggatctgtcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatgtaaaggaacaaccggtaccagccactgcaaaatcatgccaaaatgtaaagaccatcgagactaggaagaaactgcatcaactaacgagcaaaatcaccagctaacatcataatgacaggatcaaattcacacataacactattaactttaaatgtaaatggactaaatgctccaattaaaagacacagactggcaaattgggtaaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcagataaaacagactttaaaccaacaaagatcaaaagagacaaagaaggccattacataatggtaaagggatcaattcaacaagaagagctaactattctaaatatatatgcacccaatacaggagcacccagattcataaagcaagtcctgagtgacctacaaagagacttagactcccacgcattaataatgggagaatttaacaccccactgtcaacattagacagatcaacgagacagaaagtcaacaaggatacccaggaattaaactcagctctgcaccaagcggacctaatagacatctacagaactctccaccacaaatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaacgagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagaaggaatcctccctaactcattttatgaggccagcatcattctgatatcaaagccgggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatacgcaaattaataaatgtaatccagcatataaacagagccaaagacaaaaaccacatgattatctcaatagatgcaggaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcacaagacagggttgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatataccaacaacagacaaacagagagccaaaccatgagtgaactcccattcacaattgcttcaaagagaataaaatacctaggaatccaacttacaagggatgtgaaggacctcttcaaggagaactacaaaccgctgctcaaggaaataaaagaggatacaaacaaatggaagaacattctatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacttgagaaaaacaagcaatggggaaggattccctatttaataaatggtgctgggaaaactggctagccatatgtagaaagctgaaactggatcccttccttacaccttatacaaaaattaattcaaggtggattaaagacttaaacgttagacctaaaaccataaaaaccctagaagaaaacctaggcattaccattcaggacataggcatgtgcaaggacttcatgtctaagacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaattcaaacaaatttacaagaaaaagcaaacaaccccatcaaaaagtgggcaaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcagcattattcacaatagcaaagacttggaaccaacccaaatgtccaacattgatagactggattaagcaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcataggtgggaattgaacaatgagatcacatggacacaggaaggggaacatcacactctggggactgttgtggggtggggggaggggggagggatagcattgggagatatacctaatgctagatgacgagttagtgggtgtagcacaccagcatggcacatgtatacgtatgtaactaacctgcacaatgtgcacatgtaccctaaaacttaaagtataataattaaaaaaataaagaaagaaagaaagaaataaaataaaataaaataaaataaaataaaataaagctcctaaaggtatgttaagtggttaagtttctggatcctcttcttgcagactgctcaggtaaaatgctgattcaggactttcacttgtcaatcaatttctccagcgggagccaaaatacttttttgaaaaatgttgtcctgtctaaattgacccagatgctgtgatttaatctgcaactggaagatacagttcgggcagtctctttttccctttggtttccataagctttctctccttttctatttttcaatataaaataaaggacaagactttacagtgattaagaagcacacatagtaattccacaaatgttgctaggcaacaagggccacgtattagctcaatgaatggattctgggcatctgcacgaaggagaaatatgaggagcttgtgagtgaactgtcttgataaccacaagggttagtgctttttgacacacatgctgttggatatgcctgagaaagggaaaaggcacacttattttaaacctttctgatggtttatttttccaaaatgtgtttagaattctctttgatggaaatttgacacagtgtgttataatgatcattatctcaagcgggaaagtaggtaaaaatggcctgtttctatttctctagttcagggctgcacctatagcctgagttattttaacatcttccctcctgatcctaataggcatgctttttccccctcccataccagtccattcactcagctgataaattacaagggcatgttctatctgctagtgagcaactcctctcccttgtgatcagtatttaccctcttcagttgctgtgataatataatattattgactctaagaagtctgctttattttgttcctattacaaagcaatacatgatcattaacaaaaaagcagaaaaatatagacacatgaatgaacattagtatctgtgttcatcttcaccagaaagaataatataatataaattaaggcaatgtaaataccttggtgcatatcattctagatttttttctgtacatacacagacagatttttttcttctatcacccatataaaaaagttataacttaccttataaactccacaatagccaacatagtttttaatgacttctgcactacaccaggatcatttaagtattttaatgaaacttggaagagtaattaacagggtaaatgatcagctattagataactctactaatcttattgcattttcctgttaatcacctaaacccaaccatagttagctttattaattacagaatcttatatcattatttcctttccattttgatatggtttggatatttgtcccctctaaatcttatgttgaactataatcctcattgtcggaggtaggacctggtaggaggtggctggatcatgaggatagatttctcataaatggtttaatgccatgtttgtgctgttctcacaatagtgagtgatttctcacgagatctggttgtttacaagtgtgtggtccttcccacttccctctctcttgctcctgctttggtgcctgcttctgcttcaccttctgccatgagtaaaggcaccctggggtgccaggcagatgctagtgccttgcttgtacagactacccaaccatgagccaactaaacctcttttgtttataaattacccaatctcaggtatttacagcaatgcaagcacagcctaacacacacttcttataatattaccctagtcaagtctctctcttttgtttttttttgttttttttgagatggagtcttgccctgtcacacaggctagaatgcagtggcgcgatcctggctcactgcaacccccacctcccaggttcaagtgattctcctgcctcaacctcctgagtagctgggattacaggtgcacgccaccacacccagctaatttttgtatttttagtaaagagagggtttcaccatgttggccaggctggtctcaaactcctgactttgtgatctgcctgtctcggcctctcaaagtgctgggattacaggcatgagccacggcgcccagcctaacctagtcaagtctcttacctggttcttacagtaatgaattaatcaggactctggtttcaaatttcagaaacttcaactcaaagggactcaagcaaaaggcaaagtatggctgcgatgctaaaagttgcagtaggagaggctagctgaatgcatagtggaagtcacagactcaagtaagtcagcaaggcttagcttcactcccactgtctctcagcaattccctcttcggcaacagcttcattcctgggccagctctctccaaaacgtgaggagatggccatcagcatctctaggcttctatgttctcaagaactctaggggaaaaacagtcctctgatttagtcccaggagtcactctgattgtacccttctgaaccaatcactgtagccaggggtcaggtgctctgagtggggccagacctggagaacatgcccactctgaagcctgatgacacagttcaccccacccaaaactcaagaacccaagagtcaaggagcagtcattccccaaaagcaaaatcagggttctatccgcaaggatactgtgcagtcaaaagcagcaaccaacttttcctgtgtgttccatctactctttctgatccattctacactcttctccaaccaggctcagcttatggaccgtatcaaccagcttctttccctctggcttcaattgggcttactcaacaggatgcattagcaggagagtgaaatcaccatatttcttcatctcctgccttggtgggttacaggttggcagcagctgtgttcctgatctctttgtgggatctgataataactctctcccctcggcccttcaggcacaaggatgataacagctcactgctgtgctaagctccaaggtattccaccatcctttgttgattttaaccttgcacacacctttaactcatttgtgcctgctttccctttcctatgggacctcctatcaggctgctcaacctatcactgttccttcatgtcaaccacaaatttggttagccgttaaagtcttcattcaagaaatggatgtgaatatttaaagttcaaagctaagggccactgtcaatttaatccaaattgcctgttattatgacctaggctttggtgaccacagaagtatactgaggattgtgacacatacagccgattccaatcactttcattttgggttgatttagtagggtatatctggaatatattctgtgaaggttatattttagtggagatgatcttgattctctaggaggattgaaaagaaagtgaatgaagaaaggaaagaagaaagtaagaaaagaattgagggaggaaagaaggaagagagagaaaaaagaaaaaggacctaggaataaggagttttgatcttggagtaaagaaaccttagaattcagtccagctttgtttttgaccattgtaggtggccttgggacatctttccttttcaccggacctctctctcctggcttgtaaacactaggattgggccagaccatttttaaggtcccttccagttttaataatctatgaagttctaatgaactacaattaatgatgcttgcaagaaaaaaatgcccttacaaacactgcctgttcaaagaaaattaagatactttattaaattagataaatatatttttttctgaccaagaaagcaaaatctttttgaaaactaggcaatcatttaagttaattatggaatgaaaacccaaggtagtgcctgccctcaattcaaaacaaacttgtttttgttcagattcttgctacagaccaaattttatgtacagacaacgtggggctatcaatagggatctgcagtgaagcccaaggaaaacactaatgaagccagcaggagcccacacagcctagccatcgacacaatgcaaaattgaaaacacgactgaaaatccacagaggaggatgtccccacacttctttgtgtgtgatttgcctggtccagccaagattgtagaagctgtaggaggaagataaaaaaatttttaaaaaagaaagggccaaagcaggaaatgagctgtaacttgacagagtcacaaaagaaaacagaaaagcatgaaacatatcaggtccaaagaaggaatttggaaaatatagcctgtttattttgaaatgaggcaattgataatataaaaaaggataccaaaataaattaaaagctctgaggtattttatgctaaaaatactcattataaatagccagggtacaagaacagacaatagacaagccgagtttgagaaactaaatgtgttgatattttaggggaaaagaggtaatgtaagcaaaagagagactccatccttgagggctggatgttcacctggggcaaggtcagacaagggcagagcacctgcaccagacccagtgagagcttcacagcctcgacaaagaaggtaggagaaaagggaagaaaagtcagaggttgaaccatctgtgctgacaaaatggttttaagttgcttgccaagaaactgatcagtctgtaatggcagccttaaacattgtgttgaaaaggaaggtgaagtcatagcagaaccaggcacaggaataaagaatgatagattggcagtgtttccagtggggatggcagtaggaagggaaggtggtgacccacttgagtaatttgctgaccttggaatgtatgttctagaactatactgtccgatatggtagccactagccacgtttagttatttaacacctgtaatgtggctggacagaattcagctgggctgtaagtggaaaatgcacaatggattttgaaaactaagtacaaaaatatatactactttaataatttgcatattgattataggcagaaataatactttagatatgttaagttaaattgaataaattattaaaattggcttcacccatctctttttgcttatttttaacatagttgttacaaaatttaaaatcacatatgtggctagcatctgtggtctgcattatatttctattggacaacctgctctgtaaagtcccttttctgtctctccaggcttctgtgatatgatgatattcaggaagccttgacttagccctcactatcttctccatctcaagcagagccttgtctcagactaaccaaaaggaaaccacattgagactcaacagatgctgtaaccacacaactcacacccacgtgagaatatacacttacttagaagaacagtcactgccacctcctcacgtgtacaccccattcatcacatatgtacacaagcatatttgtatgtgtcagaaaaatatccataaataggaaaggaatattagcagaatcattgtcacagtgaaaattacatttcaactgtaattatttgtttgagttagggagactcattagtgcttgttaataagaaaaggttctttgaaattcaagaatatttaacttcatgtcttccaattcctaacaagaaatcaatttactgagaggggattccagaatcatgcttctatgtataaccaagacatcagggctgcccacgcatgacagagagtcaaaagtaagctttggccttgacataaaaacctccagtgtgatcgccaaccagcacaattggattctactctcttagctgtcttctctggacttctgctcttttccaaccctatgagccacctggtcttccagtcctgtcttccactagaatctaccacctagcacacctagcagtacctgccagttgcatcaaactcctggtccagactctgctagtcagtccatggtagcatagagagaccaattctaacgactgttttgaggctgtggtccagcaagtttgtgttcttgaacttttcaattaggtgagctagtaaattctcactgttgctgaagccactttgaatttagtttatcttgcttaaaactgtaaaaatcctaacagcactcttcaaatatttgaagagcgattccatggataatctattttttctgtacttcaaggggtggcttctagtgaagtctctcctgatgatgtactttcaccctgaaatttccttttcatttatccttttcaaaaaatggtctacaggtcatgattatcatttttagaacttgccttggtgatctggtccatccataataaagggaattcaaaggtcatttcaatacttcattctgagttactgacaatactcaacatcaagtcattcttgctgcttatttggatcccagctctgggctcttggcttctgtgtggatcctgagacccagatgccaatttgcattccagctttgaccggtatccaaatgcatcctgatgtttctgactgcctcttgtaataattgctccaaaccccagtggcttcaggatcaggagtctgtctacctgatcattcctcccaatctaagaactgcaaatgggtccctagtacattttgagaaacttctgtaagtaaactaagcatcttctctgtggtttaaaattgtcaacttccagattactcattgctatggtctaaatattaccatttactggatttgcctgatgctaactgtgtgttataaaactgctttgtggactaatctttcctcatgtacctgttatgtttctctgtaaccagccctatcctgatgggtaactttgtcttcaaatcccagccacatctcaccaaactttacttaacctttccacatgtcccaacctacaagaaacactgtataaaaccaccatgcctctctaccaatagtttatcatattgtgatgtcattcttgtcaggctgatatccttctgatactcctgtgtttacttactgacacatggatagtaagaaaacattgaacttaagcaaaacttacagattcaaaacttggttctgttatttactagcggtgtgtctttaagtgcaaaagaaaatatcttttatacctctcaaattttcattttccttatctataagttgggttaatgatacttgcccttattttgctagatattgtgagacttagataacaatgtatgtgaaagcacgttgtaaattttttgaaggactatataaataaatcattaatataaggttttattactagccagaattgttatctcacactcctttttaaccacaaacagccatacatattattaatagttggtgaatatttgtcatttcataaatatgtacgcaagtacccctaaaaacctatttgtaaagcaaaatggaaatgtatgtccaatgaactaagtgagggagggactagggggataaagctgttgaggaaaaagaaggggtagaaaatatgagttgtaaatgtgaatgagaaaaagagtgttgggcagagtgcaaatgcaagagagaaagagaaacagggaagacaaggcaagtagaatgcaatacaggagaggaagaggaggaaaagacagcagggaatgagaaaagacaacagaacagaaaaggcaccagacattcctaaaccacaattacctgcttggaaaatgttcagagactgcaatggaagcaagctccttgcccccaggtccttcaggaaaaatgggcctttgaacttatcttaaggaaatcttaggcagcccagtgaggaaaaccggtagccaaggcctctccacagagacagacaatgcctgctctgtgggaagagacaagagatggggacaaaaattggacaaatgaaatactcggatgtttaacaacagcacagaaaatgaggggagtaaaggggcagaggatgagcttaacatcctgtaaaacaaaacctgttgtcagacctattaaaatattgcataatttgacacgatctcactgttgttgcttttcttcactgatatatgtaataatctgggtttagttgactgctaagtcaaatttaaccaattatctggacatacttaaaaacaggacaggaattttcaagcccaagcagagttgctgctttctaggatcctgaagtgggaatggaattctgatacacaggagggacttcaaccctcttttggagtgttcccgtgctaacgttctaggtcctcagctgatgtcagtcacctctgaggatggcaaaaataaataaataaataaataaagaggtaacagcaactgcagatttctgattagagatgagaaagaattcctagagaatgagtcagtcaaagagaaacagaaaggttattaaaagggcgttccccctcccggattttcttggagggttcctgaatcacagagcacatggcctcacctatctgggatgatatagacgttccttcttagagtgggctatttgtattgctgactcagtgacctaaggtacggtcagctttagcacagcacctggaacaaagaaagtcttaggggtttatggttatcgtagtagagacagtagaaataaaatgaatagtaacagctgcagtagtagtagcagcacttgtagaagaggagtaatgctgatcttaggaattggtgtaataataccagtatctgtaaattctacaaatagctgtaatgtggtagtcagggatctgagcactgcaataagacctcctaggtttggctggttggttccatcccttactattagttgtataaatttgggcaagctaattaacttttctgcacctcaatatgaaatgcagataataagagcaccccttcatagagtggtcatatggagcgcatgagaaaatacttgtgaagagttgagctcagcacttacactcattgagcattcagtgcctgttagctagtagtagcagggatggtggtgagggtggcagcctgagcaagggaatagatcccacctaagggatacaaaataaaaggcatgttgtccctgtcattagcaatcacatgccaggaaatctgcaaacagcaccacaggagaagccttttcaacctcaaatagagaacttgtgttcttttcactctcccgtctcttctccaaatcccgtagcctcagattccaggctgcaagtgaaattcagtgtgttgtgggtgaagtttcaggggcatagagtggagatgggtaatggttattaatatccactgggcacaaaactttctatgatgggccttcaatgatgtggagatattgcctaaagagttaaaaaataaaataaaggctttatcaatgttttttaaattcttccaacattataagatgtcagactaaataccaggcatacgaagtccagcagaggaggcaggcatgttaaaccactaattacaaacaacaatgacaattataaataattgataacagcaatttgtatagagaggtctgggagcatagaggggaggtcaggaggcttgggggtcaggagatgataaatgacttcatactttgaggtgcaagtaggaaattggtgaaagaaagaggggacatgaaggctgggattaggctatagaaagatggccagtcgtctggctgaaaaatgaattggagttagggagtcaaaaaggtgtttggagatgatgccaatcatgcagaaaagaggtgaagccttaagacagcaatgacaggaagggtagagagagggtggcagagtcaaggttacataattctaaataaaacactgctaaaattaagctggtataaaaagggtactagttattattttcagagtaaaacctcatcagttcaacataattggatagaagcatgtcaaaattaatcaaatatgatttgtagctttaaaaaatacatgactaatagcttaggaatttttgactagatgagatattttaaatacttttcaacttccccactcttaattagaagcatcaatgttcctgcaaacaaaatgaggttcttagaagtaaagttctttttgtttgtttgtttggggtttttttgtttgtttttttagacagagtcttgccttgtcgccaggctggagtgcagcggcatgatctctgctcactgcaacctctgcctcccgggttcaagcgattcgcctgccccagcctcctgagtagctgggaccacaggtgcacgccataacacccagctaatttttgtatttttagtagagatggggtttcaccatgttggccaggatggtcttgatctcttgacctcgtgatccacccaccttggcctcccaaagtgctgggattacaggtgtgagccaccgcgcctggctgcaaagcctttttttttttttgaagtggatcgaacccttttgttttttcattttgttcacacagatgcacttcatgaattccaaggctggtctctactcatagcctattcccctcttactagtgtagaaagtcacaaccctcaggcttgactgtccagagaactggtctgagtctctcagtcatagaagactggttggctgatatgccccaccctcagttaggggtgtcatctgggtgattctaggccatcagtaatgcaaccaaagaaaataacatttgaagttacaaatagaaatcagacacaatttttctgattctcaggactctgtggcgtgactcaatttgttttgcaaaacttctgtcagtggtgcgatgataaaattcagttcaattcaaggacaagccatcagaacattccctttcagggaggggattttatcttatcctctactaaagtactaaattagttgaaactcttaattatcatagcttgtctaaaagtcacactaactcaatgcactatttattttccaaatacctgcacatttcttacatcataaccctaatgagtcataaagaatgtatttactatgaaaaatattagactcgattctcacatgttgactagaaatgaaaatacaaagaaaataagtcagtatgtcccactttaccaatgaatacacaacaggtgatttgctctcataagcttcctgagttcagatcagaaaggtgacagttttaacctttggatacttcctaattatgcaaaatgcttgtagtccttgcaaatgagagaataaaatgatccctttggtcagaagaaggcagagcttccacaaaaaggtagttttctggatgttaatatttggagagaggtttaccttttggtggtctagaaattgggagtcaatttattttatatttaattgaccatagagcagatatgattagaatcctccccaaaatatttcccaactgagattcacactaagttagccagctttctatagacatttttttacctgaatgttccacagttatctccatctcaatcaacatcaaactaagtcctcattccctatgcaccacacttcttctccaaggtcactttaaaaacatcttcctcttcctcctcatgcaattcatcatgatctaccggaaatgctacttcataaatttctctaggatctgtgttttttcctttactctcactctgttcttcctcctggtccttatcctgcctcccctggactactgtcaccgtttcctcaggcccctcctcttgtcaaccctgtaaccctatttgcattcagtgtcagtcatgcttcctacatgcctaacagaacttttctgtcttccgtgcagactgatagatcgtatttctgaacttccatatttagttgtctacagtgcctctgtattttctattaccaacattttttgaatgctaagaagtttgtcgatttttttaacatttaaaaaatgactctaatgtatccatttccacatacgctttttctggcattcatcttttgaggatttgaactgcagtaattacatacaatgaacagtggtggcatttgagataaggtgaggctagaaacgtcagttacactgttgatagagaaagttgagaataaatacgcatctatatttgatatgcacaaaggtatgattagtattgaacattcaaagatgagtatgttgtataaaaccttttgaaattaaatgaagtcattacaagctaaggagtaagtgagtgggcagagaagggggaaaaaagattcttcttacattctttaaaaatgcaaataagaacattgcctgaacattattacctgactgataaaatggtaatcacttagcagatatttatttagaaatctgttccaattgaaaaaatgtctgaaatttaacacaaccctatttgctaaatggtaataaaacagaattcctgggagaaaatagcaggtactaaaagtcataatatggttctacaaagttgaggataatttttaccactgttttcaaaatgtaagtgataaggtggaaagccctccagggccaggcaggcagattgcacactgaacaactgtacgctgtggctatgaaaggtaatgtgatagttcaagatggcttcctttcagacaacagggactcacagttacgactctggtaaattccagagtgcccagcttccctaaaaggattttaatccatttttaaaaccctggacaggccaaatgaacatatctgctaggccttcagtttgagaacccaagtctaaaatatcaaatgatagaccttttgccacatagaaatctttagaaaagcaaaccattgaagttcaaaggataggctctgatatcacaaaaatttgggtgaaaatactagcttcacctctttctagaaatgtgcctttgggcaaaataatgattcttctctgcctcggttacttcatatgtaatgctggggccactatcagtgagatcagataggtcacatgtttggagaaatgtctgaaccatagcaagtccttcttatcaaatgttcaaggcatcaaacaacagtgatttgatattttccttttattgtcgaaatccattttcatagatattgtcatggttgagtgacattttaatctaaattatatataccttaggagatagtttgtctttggagagttgggagataatttgaaaaaatcagtgattccggaagcaaagacttggattttagtctcaggttaatcacttattagctgtgtaggctgaggaaaaatcacttaatcctctgaaactctttttatttcttttgtaaataaagatatttatttctttatttacaaaaattgtgctttgtaggactgcaagaagctacaagtcataggcaaggctccaaattatagaaaggagcttctaagaaattgtaaataattcacagcttcaatcacgtttcttgaatctcatcacagcctgtgcttgcaaagtgagacaaaaagacacagtcttacaggaatccaagtgacccttccatctagaccatgctgtaatcctattaggtacagaggtaattctgactgggcttgagctgagagtcataaagatcttgcaattttttttttaattaggcaatatctctacccttgccaagctatttgcatccgctgatttgcacaagtcctaataaactatgtaaaaaatctcattaaaatgtgacatttaaataaagattggtaataaaagaagcaaactgcagggaggaataacaaggtgtcataagaaaagaagccagatacaccagggttgactgagcaacagacccagaacgatgcaggtcaataataattctgagaacatgtaactgttgatactaaaattcatcataacactaccctctgtgtgttccagggaacaagattaggtctgagaatttgaaatgctacaatgcttgcttctgaaatacttctatctcaagcaattttagtatggggcccactttgatcaagcatgacatggaaggcatactcttctcacttcacaggtgaaatgatgtggattttcattatcaaggagcttctgctttactaaagtccagggggaagctttgaggcctacagactgctcatttagcaggctgtaattcaaagtatgcctcagtggaactgatagagctggaggctgcagaggttcagcttggcaagcaaaacaaagtcaggacacttgggagcacccctttcagtaataaccaaattctctaaaacaggtggacaaggtaaactgcacaaaagactgagcttcctgcagtcaagcagattgagactcagatgcttatattaatgccgtcacatctgcaccctcaggtttctgaagccgggtgaagcagcctccacagcagtaagttccagaagaaaccaagcttatatagtggggaagctgtatctgttatttgccacagtttttatgcacttatatcaatcaatgagagccagaagcctgaaaactatatttttcagactttcttgcccactggcttcaggttatgttttccaaatgagagattcaacatggaaatttgggcgatgaggtgagaaagaggagtatatttcttctctatttggaggtgctttaagcagtaagagcaacagcaaatggttccagaaatgtggcaatggttgtgcctccagcagacccataacagcaaggaggatcatgaggcttcttgacctctttaacatctccttctccctgctctgccatggagctctgtgacctgcactaaatctccgtttgcttaaaatatatacaacagtttccattttcctgcctggacactgacaaatacaatagcagaaagaaataagtcaggggtattttcttgtaaacaggggtcaccaatcaagggaatgattgcatataaaggagagctggctgtatggaatccagcacaagaccaggagtcaaagagacacaagatcttaacccagatgctccaattcccaaacagaactgtgtccaagtccatggaagctgcagagaaaagagaaaatggtgctaaataggtatagaagaccagtggtttcattccaactaagccacttattagctccaatattgaaggttttctgtcatctttgggagcctttgtttcctcaccagagaatgggtacagtcagggataaatattcaaacaatttaataactgatcattaaggtcaaccaggtaagtagatggatactaaattgaaacaatcaagaaacttatagcttatagtaattaattatcagtttttgggtaataaatatctacctctcatgatactcgtgatgactaaagacacatttatcatttactctatgcatactatgtgcaaaatactatgttaagaattttacctatgtttttctgaagattacctgtaatcttaagaaaaatcccattttcagacaccaaaactgaaggctcagagagattacataaattcttcaaagtaatacagccagtaaatgggaaagtcaagacttgaacttatattattctgtttccataaaccctacttttccagcatcccatggtgttggtagttgaagttctgttaggaacgcttcagaagatgtataggatcacgtatatgtagaagattactagcttaattccataaccagaaaatttcacacattgcaagaggccattgctttcaaaatataaatgtatcttcttccttctagtagtttgtgatgcctctagcttgaggttccccataaccccaagtggcacaggggttttcaacacaagatgagtcccagctcatattcactgtattcctgatctaatcaaagtactaactgaatagtcaccattttgtcagtcaagcagtgaagttgagtattattctcatttacatttctaaagcaacataaaaataaccccttttaaatggtacccactcactttctccttatatgctaacgaatgtcacaatttccgagcctgaagagagatttcctgcaaaacacctaaatgccttaaagttgcacatgttcacaattctgactgccaggttacaaacatgaattgactccagttccaaatcaattccacatcgataagtctttagggcaaacaactaacacacattgattttttaaattctataaattatttcaaggctttagaatattcagcattaaaaattaccatttcatttcaggctttagtgaagcataatgtgtatttttaccagtattaatcaaccccaaaatcaacttttctgtttaaaaaatttctatctttttctgtttgctaagattggaaaatttcaattcattcttgtagttacattgatatccaatacatttaatttcttgatctaaagtaatgaattgtgacttggtgtcatgacagaattaaggcaactaggtaattaatttgaagccaactactcactttgttatggtttttaattaatgttgttgcatgtgtatagcaggagactgcttttatataaatattatgtattttatatttaaattattcaacttttggtatttactcagattttctgtgttgtgtataaaagcttgccagtttgatcttcagttaaaaaatatttagtggctccctagtaccgtcatcaagcctaccaaaggaatcaaaaagaaagattctttccctggaaaattcttctttcttggatttctttctcactttcctccttcttcctttacatccttaaagtggcttacaaaaatgatcaatacattatttaaaaagcaaaggaaacaagacgaagcgattaaaagggttggaaaatatagtaaaggcttgttagagccattgtacacacctagagatcttctacacttattagtggtgattataaatttgtctctcagtttcctagaaaccctagcaaagggcggaaaatgctaccatttatatgattcataatcctataagatgcttttctggttgctaatgagaaacattaataagaaagcacaacagtcatttcgtggagaagaagccgatccttaaatgaggttgttcttattaaagaaggaagaagccccagggactgcagggtcagtgaagcaagaggatagagagctcatggggcagggaggtgagtcaagggtaggcagaagctaccgttaaaaagaaccaagacataaaataaactttttctctgctcaaagcctggaggcattgtcttgagaaacctccaagtgcaagtttatatacaaatggactttccttcacctgtttatctcctgtctgaacattgtactctctggaacttaaaaagaaattgattgaaaaaatttcttagaaagcagaaactttcaaattataataaacagccagaaaaaagagacagaaacctgaactgcatttagcgatcacacttgaactgaggaaaaccacgtgtcagccgggagaatctggtagttaaacaacatcaaaagcatagctgtttctgaagtcaggcattaagtgttttagggctgaattaagtagggtgaggcaccagcaaggctcattccccaaatacaagccaaagatgttctacagggtatctgctgcaaaatcatcaaagccagtgtttccatttttctttcttcaacccttcaaaaaaaaatgcagctgcctcctccggagccttgaggaggaaaaaacagaccaataaaacagatcaggtgggtgtcagattgtctggaaagagctgcctgttgactgctaagttggctgacactatttaccaagggacaggactcatcaggaacttgcctccccaaccagggcctgattcactgccagcttttcatcatgattcaatccatcctgcatcaactgctttctctgctatggagactcttaagaggaaaatgcttataatgcttctcatattgctaaaatcaagacctagtatgacttttcttaattttaccttatagttcacagagaacatagcgcattgtatgtatcttactattagaattcttttttttttattatactttaagttttagggtacatgtgcacaatgtgcaggttagttacatatgtatacatgtgccatgctggtgtgcgcacccattaactcatcatctagcattaggtatatctcctaatgctatccctcccccctcccccaaccccacaacagtccccagactgtgatgttccccttcctgtgtccatgtgttctcattgttcaattcccatctatgagtgagaacatgcggtgtttggttttcttttatcaccgtattaaatactttagttcagtgattgtcatctagctacacagtgagatccttaagcccaggaaattgtctccctctttctgacacaaagtgtaggtgcttaattattttatagtaaagaaataaaggcaatctactgacaatttcttcctgtggttggccatgattgcattttctaactttcctggaactcccaaagttcttttttatgtctaatcctggtcctccagcatttttcatagtaattctttgagcttgtacactgtaactactcccaaattacctttgattatgttagccagagttagtttctgatgtttttagtcaaggatgctgacagacacattgtagcaaggaccaagctgaattagaaaactcaattaaatgacgccaaacaaacaaaaatgaagtgagcagtatggccggacaaaacacttaactgtaagacattttatttaatagaaaatgtcaactaggaccactctgtctcttgacatctggggaaaattgactggagcccctcaattctagagcttgtggaagtctaaagccttctctgagatttctgaaatctctctagggcatttgcagtctcctgccatcctgttccttttgggtgtccattctcacataggcatcctctcttccaaaccccatttaccaacacaggaatgtcagacatctcagcaatgtatacatagacccacacacaaacattcacatgcacatatgtattgaaataaaatatcatataaaagaaggcaatgcagttttatgaccttgaacaagttattcaacctccttatgtctcagttgacacacatggtaaaatagggataataatgatatggagcttgtaggactgctttaaaaattaaatgggataatactagtttatagcccatgctgagctcacacattcaacaaaagaaacattcaacatgaattcatagccaagctagaaaattttcctgaaggactgagtcctcggagaagtcagcacacacattaaagaaaaaaaacaaaaagatatgcaactgtactctcaaagtcccttacaactaatgttttgccccttcccaaacagagcccagattctccttctctgaatcatgtctcctccaaactcctcccttttccattcattttcttctatcttcagagcaagtaaaaggattcttttcctgggctagaaacccaggcttttcaattctcaccttatgtaggcacttttccaagtggggacatcccttatcaaagaagaatttctggttcatgcttttaaaataataaaatttcttcttgctaattacacctagaaaaagggtgtctagactttagtcatttgcataatacccttgtgatttttttaacattcccttattaattaatataaaaatgcataatatttttaaaaataaacctacatttacattttaaataaattaatcatataaggaaatatttttcactattataagtggcaaaatattattactcatcctaaggaggtaacctcaaaataaacatttgattttaaaataaaaatattgttggcataccacctaaattcattatgtattcctaacaattcatgcatcacaatttggtaaatgtgagcctaaaaacatcttttattatggacattcaaaggctgtactgagaggacatgagggaaagtctgtggcatttgcctgttattaatattgtggatagagagggggagtgggtgaggagaaacatatgttgatgggatctggttagaaaactgacagagaagatggtccagagacaagattctggggcgtgatatcatcttgtatcctgcactattgttccacagcacccaggagaatggctaatgtccatttaatcaaattgtattctgctgttagaatctaatgctgctataaataaatgtttaaaagctagaaatgttacagctcataatatctgaattattcccccaaaagtacattttaaccaactgatccagtttgatacagtgtctgaaatttaaaacaatattataatgtgtcaccattgatattgctcactctggccttttaattaacaaaaataaaattgagattctctgcatttcactctgctttctctgggcaaataatttcacaaactttagaggaaaattaaagacctggcaccaggtctggcaccagcctaaataatctatgttaatgtcctaagactctgaaccaagtcagtacatctgggaaataacaaagtccacacacttttattgagagtgtaaaatgttttattgctaaaaatacagtctctttgtatatctatatgtattagaacacaaccttatttgaaatatatatattacaacaatgacaaactgatcaacatctctttattaaatacccaccatgtaccagggattttgccagggatcatgaaacacattctaccctcaagaaattccctggttggggtgacagtacatcttggcaactcaagtcatattacactagagtttctgtcaagatatttgacagctccttttgtgatagttttctactatgtcaaatgcagaggcacaaggcccctgatctatacctgaaatatacttttctagaggtctcaagtgaatgaaaaacagttcttgtgattacagcaagaatgtattttttaggatgtattccagctactgatatctatggataattctcagcctcaaatgccaattcataacattgaggccttattgaatacacttttctttgtactatttgattgtgccaaataaagcaatcttttcgaaaagaaaatcttccctaggagtcagactactatttcatctccaaggcttgcagaaaattacaggaaaacaaatcaaaacgaaacaaaaaccatttagctttatgtaactataccatgcaaccattatgtcacataatataataacctagttgagaaaagaagtggacaaactagaacctgctataaaaagcaacgtgaatttgtctcaagtttagatatacagatagatattcttaagctatttttacccctacttaaatacatctttcttcctattacagagatgaatatctattttcaaacatcatctccataatgcagacttttagtataggaagctggaaatgtttacagtcatattacgtttttcatttaaacagaaatgacaaaacactaataatcaaacagtactgtgaacatgattatatatgaaacatcaaagaaaatccacatccattaactttataactctacaacaacagatttttagagtcttcatagcagaaatgttctcagtttacaacacaatatgtacagaaaggtaacatacctcacattagcatcaagtttgtccattacaggaaataagcatgagtgagttggatttcaatgcccacagggtc

SEQ ID NO: 1247 - DNA, 186030 bp, Homo sapiens; identical to SEQ ID NO: 1244

SEQ ID NO: 1248 - DNA, 1021718 bp, Homo sapiens
gcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtaagtgacacttgggtccccttattctgtaatgtgtctttgagatagtgggcaggggagtgcagcaaagggtctgccattgactagaatggacgaaaaagataaaagagaaggtgacagatatattgcctatattgaagatgatttcagggagacgcactctggggtacaggagaggtgagcctttccgttcccacctatttctgtcccttttaagacagtttggcaggtgcgggttaaacttgtctttaatttctttaggaaaagcaagatgtagctcttgttctttatgctttgcattcctattcatgtaacaacgtgattgtcacctacaatttaccgtacaggttgttaaacagaggaatacggaattttggacttttcttctctatactaattttgcagtatctttgtttcttcatagacatgttttttttctttttttaaggaaaatgttgtctttaagtataatgctctaaaaaaaccactgtttagggcacatggtatccttacaacagtctaatttagactgtttgagttttagccacattgagtttttaaagtatgcagattgaacaaaaatacttaggtgaactcagcaacaccattgtcatagacggaaccagtaacctttaaatcacaattaacacagacaattccaagaaaaactattctgtcttacattatgcatattattgctcctgaaatagatactgttgtctgatcctataggatggagaattctatgtactttttgaggaatgttgtacagttgcaaaggggcaaggaaccaataatggaaaacgtcatgtctctgaatttcaattccctaagggcaatggaaggagggtctgagtagagagttgagaggtgaaaaatacaccactctaagtggttaatttgaggtaggagctacttgctcacacttgtcattaaatatatttccttagaaagtataaattaactggaatagtcatgtccgttttcaacaactgtttcataaaggttgaagtgactacaaggcagaagatgtttaagtgtccaatcagtaaagtgttcaaaagagcaaggatttgccattgaaactggcagaggaattccttaagtgttcttgtttatcagttgtcgtgaagcccatgagtgttagttattgctgctttgtttaatatttagctgaaacagtgctttttgttgtgtgttgtcttaggatgtttttctttcccctgaaagttatctgatggtgtctattttgatctgtgatttatgcgcttatgcacttggttgtaagacaaagatggaactataaatgtaattttcagaatgtggtagtttctcaatgatgtgtaaaccagtttatttttctgtaccacagattcatataagttttgcaatgaaggatttttactcttaataataaagctaaccaaaacaatgagggagtttactttgttaaacaacccattaggctaagtctgccaaactgtataaaggttttcaaaacattcttatttttatatattattcagaaaaagaatacatttgctgattcactgtgtgaaagcataaaaatgtgagaatgagtgggtgtgtagatcattcttatgctcttttcgatttaaaatttgaaaaatgtgatttaacttctaatcatgtaatataatagggctttcttatggcaaatgtatgcactaggtctgtatgacattttgtgtgatgaatacaaactcctcaagaacttaattttagaaaaacataaatataccagtagggaagctatctattcaaagtagaatgataaagctaaaggttcctttgtgtttttatgtgctcacatatgtgtgtatgtacatatgctcttgagtacatgcatgcatccatacatacaatggtgtcttggagagttgcaccatcacttatgaaacagaaattctgaattataattaagttctctaacagaatagacgtagctgtaatacagaagagcacaatctaagtaagtgtacattggaatcctaaggagtttttatattatatgagaatcatgtgatttttcccattcagactttatgtgccaccaggctaatataattagcagccatgttaacgcagatgcagaacaaaaaacaaaggacaaagaaaatgcaattgttttgatagggtgaaatgatcacacctcaaaggacctcagagattcttggtaattgttgctttttggaaatacggtatttgattttaaataaaataattcttttgcaaattaatagttgcaaagccctgcactaaaaaataggtgggtgtgtatgttttccttttgctctcaatagatttttaaaaactttttatgtctttgcgctattatgagtagattgttttacaaataaaccaggtttctagactaagttatgactcatgtaccattgactgaaataaaagttaacccagttttgtttacttctcaagtgtttagtatgtgttcttgtaacatttgggcatcttttttttggtaactgtacaggaaaaaaggccaaagagactctaagttagaaactttattcagttgctttattatgtgacttgattaaggttctggaaacattaatctccagtcctcggagcaaagtatttgtattttaaataaatttaagggaatatttacatctgtaccaatttgcagctaatcttaggagaggatgaggtggcttttggtattgtggatatggtgatctcatttattaagttattatcagaccagacacggtgttttgaccatttaacaattgagggacagaggcagattcttcagagacatttacctgtcagaattctatatctgtgctttaaattagttaaatatacatttaatttaatgtttggcagactacaagtattgataaacatatactcttctcaaaaatcaggagatccgtttataaaacaagaaactagaattccataccatagagattcatacaaaacttccattttatgaaaaactgtttccatatatatcataaattaaaatctttgagttgtatggttatgccaacttcagattttagggtgattcctacgtaaaggagtatgatctctggaaacagatttattccatgtgcagaatccagagcttaagctcataatctcaagaaggtaattttctttttatcattgctgtccttaatactcagaaactgaagatttcagatagtaacaaaaatcatcactgcatttgcaatggtggatgtagtggtataggacaagaagtttttaacttcttatttactatttgtaactttcaacttgtgaaagttttggcatgttttccccaatgtttgattgaatcagagttcttttataaatgtggaaaaaattactctgatatctctcagtgtgaaaaaatacgttaaaatatgaaagaatataacttaatttagactgaaaggacagatttgttttcaagtaaggaaactcaaaatcccctattttgtactttagacttctgggtggcacaaaacatgtcataaactattgaaagaaagtttagatttacactccacagaataacacttgaaaaatgccactattgccatgggctgtatgaaatattgttaacttggagcaggtgcaactaacaattaggttagtacacattgtgtgtgcagctgtgtgaaggagtacatttgaaacttaattaagaatgatcagttactttctatcacaggattgctaaccattttcaaaggtacatattttttttccttaagatgttgtgagtgtagactaaattaaaaacaattttattataattatggaatatttcagtgatcatgattttatgcagtgttcataatcatgtgctattttattactttttagaaaataaagcgttgctgtgaagtagcttgaaaagtgcaggtagaatcttatgatattcctggtatacttctgacaagtttgacggtttttcagaagtttataactttatctgccacaaaacttcctggctcagagaattttaactttttaggattcagatgccattgatgataaaatcttgaagttgttaaccaaacttactcatgaagaagactgaaaatccccatacaatactttagaaacttatcatgtaaaaatatgttgagtttgctaagttgtaaaatgataactttcttctttttaaatgttttctatttatgcatcctgaatattgttgcacatggttttgtttttaatttattctcactgtaattcagcactactcttctctgccttatatataccaggagatacctagaaacttcttccagtgtccaactcttctttcttcgttcacaaagcaggtagcgacttattttcttgaatacagctaaagtttcaaaaagtcaacccatgtggagctgttctcctgctttctcaaataaaggcttggatgggcagcattttttctgcagagtgccagagtcatctctggcatggggcccgtatgtgggtaatgacccagaaatgcaaatgtgctttgctacctcctttccctctgatgctgctttactttgaggtcagattctctacttgcccagtcaggaatttcagagtggaagtcagggattccttaaaataggaagtctttattttttgttttttatttttaatatgtgtgtgcttgagagaaataaaatctgagagacagaaacatattttaacatttctatgttgatcctggaaatataaatacaaaagttaatggcaccaattgcattaaatattcgtatatacagataatgcctacaattccaaaggttgtatttcagttatgttatttggtagaatttcaaacagtgcagtatacttttttcataagcagttttgaaactaatattgctattaatggaaattaccctatttccaataacatacaaatgtcagaaatgaaacacacacataggaaaaatatttgtttcccattttttttctgatataatgaactcttctgatttttgttatttttttcccctcatggaaacttgattgttgtttattatcaatataataaaatacataagccatcaagatacaatgtatgtagggctaccttttttcatacaatgatagaataagtactctatttattcctaatttctataggatggaaataaaattatatgaagcatttgttcttaccattcccaagagattaaagcacatttaaaaattatgaaggaacaagataaacttctatatcattttctttctccaggttatggtagaaatgaagtttataacttggttttctcctcttttagtatttcaggagttcatattttgtaatactgctgtgcacatgtgcgcacgtaataaatttgttacgctttttcttttgttaaaaaatacttcagttgtgtttagatataaaatgcttaatatataaagaaattactagcttcatcttcctgaaataagtatttttctttttctttccttgaattataaaacaggcagtgggtctagcttataggaatattctaagatttaatcttatgcaggtatagactctttttgtttttccaacctgaaataagaataaggtgacttcaaaagcttatgatttttaccctttcagctagttgtggatcacatgctaacttgatccctgtaaaaactccttgaaatgctacatataaactgatttttaagtgcattttgaaataaattttttcatttcatacatttttaaataatttgttatgcatttaaaaatctagttttataaaataataatgaaaactattatttattggaagcttgttcttggctaaatatgtttttttttccccccactgaatcctctctggtaatcctatgaggcaggtaatagatattaatatcctcactttaccagggaggagatggaggccttgaaacgttaagctgtgtttttaagtcatcctcttagtaagtggagaagcttggattcaaacccgggtctgtctgaatctcagcctgactctgaacctgtgccacactgcatcccttccatgtaaaataaaactatagcagcctctcatgttttttttttcttaaagaaagtaagtacctacctactaattccttagtgacccattagtcaacacttaggtttagagaggtggggttgattgatgtcaggctcctgtccaaacctgaccgacttaggtaatcttggggtttgacaactatgagcagctggtgtatggactagagaataaaagggcagaaggggaatctcctcgctgcagagcaagtatccattgctgttctcatgcatttgggccaacttttgacagataaccatgaaatagggtcttggaaatttgatatgtaagcttaaaatgtattatatggaaagaaaaaatatattcttttttttttttaaatccagctctttttaaaaccactccttgatgaatggccagtgcacagtattgttatttgcctgttttttgtttgtttgtttgctcgtttgttttttacatgctccaaatcctaaattcatccagaccaccattgaccaataatatttgccataattattgtacttgggaagaaatagagtaaatatgttatttaaaatatgtgttgaatatgcttgaacacattttgaacctgagtgtgcatcagaatctcctgcaggatttttaaacatagatttttgggccctctcctagagtttctgactgcagaggcctgggctaggaccagagaatttgtattgctaaggaattcccagatgatactgatgttgatgatcaggcaccaaattttgagaactactggcctagaatatgtgtcttcacctaatggtgttacaagagaaagtgaacctgtttttgaaattcttcaatccaactagataattaactaaattcttcctatggccttctactgatatgagagaaaacttttcttcaggacctatttctgacttttagcttagttctattcagaagtttaaataggagaaatgcaaggtctttccagcgcgtttgtgtctttgtaatgtattgaaatatagaggaatctgaaagcaagcaccctcatgtctggtaatgctagaacagaattggatccttcacctgcctctctttactagcctagccactcattagggtaagcacagcgctggggtgggggttgtgggggggtgggggagagagggagagagaaagagagagagagagactgaaaaagtactgggctaagttagaagctggattttaatataccaaggagcttagtgcttctgtattgggtgactaaataactatgactttgcttgagacatttatatttctgggtgctgtttcctcatttgaaaaatagggcaaataattcctgacctatttaccctatagaataggagtatctaggggagataatatgctaaaagttaacatctttacagttttaatgttttaacctttcagaacagtccatctagtgagcccaggagtagttaaagggaagtttatggccaatggccctagttagaacaactagttttttttcatagaatcatttttttcttcacccacccataaattttgtgaggctttataaataattaaaacactaggtacaggtagtttgaactagataatatgctatgcgcctgatatacgtactttaagtattcattaaaatgaaacttggattttacaaacaagtcaacattgttcttcaggccagtatttctaaaactgtgttctgtggacactagttcagcaagacattctactgagcaagaactcttatgccccccaccgcccccaccctcaagggtcacagtgcatattagcatattagcagctacaggaagtcctgcactaaacctctgcttaattccatttaactcagcaaatatttacagagtgcttgcagtgaaccaagaaatgtctttttctgatatcccctattaatcttccatggaactagcattttcagcaatacttttcagtgaaatattactccaggctaatgatgcagtctacaagttaatattcagtgattgcctacacaatatttaaaggttaagaattcagtacagaaactcaactgattaagcagatatctaacaaataatgcataaagatatttaagaatatagaatattatcaagttattaaaacaaatgaatagaaacttgttttcagatgcttggctattttatattatatatgttcacttgagtttcttgaaattatgtttcggacactaaaatcaaaacccttaactgaagctcagtcaagtccaattgctgatgttgcaaagaggttgacatgttgcagtagttttggaacttctgatatttagaactccagaacaccttggagagggcatttgcagaagcactttcgttttaaggcagtggatgaggagcaatgtctgtatcctacatctctaggcaggctagcttttccagcatctcagcctacatatttgccttaggcgggggagtggtgaagaatcctcatactgacttttgttttttaatcaatgcattacactctaaaacagtaacacatttaaaacccccaacaatgttgcattctttggaaacaaatgagtcttagtttgaaatggaggaatcaaattggtacaccctactcttaacagaagtctttgtgtgcatctgtattattctaattacacaacagaataaggagatatttcaaatcctttaactgacagctgtgtatcaaatgatggaagggtctatgttacatgtgaactgttcggtggtagggaattcatagtatcctaacctacacgggcttgcagccataagagttatacaaggtggatcacccagagtgttatttgtattatagtctctgacaccacttggaaacaaaagttataagaacctctgcaagccacaatgagaagagaaaattatactggggtggagtgctgccttctgtggtcttggcctctggagaagggctgtgctgattgtcccgggattgagcacttcttttgttaatggcacctgcagtggtggaaggcaccttgatgctgggaatcataattcatcccggtgggcatagtgattctgacctcactctcttgttagtctataagctagcgatcaggtaccctataagagatggcatatgaaggttttacctgattgctttgaagtgcggggatgatattagggtttgtggatatgtttacccctagttattgggaactgttatagaattacatatttgaaggcttttagaaactattgtagatttggccaggtgtgatggctcatgcctgtaataccagcactttgggaggccgaggccggtagatcacctgaggtcaggagttcgagaccagactggccaacatagcaaaacgtcatctctactaaaaatacaaaaattagcggggcatggtgttgcgtgcctgtagtctcagctactctggaggctgaggcatgggaattgcttgaacctgggaggcagaggttgcagtgagccaagatcatgccactccagcctgggcaacagagcgaaatcccatctcaaaatgtagatttgatgatacataggtggtatataaagagctctggacctttttttttttttcgtctttttttctgtttaaataaaacttgctcacaactttagtgattagtgaacctatagcctgagattttctcaaatattggagcaatgtataggattatgtgtttcttacccttatcaacaggaattaatggagtttcatttttgaccatgttttataaaatgtggttccattttattcacccaaaagatagtaaattacagctgttcagtagtatttatgagtttgccttttctatgcacctggaattaaaggcttctttcattttcctacaaggcagggggtggagggatgggtggaactcctgaatgttcaaaagcaattaagtactattctacttaaaacaatgttttaacattcattgtgaattggaatccacaataaatcaaattaacgaatgaattcatagattaattttcttaagaacatatttctggttttatcaaaagcgttcttgggaagtttcacaggctcttagagatacggggcaatgcatttttagtttaccattttatagactgccctggaatagatttatttttattcagaaaagctgccttaaaaatcaggcaaatagggtaagttcagtttacatttagtaaatataaatcttgcaacaaaaatatgtggtgacatttaattatattcctcttttattataatcctaaaggtagacctgtggttttcactttcttttcgtaagaaagaggtgttaatgatcactctgttactgtgcctagctttactcacactctgttaagtaccttaaactcatgtcatattttttcccttacattgagagaaataaaccccaatgaatttttttttgaagtttacatagtgatttgatgcaaactttacacacaaactagggtcattgcatatttcctactggtaggcccatcttttaatttaatatttcataatgtgaataaaaatttacatgcaatggatgaagagccagacgtgcaggccctgccctggatgttgggagccgaagaccctggaaaacatttgcctggaatggttcttagcctgcagtgctgtgttgcagtcatgatcatttaaaagtgaatgaagtaatgaatgaatagtgggaggaaattaagtaattactaaatcagcttcatcaagtaggatttatgaaatgtccacatacgaatagcataatgaacatgtgctgaataaattgtgtgtttctaccctttggcaattaggatatgatgtaactgaaaagaacgtcaagccgtgtttctatcgtaaatctagtatctagtggttttaataattcaagattagtttaaattgcaacctgttctttatcatttatttatttattaagccatattacttacttacttatgctagaagctaaacatgctttactgtctttcattcattgtgtactataaaatcacatttatacttactgtaaataagatcaattttggtgagacataaatgtggatgtctgggtcattttgccccattttaaagtgttaattcatataagtttaattcatattatctagcatttgatgcacttgatgcaacattacttccaagagttttgttaaatcagaacgtaaataatgaagttaatattgtctttatttttcatatctctagagcagtagttttgaatgttttttgtttgtttttagcttgtttggcatggaatcttgcaaatctgaaaaaagctactaactctcttaccaggaaaatgggcttcaaaaacttgtgagctcaatctatgaaacttagatgaaaacccctagtataaattcttaattttttttgtctgccatttcatgaagagcttctgcttatcaacaattttgattcagttattttgagctcaggaaacatttaagagattatatacatacttgatatatacaattatatattgtaaagatatatgtatacacacacacgtatgtgtatatagtgtgcaagaatgtgtgtgtgtataatgcaaaatttgagaacccaggagtagagttggggaatagaaccaaactgacctctgtcaagcagattaaatgtggcatggtagatataccgttaatatagggcagcatgataagaacttaagataattaagaataaaatacaaaggaaatttatgggaaggattatttatctcctcataggttgatcaaacaatatatgtggtactagtatacgatagggaggatttctatagctagagattgcaaaaaagagtatcccaggtggaagaaatgatggtagtagaaaggtgagaatgaaagagaatatatgtgggacaatgaagggtccagatgaatggcaagtagggaagaattgtgaggtgacttagggaatggaagggataggagtctggtttagtctggttcatggttgaacttgagctccttggaaggagtttgggaccttatagaataggatataggtctataggtctctgtagatgttaatcatcaaggcgtatgtcccagtgccctacagtagaataagaaacaacacaatgtgagagtgaaggcttggggtttggagcaagccctgtggggaatgtgagggcaaagtagtaataaattaaaagattgctaaactgcttcaaagtccccggtgaaattaggtggcaagcatttgtaagagaaccaattatttctccgtcagcacccaactttctaagaattggaatgaaaaagcagaaaatggaagttgcagggcttgtgagggcttatgagagctctaagatgacagtgagaataaaatgtctgagcacaggtaggtgtgggtgggaaaccatgctgtcagaatgggaaggggtagttagatgattgaaatgccaggcaaacatttgagaataaggaggtgggtacagcagaagtgagacactagaagaggtgagaggtaaggtggtggtggtaagagacaagaacagaagtctagatcttgaagaggaacacttcatggatgacgcaaggcccttgattggccacctaattggtagagtgtctagttattgagaaggataggaggcaatgaagctcagctgttagaagaatcatcattgtacattttggttttattaaagatgcttggaaataagagacctaagaggaacacagtgaggagagaaaaagattgttctgggggttgtatatactggtgagagtttggggagagtttggtgtaagcagatgaaaggagctggaacagaatgatgtttagggaaagtctggagacaactggatggtgggggatgattttggaggaatagaaatgtttgtttaatgaatatgtgaatggagtgattatggaaagagtaaagtaggcttcaggcaaagcatttttctcaatgttcacaacattgccattttggaatgataatgataattatttgttatgaggagctgcattgtgtattataggatgtttagcaacatccctggcctttatacactagttggagtagcatacaccccgttttgacaaccaaagtgtctctagattttgtcagattgcaaaatagtccctttgtcgagatcctctgagctaatgtaaagagctggaaagagcacttagaaataacaggacactttcttcagaaagagtttgaattgtccagagggcagctgaggagattgtgaagggaaagaccagactggagcctgacggttgcagacctgtgagagtcatgctctttatcccgaggcccgtgtcagaatcatctggaattttcaaagatgtcaacaccagcgccccttcctccatccctttgacctatgaaaacggaatcttcagggaggcaacccagccatgtagccattttgaaaactccttagattattttggtatgtttctaagccagtggtaaatgaggagagcaggcacatgaatagtgggtatgaaggcatggggaaaaaacaggatgaaagtaaaagaagattggaaggtaggttgagacatacattaggaaaggggggtgctgaataagcatttgtgggagtattgactggagaggcaatgttgaatctagatttatttgaaagctactttttatggtcaattatgtactcaaccaagccttcagtattcttggctgttttactcagtttagtttgagccaggtggattttatctaagactcagtgaatgtcacctttcttttagtgccagtaaaaaccgctgatgaatatttgacacttttaatttgtcttctcccagatgcaatattctgttaaaatatgcatatagtatatgtttcttcatgaaatgtcttaaaaagatttaagataggaatgcatattaattttcagacatataattattgttgacatgcaggacaaacacgtatttctgaatgtagaagttttaggtccaagtatgagtttttaattcaataaaatatgtggataagagttaagaacaatgtgattgtaaatttaaaaattattttttagactctaacaaattttcagacttcttgtggaaacacacacacacacacacacacacacacacacacacacacacacacagaggaatcataaccaggaacttctgtttgaaataatattaagctattaacattttttaggtgatcccaaacccaagaaggttctgcaagaattttaatatttgatatcctaattcaccagaaggcccagttattgccaaagaagcataataaaacagcagagatttatctttttaaattatcctgctgtataattttgcttgatccaatttgatttccttcggtaacactttttggtggactctaatttgcatgcctggagaaaggggagtaaattacaagacttcttgaaggtccttttaacttgatggttttatgattaaatcttgcatcttaaattgcctttctctggaagaaccaggcatttccggcttcatttttgtgtagaggaaattcatatatcacctcatgtgtttttctgtaagaaagaaccagacaaaatagcagtaatagaggcaaaacaaacaaacaaaacgttataaacttagaactagatgtagatgaggcttatcttatttgcaattctgcaaggatgtacttgggtccactgaaagtgcaggtgagtggaaaggtgtgtgtttgtctgtgtgtgtgttaagtgggtgtaggatgtgtaggatgtgagcaaagggggaatgaaaatgataccgttcataggtgttaacttcgtcaggtgttctggctatatgtgagaagaggaaagtgggttaactcagaatacattctttatttcttagtatattgttcttctggatgtggtaggttttcaacaggtctcgttaatagataatctgcagtgctcagggtgaaaagcaggagtcttccatctgtatgcctcgggaatagtatcaatgcagaatgaaatacagacagagattggagaaagactactgtattcacttgaagccaatggaagtttaggtgggcccgattgcaattatcccccattggaaattagccaggacacacattagtgcatgctactttctgtctagcctaattaaaggattgttgagaactaacaaagttggctgacttgcaaaagtcagtgcttgctaaaatttgtaagttataagtgcttaacaatatgacctgatttttctgctggggtcatcttattaattaaagttttccaatcgtctaattagaaaatacagtctgaactgagtctggaggattccgagtcttacttgctaatttaaagaaaagtggaaggaagaagaacagctcccaattaaagcaacgcaacggaaagctggttctggacatgcccttggagatgccccataccagcagggtaattatttaggatgcacttccagtaaagagatgttaaagggacaccagtgagtagcttttaaaagtagaaatctgtgccagtccccaaattaactcttggactagaatgcaaagctggaaagcatgaccagcactacagatttatgagaaagagtttgttcattgcttcacaagttatgcttgatttttttcagctccaatagtactttcttaaaatagaggaacgaaaagagcagtttgataatgttggtatattttagatggtaacctgacactttaaaaaaggtagataaaattctctgtattttctaaagataaggtcctggaactgagatgtcacatttaagtccttaatagcctcgaatttagttatcatcagcgtccttgtaataataccaggctagagcagtactgcattcaaaataaaaatctttcaaaacaatccaatcaacatctgctatgtgccacccactggactaagcagaaagtattaaaagaaggacaaaaagggtgtggccaatgcaaaggatacattgattagtgtatatatggcagttcactagttactcagagtttctgattctcctgcttacatagctaaatgaactcttagtgtttatatataggcagtagaaaatacactactgggacagagaagaaaataaattatttctttatgatgaaattaaaaggacagaagataacttttaatttttgttggagatttttaaataagatgcctgtattataagtggccttgatcagttctgtagacacatgtttgtagatgcacttcccattaatgtggcagcaacagaggagggtgtggtggaaccagtatgctccctctgcctttccatgctgaccatccagatgctttacagatgaataagtcaagccaggatctaggtggttgtgccagaccagaatctctccttgccagccattctgtacatcatgagtggagatcacaggtttaccagaagtatatttatttatgtatcttgtaactgaattgaatttgttaaaatttgatacttgcttgaaattaattgggatattgttgccaacattttgctatttagccgtacccctcaatgcttttgattttgtttaaagcctataggaaaatgctacctaacttaaaacttgaaacttaaaatattactcttatccattcgtctgtaagagacttgcaaataagacatgtcaagttaaaattgcagttttaggcctcattcaagaaacaattagaatgaatatatcacaaaccatagcggggaaaacactttagctgtttcacaatgaattggcctcagaaacaaagcagctgatggtttacaccgaggacattgatcaggattcatttgggctgttgctattgtgttttaatgagtaacattacatgccagccaatcacatgtcactagatcattatacaaattgacagtttggaagagtataaaaaacgctgacctgaaaggggaattctgtagaagtgagacgtagccactggatatttacatcatttttcttgttgttgagaaattgaaataaccctttaatgaaaatggctccttcatattgtctctcactattttagatcaggcatcttatttttagtttggagaatgagaacagctggtgtcaggccaggtgctgatagtactaatgttgatgtaagatgctgctcaaatggacagtgcaaagggaatcattgtcccttgatttgatcatgctggctctaaaatttattttttgatttggcatttgactttgcattatactcagagagttggaaatcacaaagccgtgcagctgcagagtatatctagatatagaccctgtaacgttacctcataaacccagcactcagtattagcagtctttgtaaatggaagaattctgttctgtaacaaaaggtagtatttttctttatactgtgagggaggcctatagtttgaaaccactgtgggtgtgtagagggacaagcggggggcccgagggctggagcaaggagtgtggctgtgggaggatgagggagccgtgaagttcaaaaatactgttggcttttaaggtctccatgacccttgaatatgagtatgaataaagtgattttagaatctaagaagatgtcaaatatttttcttaaagctagtaagagtagcaggggatggattatctgaaaatcagaaaaatcagaagtcaattattatgcacacacagttaattgaatttgaacactttttcttttcagcatccatttttatattgatgacttttccctttagagtgagaaaatatgattcagattaaataatcacttaacataaattaactctttcaaaccttatgtggaattaagaactaaagaactattgcttaggaagtattaattttaggaagtattaatttgaactttgttgtcacgtttaatgagataatgtactatatccaggtaagtgatttacacaaatgccagaattctttgcactcggatgactgttaaaaaaaaaactcctagtgttctgacaactaattttttatgccttgtttgtgtactcttctctttgcatttcctaacattggacatttctgaaggcctagttctttatttgctattcgtctttaagttttgctattagaattatacattctggagttgataagccagttggttaataaatatttattggatacacacagtgggacatttacagagcctggtattgtggaatacaaggaaataagaaacaataaggagttttccatgtggttagcaatattagaatgcttagactatcttagggaggttcactgatgtggtcggtctagttgagtattaaaaaatgggtaacatttacatggtttaaatcagagtttagaagggagacatgagactgggtttatgagagacatgatcctcccattcagattgaagtatttttggaggtgtagtgggggttgtgaaaggatagagttgggtaagattatggttttttagagtataatgtttatgagagcttagctgctggaatctgattctcaaatcctgtctccaaaattcctgtaactttgcacaaattatttctctatgcctcaatttcttaatctgtaatgtatttacttcagagagctgttggaagaatttgagtagttaatgcatttaaaatgctcagaatggtcacttagaacttagcactctataaatgatattttttgacattatgaagagttttgaaatctagcaaaagagtttaaattttatgtgataagtaacgtacagccaggataaattccttattatatgttcaaagcagcatttaaggaaaagtaagtagaaaacagaggaccaattcaaatggaggaggctggggtgaggaagaccacctactaagctgtagtattcggaaatatcaggttttaagttaatgagaggctaggataatagctacaacaaatataatgattaataaaaccgaaacctgtattttctttacaaaacacttttgacataacagtacgtcctggatacaacagtatctctaatttggagacaaagaattggaaacttagtgctggcttctatcattgtggtaagagtgaaaataatggatacaaatcagatacctgaggatctttagagaagtaattgttgagatgtgttgacagatgggatagtttgacagagtggttgagagggtgctaggtcagttctcagagagggaggagtaaggaagtgacattactgttgggaggtaattgagttgggagagggaaaccagttaagtgagagtgataggaacttgttttgaattcttttgtacttgatgtgaccgtagcaaaggtgatggaaatgtacctagacagttgtagaatgtgtgtagaggtcaagcttatcaactcagtcttgggccttatcaacaagtgggaagcaagaagagggctgggactgtgtattcagaaatgccactcaggggatttgaagagaagaagaattattgaagagaaaagaagtaatttgagtagttggagaaggatcaggtagtgcatcatcaagagactcaagaagaggaaggagcaaaccagaagggtgaaacactgaagagaaattcaaggaagaggaggaagactgggaaagcatttggatttgaaattcagggagtttttgatagggtagtttcattagcattggaaaaatcaatgtgaaggacttaagaagaaataagtagttaggaatagatggaaaacacatagcatattctttaagaaattaaaaaatactgagctgggaagtaagatccttggggtttagctttagatttgccattaactgcatgacctttgatactttgtctgtaactaatagaatttatctgcatgtaactgaaagtacttatttttcatttaggaagcacttttgacctttttgacaatcttattatatatagaaatacaacacatagtcaggatcctgaaagtaagtggaagaggcccctgaggttccagacagacggatctcacaaagtccatgcactaacacttatgcaccctaccaataatcaccacccacaggctttcactgaaactgccttattcctagactgaactattatacatgaacatgattatctgtattgtaaagggcagcaagccatttgagaggacaaggtgaagaaagatctttctgggagctacactggtggcaataaaaattacattacctagtaaaaactaaaggtgcaaaaacccgtctagctacaattcaaaagagtagcagtttgaggacattttgggagggtaccatcagctcctatgcacctcacttgcctttgagggccttattatagaaagttggagtagtttacagtttaaaaattactatcccatagagcattaggacaaatacctaatgcatgcagggcttaaaacctagatgatgggttgataggtgcagcaaaccaccatggcacatgtatacctatgtaacaaacctacatgttctacacatgtatcccagaacttaaaattaaaaaaaaaaaagaaaaagaaaaaacaattactatcccattatccagtcagcaagggaagagttttaggtttaggatcagggctccctgtttggagggaggacaccaggcaacctttttgcttttctacctgatggaaaggttgggttcaatgtgctctgcttcagaaaaaagcaaggaagtacatgatgtgctttttgaaaggcttccaatctgtcttaacccatttgggctgctgtgacaaatggcatatcaaccacagaaatttatttctcacagttctagaggctgggaagttcaagatctcaccgggtgtctggtgaaagcctgatttctagttcataaatgtgggcactttctagctgtgccttcatgtggtggaagaggccaacaagctcccctgagtcttttttaaaatgacactaatcccattcatgagtgccctgccgtcatgacctcatcacctcacacaggccccagatcttaataccatcaccttagggttaggatttcaacacgtggattttgtggggacacagactttcagaccacagcacagtcattaagggtaaacaaaaaataattcctaaagaaatatgcttctattatctgggaagtagcatttgtattcaaaaggtgtttctagcttaagttgttgatactagttaattgataagttttattgaaaaatctgttttcagagtatcctaacacattgatacctatttggaacacaaagatatgtaccagtataatatcctaatcctgaaaggatgctacctcacccagccccacatttgccaactactgtatgccagcaaatggataatttactttttctcagacgccattaaaaggatcattagagtattcaggatggcttgaaatgggcatattcagctaccccaaagcaaattttcagactgagctttgttttgagaatcactgaaactgactcagctgtgcaattcagtaactgtggacatgtcaaaacacctcattttgtcatctattaaaatcccccactgtgtgtgtttagagatttcctttgctttaaaaacaatgataaaaaccctcatgcagcatttggtatgatacgtgttttcaaacagtagcccatctcatttcaagagatggaataagtatcattaaaatggtaactcaaatcagtcgaagcacttttctggaatacttagattaaaagtgattaagaactgctgtggtttgctgatagttactgttttgtattacattaatttctgcatttaaaaatagataactacttttagtgtcttaggataacatttagtatccactgaaattcatggatttagtggggtgatcccattctatggtattcttcggccggaaaagaatgagaacactgctgacagaagtcccagcaaggccactccatcagccccaccattaacagatgcatgacataaactctgggaaaagagagatttgtcagatttttgccttcagaatggccaaaagaaatctgaaatataaaaatataactagttgaacagtttccaaaacgccatgggttttttagttctattttttatgttttactttattaagacaagatctggagattcagcttttttaaattgttgtaaatcatacataacaaaatttactattttaaccatttttaaatgtacaattcagtgtcattaagtacattcatattgtggtgcaaccatcaccaccatccatctccagaactttttattttcccaaacggaaaccctttcccattgaacagtaactcaccattctccccttccctgagtacctggcactacccttctgcttctgtctctgtgaattttactgttctaaatatctcatataagtagaatcatatatcatctatccttttgagcctgacttatttcccttaatgtaatatcttcaaggttcatccattttgtagccttcttcagagttccatttctttttaagactgaataatactccattttgtttatccattcatccatcagtgaactcttgggttgcttctatcctttgaaaattgtaaataatactgctatgaatataggtgtacaagtatctgttcaagttcctgcttttagttcttttgggtgtatatccagaagtggaattgctagatcatatggcatttctatttgtaattttttgaagaactgccatgctgtttcccatagtggctgcacctttttacattcccaccagcagtgcataagggtttcagttcctctgcatcctggctgacacttattttctgttttttttgataatagtcatcctaaagtatgtgaagtggaatctcattgtggttctgatttccatttccctaatgtttagcgatgttgaatatcttttcatgtggttattggccattaatctatcttttatggagaaatgtctattcaagtccttttctattttttaatcaactttttgttgttcttgctgtcattgacaaaaacattgttctgaacagaagtagttagaagtatggtgttgaagtgtattaatgatcatggcaagagatcaggcaaattgaaccaatgaatttcctgtcctgatgtcttgatatacaggaaccctgctactttgcccccagaacaactctggaataactttgcagcttttatttatttgcttaatttaggcttcttctggactatttcttatacatgtaccacatgaaaaaattgaaaacaataaagttcaaatacttgatagattttgtttttattaaattcagcatcagccagtaagaagtatcaatttagccagtaatttggatatatatgtattattacttcgcacatcaaatctcttcaagaaatgtgatgtaaaagaaatattgagtatgtgaaaatattaactgtgtattttaacacagatatcatttgaatttgaacactttttatgaaatggtgctatgattaacatagtaaaactcagaaatatttaaaaatgttttccaagttgtttcaaattttgaaaaggtgtaagttagatctagagacaaaggtagggataaaggaagagaagaggaaacataaatagcattggctctgttaaaaaaaaaattacagagtagaattaggatttcaaaacatcacaggatagcagttcctctctctctctctctctctatatatatatatgtcatatatatatatgcaagttcctttgtctgacttaaaagacttttgtagaatcagcatacctattcaatgtgtattactttgtgtttgtcatgaaattttacttcccatttgcctttggttttccttttctttggaatagccttctgtcatgcactgcctgttaaattttgtttaacctttgtggtcctgctcaaatgccatttcccctgtgaagacttccctgaggcctccatccttcctctgcactcacatagtccttaggcttatcatgatttttctctccctgcctctaagcagtaagcttcttgagggcaagcacatgtcttatttgcctctgtattacctggtccagtcaacatttattaaatgaatgcacatttttggaattactggttaacctcgaggactgctgtaagatctccagcaacactgtgttaactgactaaagagtatttgtgtgaataatttatatgtgaagtgtgatactcaaataaataaaagttaagttaccaatagctcataaggcagtgtttggcattctggaaggtttcccttgaaaataatgttatgttggctggattattaagcaactcctaaaagcctatttaatatcacaaacctgaaatacagttctgatgttattctatgtcattcccctgcttaaaactaattatgtcttgttattgaagatagaggccaaaatccttcatatacagcctatatgatctgatctccacttaacttttgtgcctccctctcccccttaagacttgtcattcttccacttcctaaaatatctcaaacttcttctcatctcagaggttcatgctgtaccctctctcatctcaggagcttcatgctgtaccctcaaccagggattttcttacccccccttaccccagctggccttgcttctactaaactttcaggtttcagcttaaaggtcttctgggaagctctccctgaccttcaggccagatcaggttccctgttacaagctatcagagagatctttcttagaacttgagagatatttatgcattcatgtcctccaaactatgcctggcattctgtaggtgctcaataaatattcatggagtaaaaacaggaatatatgaaaactgcttaactgtcattgaatagataatgattccaatagagactggtacctgtttatctattacacctttacaactttaaaaggaaaataactatacttctgtacttgcatgtgtgaaatccctatctgctcttgagctaagattctttcttattctaactctactttctccttaagcaatcttgtccatactaacatttttttattatcaccgttactcagatgattctcaaattaaaattttccacccagagttctcccttgagctctaggtctaattatctaattgtctatctgacagcatcctgtgggtgtctcaaaggcttatcaaactctgtgtgtttgttaggatattcctagctgttgtatcggacatagccccaaattccattggtataacatgataaaacttgatttcttgctcatgtgacatcctgattcagggtttctagtcagcaagcagcttcctacatgatgagtcagggaagttaattctcaactttactttgtcttaaggcttgtggacttttgcttgtagactgcttatgcttcctggcccagaaatgctacatagtactcttgtccatactccattagtgaggaccaaccacagagtcccagctaaatgcagaggggtggggaggtttgggaagtatagttattggtagaacagctaatttctcataatgactcttcactgtgaaaagtcaagcactaatccttggctgataactagtcatctgtgacacattcaacgtaacgaaaagtcagccagtttcccaaaataagcaaagtaactaactaatcatgcagacaaacagaccagtaaaccctggccttctttcagtgttctttgttttggatgatgctacacttctgcataagctggggacatgtatattgttgttgacatcctcttacccttaacccttatatcaaagaagtctataatttgcctggcttctttaattaatgactaaaatcttggaaatgaaacaaccttaaatgttagggaaatgggactcaaaagccaaggaatcattcctgacttttctctcgccccgtgtgctgtcattatttggtcttgtgtagtttgcatcctaaaaatttattggctgggttcatctcttcttagtgacagtaacactgccatcctccttgcttagaccactaaatagcctaacttcacttccacatgtcctctggctcccctcttgtcttctttacacagcagccaaagtgagcatttaaaatgcattttaaatgcagatctaatcgcattatttccctgctgttaacacttcaaagccttcctgttgctctaggcgtaaaggcaaaactccttaacataatttacaaggacatgcctggcctaaccccttccctgtctcactcccctttgctaataaatttccccctgtttgagcctcactgtcttctggtattctccgtgctaccctctgccatatggcctcatctgcaaaattattttctcttgttctcacgtagtttacacttacatatccttgatatcaaagtaaaataagtttcactttctcaggaaagtttttgctgacccccctagtcaggtcaacttcacccactgaaaaatttagaaacaacttgtatttctcttttgtagcatttatgataaataaattctcacatttcttttgtgaatattgaataaataactgtgtctgccactggattttgtatattcagtaagcagggattgtgttttgctcaattttgtctgtccagcgtgtgtatcacagtacctggcaagggattggtgttaatttgttttgaatgaatgaatcaatcagtgactgacgaatgaatgattttgtatatcaggtggttctgtcatctggggaatgaactgctgttatctctgcaggtttgtagagatattaatttaggaaatcagaccagctctggtaaatctgtagctatcggcttttgtaagttgcatatttaaggttactttatggaacaatgcaagtcttgcaaaggtcagagcatgaagactaaaaatgaattagttctgcttagagatttacatcagatctttccatgcttgaaactttctttttttcttcttcttactgggtttcctagcaacatattttgccattaccatgggatattctgatagtgaaactgtagtgtctttgcatttatctatcctgaaataatatacttggcaattgcatttcctaactagctatctaattttatatatataatgtatatatatatgcatatttatgacatttgatgaaaatagtatgtatgcatattgtgtaatatttaaatcttttatatagccatgattctcaaaagtatccttggcaataggatttatttttaatttctgggaaaagttatctaagtgtctatatacttagttttaactcttttttttttttaagatagccacactggtttttttgtgttgttgttgttaatttaattatttttattaaagactttattttttacagcagttttaggttaataccaaaataaagagacaggtaagaggttttcccatacccctctgctgttaaatatgcatgttcttccacatcagagtggtacctttgttacagtttttttttttgttttttttttttgagacggagttttgctctgtcgcccaggctggagtgcagtggcatgatcttggctcactgcaagctccgcctcccgggttcatgccattctcctgcctcagcctcccaagtagctgggactacaggtgcctgctaccacgtcctgctaatttttgtatttttagtagagacggggtttcaccgtgttagccaggatggtcttgatctcctgacctcgtgatccgcccgcctcggccttgcaaagtgctgggattacaggcgtgagccaccatgcctggcctatagttgttgagcctgtattgacacattgtaatccctgaatccgttttcattagggttccctattgatgttatatattctgtggatttggacaaatgcatagtggccagtatccatcattatagtatcatgcagagtactttcactgccatgacaaacctctgtgctccatccattcatctctgcgccccagccaacccttgcaaccactgatctttttactgtctctgtaggttttccttttccagatatcatatagttggaatcatacaatatgtagccattttggattggcttctttcacttaataatacgcatttaaagttccttcatgtcttttcatggcctgatagctcatttctttttagctgaataatatttcattgtctgattatcacagtttatttatccattcacccaatgaaggacatctcagttgctctcatggtttggtaattatgaataagacagctatgaacatccatgagcaggtttttatgtgggtataagtttttgacacctttgagtaaatgccaagaagcgcaatttttgtattctatggtaagaatacatttaattttgtaagaaaccgctaaactgtcttccaaagtggctgtaccgtttcgcatttctacaaacaatgaatgagagttcttactgcttcacatcctcaccagcatttggtattgttagtgttgcagattttggacattctgacaggcatgtagaagtatctcattcttgttttaatatgcatttccaggtgatatatgatgtggagcattttcttgtatgcttatttgacatctgtatattttctttgttgaggtgtctattaaagtttctgacccacttttaaattatgttgtttgttttcatattgttcacttttaaatgttctttgtatattttgggtaatagtcttttatcaaatgtcttttgcaaatattgttgcccagtctttggcttgtcttcatattctcttgaaatttgcttttaatttagtgaagtctaccttatcgatttattttttatggatcatctctttggggttttgtctaaaatataaataccataaccaagttatctagattttcttctgtgtcatctcataggagcttatagttttgtgttttacatttaaatctctcttttgtgttgattttgtgaaaggtgtaaggtttgtgtctagagtcacttttttttgcatctggatgtccagttgttctaccatttgtagaaaagactatccttgctccattgtactgactttcctcctttatcaaaaatcattgactatatctgtgtaggtctttctgtgctattttgttccactgatttatctgtctgttctttaggcaataccatatttttttgatgattgtagctttatgggcagtactgaagctgggtggtgtcagtcctctcatcttcaatattgtgttgactattttgggttttttgcctttccatataagctttagaatcaatttgttgatatgtataaaataagtttctgggattttgatttagatttcattgaagctatagatcaagttgggaaaacctgacatcttgacattgtttcctattcctattcatgaaaagtatttttcaatgtatgtacttctttgattttgtttttgtagttttcctcacacggattttgtatatcttttatagatttgtacctgattttattttgggttgttcttaagcaaaaggtaattttttttcctgtgtgtgtgtgtgtgtgtgtgtgtgtgtgtgtgtttcctgtggatttttttttttttttgagtctcgctttgttgcccaggctggagtacagtggcacgatctcggctcactgcaacctccacttcccgggttcaagcaattctcctggctcagcctcctgagtagctggtattacaggtgtgcgccaccatgcctggctactttttgtatttttagtagaatcggggtttcaccatgtttgtcaggctggtctcaaacacccgacctcttgatccacccgcctcagcctcccaaagtcctgggattacaggtttgagccaccgcgcctggccagtattgtgtttttaatatgaaattccacttgttcatagctggtatgtaagaaggtgattgactttggtatattacccttgtatcctgcaactttgcaataattccatattagttctaagagttttttatttagttagttatttttggagatggagtcttgctctgttgcccaggctggcgtgcaatgacgtgatctcagctcactgccacctctgcctcccgggttcaagtgagtctcctgcctcagcttcctgaatagctgggattacaggcgtgtgccaccaagccttgttaatttttgtatttttagtagagacggggtttcaccatgttggccaggctggtcttgaactcctgacctcaggtgagccacctgcctcagcctcccaacgtgctgggattacaggtatgagccaccacacctggctgttccaggagtttttttgtcaattcttctatattttctacatagacaatcatgtcaccagtgaaaaagactattttattcttccttcccaatctgtgtattttaattcattttctttatcttattgaattagctagtacttctagtatgatgttgaaaagtggtatcaaagagggagcatcataaccttgtttttatcttaatagaaaagctttgactttctcgccattaagtatactagctgtaggattttttgtagatatgatttagtaagttgaggttccccactatacctagtttactgagagattttatgatgaatgggcattggattttgtcagatgctttttttttgcgtgtactgatatgatcatttgatttttatttattagcttgttgatgtaatggactacatgagttggtatttgcatgttgaaccagccttacatacatgtgataaatcccacttggttgtggtgtataattctttttatacgttgttggatttgatttgctactgctctgttgaggatttctatatctatgttcatgagagatcttagtcttttgttttcttgtattgtctgtatctggtttgggtattagcacagttctagccttttagaaggaatgagaagtattctctgcttctatcctcattttagctggataaatgaaaaaataatgtgtttacttaaatttagtaaccatttcaccgacatctccttgtatccagtttcattcaatcagttgccattactattgaattatatcacaaaaatagaggagcatttgaaattccacccacccatgtttgttaatcagactgatcagtttattcatgtttaggttctcagcctaagtttttctgtgtgcgttcttgtttttggtacgtggctatcaaagtattctgtacatagttgtcattttttaaaaaataggaaaagagataaatctatttacaatctatctgcccatctattcatgcataagtaaaggttatttatgttttgattatgcctttctctcatgactaaagagtaatcttgttttgttctttttcatagatattttcttgagtacataaagcaaagcaagtgtggtgtttactcttcaattttggaagagactctctatgtgcagacacagagagacatcacattgcataaatgagtgaattctttattttgtggttatgatcttatagctgtttttcagcttgtatttaatggaatgtatgcacctcttctcttcaaaacaattgtgttgtcttgggctgctactgcctagaattctgtagaaatgctttatcgcgtgaaatgttaccttattataattttttgtattcttctgtccacactacttagtgttttcttctccggctccccctgaggttcatggttggacagtacactgtggttcctgcttaccccagtctctgttgtgagttgtatacatttataagcattaaatcaaatactcacctgtaaaacgttcattaaaatacaccttctctacaatattattggaaagtcaaaatggaatatttcaaaaattgaaataatacaaaaataaaaatactatgatacaaaaataaaaatactgtaaaaccaaaataaaacaaatatccatgagttcatattagtattaatacatgatcaaataacaaatggtggagaagggataatgcctcattatataaaaatattactatctttagaactcgctactctggaaggtgaatcttaattccctacccttgagtagggaattaagggaattgagtaggctggacaaagtgacttatttccaaaaggtaatatatgaaaagggaaaaacagaagtaaatttacttttgagaatcttggcagtaagaaccttaaccaaatgacaaagattaatattaccacgagaaattttgttgatatcatgtaccccttgatatgatgtgatgagaagtgcactgcacttctgtggcattcttccccaaaatctatagctgcagtctcatcatgagaaaaacaggaggtaaaaccaaacggagggacctcacaatacctgaacagttgtcttaaaaactgccaaggtcacaaaaaattaggtaagatgaggaaccgtcacaatttggaatgaagctaaggaaaatggtgactaaatgaaatatggtgtcctggctttcatcctggaccaaaaaaaaaaggtgacattagtggaaaacacggtgaaatctgaattatgtctgtagtttagttcattgtaatgtactaatgttaattgtttgcttttgagaaaagtacaaatggttatgtaaaaatgttaacattaggggaagtgtggtgaaggttacacaggaactctactgtctttgcaacctttttgtaaatctaaaattatcaaaattaatgtttatcaaaaaataaaatattatgagtacctcaaaacactcctctccgacttatttctcattccccacaaacgatgcacattaaaataaccttgatcaacaaatgagtgaatgttgacatattagaatatgctctgatgttacataaatccgaggtgtttgttacattcattcatattgtaaaagtagcatatgctcattataagtatcagaagaaatgaaatcacccatattttgttttaccatccaggaataactactcttaactgtttatacttaaaaatcactttacaaatgtatggttggtattttatatagcatttgatttatgctgcatgttttattttatacctgacttttttttttcatttagaaatgtgttattacaccattctcggagaaagtgacttttaagattgtgtaagcaaacctgctatgtcaaataggatttccaattattgtcttccagctccataggtcctacaaccctctatcataccccatttgagttagtgggattctgtccttccagttgttagcaaaaatggtactcatccttgacaactcttgtttctcttccacccacatttaatctatcaagacattgtgttgattctacctttaaaatatatccagaatccaactacttctcacttactcttttacccctcaggtccaagctcatcatctttcccttttgtaactgtttgatttttacgaatgtaacacagtttattctcaatgtaatagtctgagtgattgtgttaacaaaaattcatgtctttcctccactcaaaaattttccttggcctatcttaccactcagagtaaaaccgaagtccttactatgctctgacattctttctgatttttttttctgatttcattgtctagcttagtgttgggctatttcttatttagagggaatctgagacagttttcatttctgttttactgtggaacattccatcttgtggaaagtgatgtgaaaattacctttcaatatattatttccaagatgtccttgtgcatggaattagttgcacagattgtgggaagttttgtagagggaacttgactttgctctgagaaaggacagtgtgtataaaacagagttatgcaagtataaagtataccttggtagtaggatcttgcagaagaaacaagactttgaagtggtggaccataataggagaaaaagttagccctaaataggattttccaggaaagaatggcagagtacctaatacaatattcttagaaaatatacaccaaaagtttgtttcaggaatgcaacaatgattttaaattttctctttttttctgaaatcaagagaactgaaataagacaaatacgatgttttaataagtgaataaccataagccaaagtccttaagtcaaccttttagtttctaatatacatggaaacttaaccgaaagggttttgaaagctacttcataaattctctccgttatgaatctatattttgctgcttttattacctcataaattctggagaatgatttatataataatgagtgtccttgtctctccattgctgatcaagagagcaataaaccagtttttatataaaagttataatatttattctgctactgtctgaagtagtttttacttgagttatgtcaaatttccactcttaggaaggttttcgattttacatttggaaaaaaagtgatactgtaaaatgccgtttgatgaaaaatacctaatatattgattttgtttcacataaggaatcaaaataaatgtgcttcaggcaaaagagtctatctacagacacgcataaagtaaacacaactcttggagggatcattatgttaaagcagtgtgttttattacctttctactcaagggggtcaggggaccagcgcatctttttaaatgagtaattgccatttaaacgtgcatttgaaatcaagtgtctttcaaaaaagtgtgagatttcaccctgtatgctagaaaaaggcaatttacctcctaaggttagattagaaaatctattctttctccctttgcccacttaaggatgctgctagcaatgtgttttctcgcatatggataatgactctctctcacaatttaacctgcagaattgctagtcatacttagctttcagctccatctgcaccgtagctatcctgccctgcttcaagtccaggaagcagaacagctcaagaacagagggcagcagctagtttatgctgcttagggggagagggactctgtgtgtcctgtttggttagcacagaaggctggcagaacagagcatatccttcccacttgaacttgcagaaggaaaaaggatctcgaaggtcattaaggtacttctaaacctaaacactccaaaaaaaaaaaaaaaattggagtcaatttcagagtaacttttacaagtcgtaaactttgtaattaatataatttttagtactttaagaaaaatactgtaaagttatttaaaaatgacttatagtctcctcatctgtaaaagttattttaatttgatttgatttatggaaatgtgattagcagacaatctttagatgcttaagtgtgtctataaagaatatgtactccaatcctattctttctgttgagttactcctaaacaacacaaaataagcatttcgttttgttttgtttcattaaaaaaaatgttcttagagagtttgtagttccctttaatagcccaatctttttctaactttacgaatttcttttcactttggctgttaactaccctctctcccacctactttttcttttgcaacactacagcaaaattgaggttagctagtagcatactgttagtcattaattctgcttttaaataactgaatggttatatgttatttccagtctcctttttgattcatgggtatttatctagggattattaatagagagaatataggaatgattatgacagaagatgttcctatgctcaaaatgtcgctcttcaaaatcagaagcctcttgaaggatataagcaaatgttacagaaaacatgcttcaaatgtcaagaaaacaatatacaaagcaaaactcttaacagcaataaatggatcattaaaaaactttccctgcaggtggatatgattaaaaataaattgatttctaacagtttttgttttccacattttcaatttcatggatgttatttttggcctaatattttagataaaataataatcaccttgaaagctttttttcttccacagtttataacctttagtattcataagtatggcaggaacagtaattgacaaatgctttatgtttatgtgcatgtgttagtctgtatgtttgtgtgtatttaattactactgttatccagagtacttaggcaaattctgtattcttcgtatatgattatataatgttctaaaaacattcacttttttaaactataaaagtcatattcagaagatttacgtataaatttatatctcttctgccaaaaaattatacaaccatagggaaaaaatgaaacacagtttttccttttaatcaaagatgatttttaagcttgcaaaactatcagcaaaaactcacatatttgtacctaaagagatgttagattgaaggaaaacttgtaattgtctaacctgattatttttatgatttacattgaagaaaaacaataataatttttaacttcgttatatttttatgattttaagtaattgcttatgtaggtattgcaattctgaaaggacaaaatagtcatggatgtcaaacatctaagatctttttgaggtacttgtcctgtcttgaaatacacaagaatttatagtgcttagaaaaatgaaaatgcattattcagtttttattgtactctggcttttggggatcaaaaagcagaaaatagtacaataagactacatttcattatcctgggatttgtatgtattagaaagaacactttcattaattacacttgatatttttatagtttatatactatttatatatgtttcctgtagggatgttagaaaacttttcaaagtgtagtctagataggattttacagctttctgtaaaaggaaaacaaattgtttctttgaggccatcaaaattattacttttctttctatttcacaattgcttaaggttgcaaaccagtaggacttctttcctctgtgttttttaaatgcaatgtagatctgatacaaatgtccaaactcaggtacttttgaactatagcacaactgttattctatacctgcactaagcaaattgcctagtctagaaagtgtgaatagggcggtatatgtacacaaatagaagaagaaaaagaagcttaaacatcttcttttttcttttgcaccgtatctttgggaactttaacatagctctctcattggaaccaatttgtaggtatgattaactgctaacaagtacttgagatattcttaattcaattatcttggatgaggtccaaagtaaactggcctaacatctataatcagtgttacaatcgtgagatgtcagagtatagtatatgtgttttcaaggcatagtaattaaatatggagacataaggctgaaaggagtgacttgctttataacactatatattacagtccctttgaaaagtaagcagaccactgcccttatcactgcagggacaaattcagttgtgatggtaatttacacctcataactttcttttatgacatccatccatcatcaacaggaagtctgtacacagtctaaggaagtttcccagatatgacattctgggtagggctcccagtctcctgaagagagtaatgcaaccaatggtcacgggaaccacttcaccttaacagctgctgagtcggccctacataaccctcaacgtccaggatgctatggatttttaaaacatttcaatcattttcatcagcaaaaggaaaaccaacaaagctaacagtagcaatagtcaagggatcctccatcatcattaagactgtggcttaagttttcttggatcagttattgtataaccttgtcagtcaagcaactataggatgacttacaggatgacaggtgtaggatggttttcaaaagtcgcattgagagctccattttatgcactactaaactgttggatactgttagtagataatgggaagattccatagtagatgaagtggaaaggttaattagcccattgtgattttaggagtatctgtctaccaacatcagtagacatctgatttttctttgttgtttccctagctccaaggtggtaaaataatgctaacaagacaatttattcaaattacttggagacattatacacaaaaataaatttgtggcacgtattagtctgcttgggctgccaaaacaaaataccacacactgggtggcttaaacagcagatatgtatttctcacaactgtggcagctgagaaatccaagatcaaagtgccagataattcagttcctggtgagggctctcttcctggcttgtagatgggcaccttcttaatatccttatgtggtggagtaaaagtactctcatgcctttttcttttcttataaggacactagacctatcagattagagccctatccttatgaccttgtttaacctttatcatctcctcagaggccctatatacaaatatagtcttgttgggggttaggacttcaacatatgaatcttgaggagacacaaccatttagtccataacagtatataaataataagattgatatattctattgcacttcttaagaactttacaacttcagcaagtggaatctttggcaatgatgactgatttgactcttgtctatgtttttgttttttttttccctaatttaacgtccacttagaggattagctctgcccaatgctatgggatcattcttgttctgaaactaggaacagctaaagaccccatgctagttaatgcttagtctgagtgtctgtagtttttgctctgaatttctactcaagctctacgagtgaggctccttcctcttatctggtccagttctttatgtgaactcaagtaactagatcctggtcttatctattcagtgctgtaatacataccttcagggtggctgatttactcagccactcaaacccattgtgggataggggtacacaggtgagcaagtgcacgagctggggcaagtgcctttgggtgctggcaggaatgaaccctgtaccggcctgcgacaatatctagggttgtccatgacctctggagccccagagggtgtgtggtacaaacaattctcttttagctttgccactgcacacagcttaagcgttaaacactcagtgaagactcagtgtgacagactttttgggttcccgcacccagtgtgtcccgaattcttgtccagaatccaggaagaatcaggtcacacaaatggattgaagggtggtgtatgcagagagttttattgagcaatggcagtgactcttaataggatggggagctggaaaggggatggagcaagaagataatcttcccctggagtttggctggggatgaaccatagtccccaatgttcagctgcctcttctcctctcaatgttcagatgcttcttctctccttctctgccgagccactctgcccctttgccaggggagcttggggtttttatgggtacagggcaaggtgtgtggagggccagggtggttttggaaaaggtatcttttggtcgggacaacaggaatgcatatttttatttagggctgtgagtccaggcttgagggtggagccctcaccagtgacctcgccctcttctacccagtatttccctgcatcctgtccttatcatcacgaaatatgagacttaagaaagggtaagattattgaaacttatataggatcagagctacagaaagaacaggggtttggggcttctgacgggtggtggcgacgcaagttatgggagggtaatgggggaagtgtatgggtgaacaaaggttgtcttatgatgcagctaaagtctctcaggtaataaaagttttctaggaacaaccctaagaagaataggtgatagcctgtgacaaagtccgggcatgattttgacctcgatctctgctcctgtgatacactcttccctggttcatgagattcccgtaatggggattaatgacaaaatgacagataagttccgctttggaggttctgtcatcaggtaggtaagagaacttatgagaaggcctctgccctgcccttttggggagaaagatgggtgagagacaggagggcaagagaaggtcggagaagctttggttctcctttaattcaaagcactcagcatgccaaagtgccatactttgcagtgtcattctctgaaccccaaccgtgtcctaaagataaagaggagttagataagtgttgggaggaaagcgattctggcagagggaaccagacgtacagagcattttgaagaaggtagtgtttagctaaagcatagattatgagagaggaattagttttactttgttttcactaacatttttcaggtattggaatttagatattcaatcccatttttgtaggtttatttccttctgctccctgcctctattgctcacatcccctttaactgctgacatcccctttaaatagcatcccctttaaccaaatctctgttactcgtctccccttaatgatctcttagtagctaacctatacacatgttttctgaccagatgaaataactttcaggccatctaaacttcagttcacaccaggacagatctatgaggaagaggaggcagagcctaatcatactacatggatacatatgtgcttcttcacaaatgctgttgtctaaagaaagtaaccaatccagattgatggcagagtttatcttaccatctgatttaaatcctgctgtacaaggctaacagatgtgacaattcctgaggtcctattttatgttccttctacatcaccatatggcaaccatatttatatggtcagtattagacatatactcttcatcaagaattatttccaatttagaatgatttgaggagatttgctattgtatgcaggcctatggctaaatctcaacaagtaaagccaaacaaaattacttagtttgagtgacaaagggaatactgaacaaaagaatttaacattatctgagaagaaatttgttttaagatgttaattggaaaacaaccttaaacaccaattgaacagaagtgttttgacttttcaaggggtcattgtagacttttgagacaaatagatgttgaagtgcaatattctgattataggtttatacgcttggagtgaatcaatatatgtacttctatttgctggtagcttgctacacttctgaattagagtacaaatactataaaatgtgatatcttctatggcaaagaacagtttaataatatgaagaatccagtcatctgcaatagtttaaaaatggcatagaattcaaatagctcacaagtcttttgacataaataaaatgtaataactttcaaacatttcataggtagacatgcagtcatcaaaaagaataatacaaaagtgacatgacaaatagagatttaacaatttttgctcatgtgatgcgttttccttttatacttaacaccaaatcctgtgttatcacaagtgaattgtataatttgggtttctcttcacctttctgatttttattatacagttgactcatgaacaacacaaatttgaactctgtgggcccacccataatcaggttttttcagccaaatgtggattgcaaatacagtattttctggatgtgaaatccatgtaataaggaaggctgacttttatatatgtgggttttgtaggtccgactgtaggacttcagtgagtctgcatggattttggtatacacaggaggtcctggaactaatcccccacggatactgagtaatgactgtataccttatatttctgatagttacagagaagagaaaaccaagatcagtgatgctaaagcgttccaagtgaaaatgccagttggacaaacttgtaggaaatttgagtttctattattcatctaacatatatacaaattacttccctttttttcttccagcatctttaaatactctatatttttattacatgaacactttaccgggtctctctgactcatcccaatctctcttttctttgaattctacccattctaattttataactatgcttttggaagcttacatttttatatgaatgttttatatgcatcttctttttctaaccatgcaggagctatatttttgccctattaaagtgttaaacttggagcagcactcagtgtgtatatgctgagtcgttattaggctttcaaccctatcatttctaggtgtgtgtaaacctcaatgtggtaggaaagtttgggaagctggcctgaatgaatggcttttcttacttatttagttaagtcctcataggctaaggatttttccccttcctgccactccaaataggttgtgcttttgcctcagttcttaaaaagtgaaccctgaacttgcttctagtcttaccagaacattgagccaagtaaaggagagatgcaaatagctatgggctgtttttatttaaaatctctaccccatgggtgtttcttgaaattggctagtctaacttgtaaacatctgttgcttagacttcttagtctttgcagttgatgttttgcattttagaggtgatattatctcagttgtgatgaactaagtgggatgttaataggaagaaaaaatgatttttatagcaacattgcatcaagtaaaactaggttgatagagaatgtgagaacagtaaaattcttcagataaaagaaatagcaagcagtatatgcacgtggtcttcttgtcatttcaatattcttcaaacccaggcttcctgatgagggcgctaatgaagaatactgttggaattatcttttctaaaggcattttcattctattaccaccccccacgccaccgccacacacacgcacgcgcgcacacacacacacacacataacacatgtctcttatttcctctttcattcacaaatatccactctattccaggcactgtactggagatggagataaacggatgaacatgtccttatcgcacattcagtccagtactatgtaagatggctaagagcagaggaaaattgttgactaggaatacattctttatttcagaattttatgtcttggttgaaaggctaataaattctaagtgtgcttttatctcttcctaaatcagcctgtgtcatctgtcaatacatacatatccacagtagtgaacacgtgtatatttttaatgaacatgtaccaaaggaaacatattctgccatctctgaagacatttttatcacaagctgactttggggaattctgaatatatgcagtgccaatatcctgaaaggtggtggaaagggattagatcttatagcagtaatggcttcattttccttagctcatattaaatctttcagccaaacagaaaaaaaagtaacatatacaaataattgtattgctcagcaaagggatctgaaggatgctgtattttgattcatcaaaccaagtggcatgtatcccggcggatggaactttctgcttggaattagaagactagtgttctgaggcctttgggaagaaaagaagaagaaatggaagatggatgtcttattctactgcttattattatgaacttgagtatattacataacatttgaaggatttgtttccttttctttaagacgattaaaataaataccagttttgtctcatgaggatcccatttgtgagaataactcataaacagatgagaatgatacagctctatctttgtttttaactattggccaaatattacctaaaacttttcattttaattttaaaattgctgtatctaaaatccaggcctatcagtctgaagtggtgaaactttatactggctgcagtttataattacctaaaaaatcttaaaaaaatgctgtggccttggtaattgggatggtacggagcttgagaatcttctgtctttaaatctctccttgggatccactgtgcagtcaggttgaaaattgttggtttaaagtcaagtacttcaaacatgagcacctttatatatcaagcagcagcgttctagctcctagagcagtaaatgctatctgtagctaagaattaaataggagatattctttatcgaaaagccatcataaaggtggacactgttaagtgaggaaagtggaaatacttcctcaaagagtatgacactatagtgactaaactgtatacatttactgttatcgtgtggctgaaagacaaaagatgctttagaaacctgtactggagcctagagctttgattgataaatagccatacccagcaatgagagaccaaggatgaagggatgaagaatctgtagaccactgccaactaccgtatgattctaaagtgtgaatatttgcatgctacctgatatggtttagctgtgtccccacccaaatctcatcttgaattgtagtttccataatccccatgtgtcgtgggagggacccggtaggaggtaattgaataatggagatggttgtcctcatgctggtctcataatagtcagtgagttctcacaagatctgatggttttataagggacttttcaccctttgcttggaatttctctctcctgctgccatgtgaagaaggagatgtttgcttccccttccaccacaattgtaagttgtacaggcctgtgcaactgtgagtcaattcaacctctttcctttataatttacccagacttaggcagttcattatagcagtgtgagaatggactgatacactgccacagtctgtttaaggactggggatgatttgactgagccaaagggtgtgtgcttactttcagagtgcacccgtactttagaatagacagaattctgggtcattggtgatatctctttaatatatttcataccagcattcagatttggagagaaagagctgaaaaacacagcatgtctgccagttttaaagagttcccactactacatccacaaaagatagaaaagttctaggacttagtgatatttctgccaaattatttaagctaaactttaaaaatcatatgacatggtcctccctacttaaaacatttctataattctcagttttctattgaataagctataagcccattatcttgacactcaaagcctttggagattttggcaaccagatttcccttaactttgctgtacttgctccgggaatcctacactgatcctgatactatattagtttctcttttgaactcttgtactactttgtacaacttttagataaactgattcactcatctttatattattttccgtcacttttagttataatagaattaatactaataacagctgtcttctttcagaagctgaccttgaggtaattcatgtaaaaatgatagacgaggaagtgttcctaggaaaaaaccagtagcagagttgggaagtagacatggaatggcaggaagccaagcaatggtgagagatcctgtaaaatcccaggaggaggtgggtgtaatgtaacttagttctgcaaggtagctctgcagatagtctgaggctcaccttagagtcccacttaggaagccagggggatagagtctttgtacgtccctacccctgttagtcattagctacaggcagaagtctgggaggtggcatgaactccctgcactttcctatctctgtgggtgtaggcaaagcagtttcggcagtctgcaggcaactttgcgacaaggagctacagaggctgggggtgggtgccagtgtgcttgtagctggagtgcaggaagctggtaaggggagacaaggtaatatgggcagggtggccaaatattcttttaacttctgtgttaaattacttcttggattggaagctgcttggaagcagatatgtatccctaattcttataataccttatctaaaatattaaaaataatgctttcataagtattcagtgattagatgagtcagtgtttattattatttacaattttctttaaaaaaatttttttgagacatggtttcactctgtaactcaggctggttttttttttttgtttgtttgttttttttttaactttctgtggagatgaggtctctctttgttgcccaggctggtctccaactcctgggcttaagcagtcctcctgcctcagtcttccaaaattctgggattacaagcgagagcccgcatgccgagctgctttttttctttaaatgtttctaactgtagaacatgtgcactgataatcctttgggatgtgatcagatctctctcctggtgctcatttcagaacattctcctgagctcaaacagcaatgattgaggaaccccaaattagctgttacacagagagctgacctaagatacctcagagtagaagggactggatcacatttccccgcctaactggctgataacacttgcaagctgctgaaaaaaaaaaaaaatatatatatatatatacacacacacacacgtatatatttttttcccctccaagctaagggctactggtgggtctaccagtcaatgttatcaacaaagagaagcagttagaattgaggcaatgagtaatccaacgacattttatctatgttcttgtgggaacaatttttatgtgtttagtaggctaatttagtagaaggtcttctttaccagagttcacttctaactttgtttcactttgtaattttattttaaatgtagttttaattgacaaataaacattgcatttatttattatgtacaacttattttgaaatatgcagttgctaaattgagcgaatgaacgtatgcattacttcacacgcttatttttttgtggtgggaacacataaaatctactgtctcagcaattttcaggaatacagattgttattaactgtagtcaccatgttgtacaataggtttcttgaacttagtcctcataatgaaatttcgtatcttagaccaacatctcctgagccactggtaactactctctatttctattagttcaactttttagattccatatataagtgagatcatgtggtatttgtttttctgtgcctggcttatttcacttaacagtgttctccagttacatatttttttcgtaaataataggatttctttcttttttaaggctgaattgtattccattgcgtatagatatcatattttctttttccagtcatcatccattgatggacacttaggttgattccatattatggctattgtgaatagtgctgcagtgaacatggaagtgcaaatgtctcttcaacatactgatttcatttcctttggatatatactcagtagggggattgctggatcatatggtggttctatttttttttttttttttttttttgagacagagtctggctctgtctctcaggctggagtgcaatggtgcaatctcggctcactacaacctccgcctcctaggttcaagcagtcctcctgcctcagcctcctgagtagctgggattacaggcatgcgccaccatgcctggctaagttttgtattttttagtcaagatggggtttcaccatgttggccaggctggtcttgagctcctaacctcaggtgattctcccacgtcagcctaccaaagtgttgagattacagttatgagccaccacgcccagctgttttttattttttgaggagctttgatactgttttccataatagccttactaatttgcagtaccaacagtttacaagtgtttccttgtctccacatcctcaccaagacttgttagtttcatcttttttatttatctgatgattagtgatgtcgagctttttaaaaaaatatacttgttggccatttgtacgtcatcttttgcgaaatgtctattcaagccctttgcctatttttaagtcttgcgatagagttctttgagatccttatttattttggacattaattgattttctgatgtatggcttgccaatattttatcccattccatagactgtcacttcagtctgtttattttttaattttcattttatttttattttttttgctgtgcagagattttgaaattcacataatccatttgtctgtttatacttttgttgcttatgcttttgggatcatatcaaaaaaattattgcccagaccagtgtcatgaagctttagccatatgttttcttccagaagttttagtttcagtttttacactgaagtttttacctcattttgaattgctttttgtccaatgttataagggtccaatttcatttttctgcatgtggacatccaccagtcccagcaccacttattgaagcgacaacatgatcttttgatatatgtatacattgtagaatggctaaatcaagttaattaacatatgcagtacttcacaaacttctttttttttgtgatgagcacttaaaatctactctcttagcaaatttcaagtacacagtatattgctattgactattgcacctctgatatacaataggtctcttgaattttttcttcctgttcaactgaaattttgcatccttcagctaacaccttcccagtctccccaacctccactgttttactctctaactactacatgatccagcaatccccttaactgagtatatattcaaaggaaataaaatcagtatgttggagggatatctgcagtcctgtgttcattgcagcattattcacaatagccataatgtggaattaacctaagtgcccatcaatggatgatgactggataaagaaaacgtggaaaatactattcagcctttaaaaagaaggaaatcctatcatttgcaacaacatagatgaacgtggagaacattatgttatgtaaaataggccaggcacagaaagacagatactatataatctcacttatatgtggaaatcaaattcttcttatcccttcctgaactttactataaacacacattgccacagaaaatccaaaaagaggtgttgttgtgtagagtagatgtggtgctccgtggaaatctttggaatcaagagaataaggcaaatatgtgctattatgtggcattaattaaatgtttctaaatgttgtaccatgttttacagatgctagtgtgatagccccaagcattctgtagactttatcatcatgttgagtatcatcattgatgtttcctaaataagcactatgattcagagtcctcatgtcttgatactgtgtgccacagagtacagtaaagatatatgttttaatgtgaagagcaagaatctttttttggatcagtttcctataactgtttagctttatcttggaggaaaaaaatgacttgtattatgacagtagaaatttagtaattacccctaagaaaaaagatctttcttctttcaccttaagcttactcagtgtaagtggataaatgccaaagttctgtaaagtgcaatgcattttctatacataattcacaaatctacaatagaaaaattgaatggtctctttggcgtgcagcccaagtagacagtgaaaacctatgggaaatgtaatattaataaaaaagcagagaattagacctgacatttcggtcattcattctacaaacatttattatattataatgaaatattagttattgcattatcagataagcagaaacaaagcactgtgttagaaacactagccttttcattgtatttatgaaaacataagaaaaaaagaaatacaagtgacattcaggtacatggagtaatgacaaaaaggaggagaatattcaggaggaatattcaggaggaatgacaaaaaggggggatgatatagaaaaatcagactagcaaaataattcatttatgtgatttctaatatttatctgcagtttacatttgaatgaaattgtaaaagataaatttccttttttttttttttgagatagaatttcactcttgttgcccaagctggagtgcagtggcgctatctcagctcactgcaacctccacctcctgggttcaagcaattctcctgcctcagcctcctgagtagctgggactacaggtgcccaccaccacacccggctaattttggtatttttagttgagacggggtttcaccatgttggtcaggctggtcttgaactcctgacctcaggtgctccgcctgccttggcctcccaaagtgcagggattacaggcatgagccaccacacccgcccgataaattttctttccttactcatatattcctcttagtacaaggtaaagggtttaaagatgaaccatgagggaaatttaatttcaaagatatatgggaatcggtgctttcaaaacaaaatttgaaatatactttgttatgcctttttcatgctgtacaaaatccatcatttataaagatactgattctgtcagtgcctcttttcaacacaggacataaggcagagcaatcaaaagacattttaatttttaaaatgcactcatctgcttttccattgcctttggtagcttatacaattttagaacatatgctgcatgccaagttgtctggctttatcttatctgtagaggaaaaatgtcaccacgataatgtttgactgtttgctggaaatggagattttccatgaatcaaacttattatgggtattaaaacattaacaatttttattattagttaaataatacattaatgctacacttaagtacttttatatgccaggtgctgtgccaaatgtttcacatacgttattacattttatcttccaagcaaccctacaaagttctcatcaatatccaaatttacagacaagtaagattagccttagagtacataagtaacttgtgcaaggcccttcatcttaattgagaagagctcaaggcccaagcaggaaggtgaagctctgtagtctggagggtgggtgccctcactgaacttttctgtgatggaatcagaaggtcattaactttattaggtcttcaggtttttcctagaaggatgctgaacactgaggtggatctaaaggaactttggtcttctgcgtctttccttggctgagacaggacaccagtgactattctttttctcctggcattatcactgaaatgaaatgattctcttcactgtctttggagcagcattcatacctctactctgtccgaatgtcattatattctaatgtcaaagtcagttggacagctatgagtttgaaaagtgataaataaaatagcatacaagaaaatagtataaatgtattcctttacataaacagatttaatataatatatgaaatttgcattgttggaaatcagttctttgccatgggttttaaatttatcgcatttatgaattttcctaatggaatttcatctctaatttttataaattaaaatattgtgaacaaatattattatccttctgttgcaatacatatgactgaggcaaacagtgaaaaatattcttggctgttttaagtctgacatttagaacccgggtggcacataaaaaaatactgtcaatgtgacatcatatttcccactgattccggaaactaatttaaatagcaaacacttaaacttgtattttatatgaatgtcattttaagaagactttgattattgcaaattgacccagaagtgatgagtgtaaagagatattatctagtactgattctttgtggttgggtgtctccatacttgtcagagcaccatatttgccacccagctttgttgccagactattatagaccagccacggttactgcagttttctgtcagccacccttatgtgctgcacatgccatgtctggggataatggaaatgagacagatatgctggtgtttttgcattaaggaggcagttcctgagtgacaaggctatttgtgtatcctgcatataaaaattgcctcacaatgtctgagttcacatggattcaccatagaaaacttgcataaatgccagaaaattaattgcactgctgagacgtatggtagaactattaaaatgatggctatgttttgaggaatactaggttggccttattacttgtaccctgcagggtgtaaatgcagttttagcaattatcagggtgatatcattttgaagtttacaattaaaagcactgtaccctcccacaatatcttttaagattttatagtttcaaattatccatagtttaaaaacaccaaactgggaataatggttaagatgttgcctatatccttgatttcttttgatttcttactttttcacttatcataatgagctgtcaaatttgtatggcctgtttattttagaccttgcaataaaaccccttcctttttttcctcctagacatgtagaactaaagaatgtttgagaattaactagaagtctcataactttcctgacagctttttgatcctataactccaacattatggatatgttaagaatgttattgttaagccgagaaactgtctcggaatatagaataaatttttatatttaaccctcagtcttgtaatatttgtaatgtaactttgtgattatttggttttcacttattcctattttagtgaacagtagttaataaaatggcttctgaaattatcatttgatatactgaaaattattaaaagtagccattggcatataaatgtttctctttctttggatttactctatatcgtaaagttggtaagagctttagttgttgctttttggaaaaaatgccaataaacagaatcttgcctcagggatatctagtttacagattacaacaaactatttaaagataaatttgtaatggattggaagaaatgaagtgtttctcactaggggttctgttgaccacctatatctgtgacaccccatgtgcttgttaaacattcagatttggggctccaccacagccctacagaatttgtgggaggtggagccggcctctctactataacaaacccccaggttgttgagcctgctcaagtttgagaattgcttgtgtcttttaataccttcctctcctaattaaatcaatttaatcacataaacaataaaaataactttctgattgatttctggtaccaaaagcatacaaacaaacaacaacataagacacagtggggttgctaattttccttttctgactacaataatcaaatctcaatttaattgtttatctttttttctcatgtttttattcctcatagttgaagtataatactcttaatcttttatttattttgatatggaagtataatggactgctttaacagtctgggaaagctatgaaacctctgtccagaaaaatgcctgtcacatttttacatacagtgtcaggggtttatggaacccctggagttcatcatggaccctaaaataagaaaccctgtaccagcaggacctcatcatttaaaacaagcctgtgatttagattttttttttttttgcatatgtgatgattattggacagtgcgaccaggggcttttcaatgtgtatattatttacttggtagtctgtaatggttcctaaggggctataagcttgtaaagttgtaattatggaattaaaaacaatctatacagtttttcagatggttcataatagcaccaatgtgtataaacatgcaactatgtttttttacagttatatttaagcaataggccataataattgaaaatttttattttttaagttcgtagaagattaaacgtggagaaaaaattatgtaaaaccagagcccattgtcttaccttatgtgatgttaagacaaaattttacatgagaagacactttttattctcagaaattcatttaatgcagaacaaaacacatttatttaagatagctcttctggcagttcaacatgcttaataaagacatgtttaaataactgatttcttaggaaaaaagaccatacatattgaagcagaacactatcgattgtattcatcaggcacactgcaggccagaagatcaaagcttatgctttcataatatcatttaacctctccaaaatgtagtcagctgccccatatgtcagtgcaattgtatttgaagagtgagaatgacacagattattggcctgacaaggctaacctcctaaacaaagacatatcagatttatctgttgacttggagagatagtgtgaatgtgttctttcttctgcagtttagagagtatattagggagatatgaaactgataaaactatccactcctgggaagaaaggaatttaaatattttcacatactatgtgtggaactatccttcctaacattattattattatttttttttttttgagagggatactcgctctgtcgcccagactggagtgcagtggcgtgatctcagctcactgcaacctccgcgtcccgggttcaagcgattctcctgcctcagcctcccaagtagttgggattacaggtgcccaccaccacacctggctaatttttgtatttttagtagagacagagtttcgtcatgttagtcaggctggtctcaaactcccgacctcaggtgatctgcccgcctcggcctcccaaagtgctgggattacaggcgtgagtcactgtgcccatcctctaacattgtctttttaattttcaaaacctgttttatagatgaggaatttgagggagagactatataggggaaaaataatttttccaaatacatatttacatttaagggacaggataacatggagttatagaggaatacaggatagaggtcattaaagcagaaagtactgcctttagagctatgcaaatagttctttctttagtagtagaacttggatgagattctaggctgatggacttcaggtcagactgtgtggatcagaatcacagccatattgggccaccatcaaaatcagagtcatattgagtgggaaataagttcagcacattattgaagcgtcagttttgtggaagcagctgaggtcagtactgggaagttcttgaaaacagtgagtgtgatgccagaagatttaattgagaccagtcctgggtaagcagctatggtgatgggaatggatctgaggacaccaaatgctaagacaggtgaactcattttttttagtcattcttatacaaaggataagattttggacatatcttctttataagcacatatattgacatatgtgtgtttcattatatatgtgcatatgtataacttaaacatatatatgtacataaattactagaatttatattgttttaaaggaagaattaccacacagcatatgactgcacaatttagtatacaactaataattaattaatgactacacaattagctcctttttttggaatgacataagaaattcaatcacaaatagaagctattcttttgaattgctattagaattcactgatgctgtgaacagattccatgtgatcagtacatttttccatatagatagactgtatggaaagcaaatcatatcagtgatatgtgggaagcaaaattataatcaaaagattatgtgatgagttgggtgaatcaatgaggctggtcatggcagtgataacagtcatattgcaatgagaccattggagtatttctgttccctccacagtgtttctgttttcttctgttatagacacaccgagaatacattttccctggacttgtaagttgcaagatgttattttaaagaggcagccaattcaggacttgacagatttctctaaatcttgtgcagtagcatcctcaagagcattttgagaaggaccattttagcatgtggtccatccattggtcctgttatctaccccctgtttcatctgtaacactctcacattcatcatgttagaacagggatcatctaggtatctgcctatttacttttttttgtttgtttttgagatggagtctcgctcttgtcacccaggctgtagtgcagtggcacgatcttggctcattgcaacctccacctcccgggttcaagtgattcccctacttcagtctcctgagtagctgggattacaggcacatgccacaatgcctggctaatttttgtatttttagtagaaacggagttttgccatgttggccaggctggcctcaaactcctgacctcaagtgatccacccgcctcagcctccaaaagtgctgggattacagtcgtaagccaccccgcctggccctgttcgcttttgagaagcaaatttgcttgtcaaaaatgtccccttttagttagttagcactaaggataaatcagatgtgataaggaaagtcaatgccacagtggaagcacttctacttgaagcactgaaaacacatctactctctaaaagtacaagatgttgaggagatggtgtctggccccaagaatttcaccaaacatcagcagagcatttactcacccacaggctgaggcaggagagaaatacagatggaagaaaagatgcacccatctccctcctgccaattttttgttaaaaaaaatgctgggaattatttaaaaagtatattatctccagaaacagtaattataaggctggggatgtggatttgattgaaaaccaactgcaccaatgtgttcctagcgtttaaagtaatagtgtatgtattattattatctgagacaggatgtcactctgtcagccaggctggagtgcaatggctctgtcatggctcactgcagtctcaacctcctgggctcaagtgatcctcacacctcagcctcctgagtagctgggactaaaggcacatgccaccatacccagctaatttttgtattacttgtagagatgtgatttcaccatgttgcccaggctgtcctgaaactcctgggcccaagtattctgtcccccttggcctccaaagggctaggattacaagtgtgagccaccatgcgtggcaatagtgtatatattaatctctactgaatttattgaagctttttatatatgaaaaattatttccctctcttctgaccacctctcacatacttttctccctctctgttttgcacttctcatgtcatgtctccttgcctctaattcactcccactcagtgtttgcccctttgagaaagcctaccagaaatatcaactccattttcagaatgcccgcagtatgccagttgtgtgcccaggtatcttcccaacatctctcctccatgccccagcattgccactcaggtgttcttcacaggtatcctgtaggaacagcagaggattagagacactaggtgggtccacatcgatgggctcccaaatctgtgttcttcctataccatgtcacctcctgtgctattaaatgatgtattaggggcagataatggcttccaatgagtgcttagttcacaattaccacagagcctttaagatttctgtctacttgtaataaatacttctaataaatcctgaccaaaagaggctaagtaaatgtaaattgaagccagaaacaaataagaggaagtctatttcattttagtagcatattttagaggtcagaagcaaagctttctaaatatctgctcacagtctaatattatattgtctgtgtgtccaaaattaattcagtctataaaggtcaataatgtaaaatgtattcatgtgttcaggtaaaaatttatgatgtgctataatgtgatgatgtttgactagtttacagtcctggtgatacaccattggaagacatttggaagtgataaaataagggcagatttttgtcgtttctttatagaaacagtaacctgaaagtcatactaaattttattgagagtccatccctaggtaacattaaaataagtgttcgtctctctaattctgtcattttcgggagaaaatctagaaaatatgccaattaatcatgtagttagataattcattttattatcttcatccgtgtagaaaacaccagagtgtgaaatgtaacctgcaagttttattttttattttttcctagattgtcctctaaactggactttaagcatagttatattttacattcttggttaaatttcccctctggtttaattttcctttaatttattttgatacctgttgtatcaaaatgttatttgtactgtaatattgccagttagctggagatgaggaaaattaaataaggttaatagattaaacatacatgcatatgataatttgatgtcaattaatttgtatatctgggaacaaacaggatgaaaaatatattttcgttatcattattattactaccactgacattcttctaaaggctataatataatcaagaagttttcaatctagattccagctttgtcacttactacagttcaaattgaccattttctcaaatcctctgtttcttcatgtataaaatgggagaattgtttattaatttgttatagtggggaatgaatgccagaaaatatatgaagcatttatggggttgcctcatgctccctcatgtcactgaagttcactatctcagaggtgtcattaaaatgtccttctccagtgaccctgcagccaatcctttgcaaactcagttttttagtttttgactctatcttagttttattgctcttgcccatgttatcattttcattccagatctttatcacagcttacatggactatagtagctgcatcctgatgagccactctgtctcctcacttcatcatccaaaaaggttaaacgcagtaacacccttacctggttcatattctttcttataccccttttgctgattgaactcaaatgtagcatcttagcatccccggccaactacagtatggtctctcagttcattccctactgctccatagtttataccctgtgatctaataaactgaactttttattcctatgcatttttccttatgccttacttttgctcatactgttctttctgcccacaatatccattgttactatccatttctcataacctgtctccatgttggcacccacaaacgcacacagcattgttttacactggactctcagagcccttgactttccttctcttatggcatatatcttatctttttctacgtatatgactgtcagtcatgtatctgtcattttcctcctactgtacggtaaagtctttgttgggtaaagatttagtcttatttaccactgagtccctgggagcatccagtgcagtatacatagcaggtagccaatgagtaattgtcttattgaatagctgcatctcaaagagctttattttcctgttattagacctgtaggattctctaggtgtaaagatcacaatattcagagcataagctttaaaaacagctattctctcttgccaactggcctctggaggaagcatcagagccacagataaggacagagccctgtggaggcagagggggaaacatttatgttgaaagagcttttaggatagaagtagatattaaaattaaatgatatagattttagttttataactggattgtaataatttggtaaatgtagagtctgtcagaagtaatccacatttgttctaattaggtttatagataactgtaacaattaataacttaatctggacttcagttttacttacctattcccctcactcttcattgttacttccaaatgaagttttatgttttaccaccttatcttttatacacaatatctatgaacttttctttatgccagcaaattagataattaacgtgtagagggatgaaatagtcttctcagcccttcttggagtttccatcggatcattacttaagttgtgatcagatgatctcacttctgagaaaactgtttgtggctttagtgataattggcaggaaagatgattactattcaggccctcttggcctgtgggcaccattgggagtagagttggtacaccttggtgccttccatactaaagttcctcctggacttacaacaccagcacctaggcccatatgctgctcttaggacaacaatgcagtttgctgagggtaaaaattcttctctcatcttataaatttgggtctcctcttcctctcctgtccactttgaccctttccatctcagcaaggctagtttaccaaagctcatttttttttctgccataacaataatgctatgttataaatccagttatatggctgtcatggaaggtatacttaatgaagaaaaaaggagttcagatttaacacttggtatgcatctttccttctttcagctataaagatcaaaataatcaaagaacatgataatcttttaaagacagatactactacttcctctagcctcaggttgtgttttcttttttgttgattgcttgcttgcttgttttgtttttctttatttcctgttgttgaaagcatgagaaagctataaaaaaacattttgggatctgccagctagtgtctcccagatttctatagcctgttttaaacattgtaagaagtagttagactgaaattgattctagtgttgtgagcttatattgtaaataaataggcaggatgacgtggataacttacagagtaaaattcaatgatctcgactcctctgtttcaatgtcaaataaatcatctttccatctttggactgtaaatgtaagatttattcattgagtagatgtttattgactttattcctcctaccaagtactgttgtctgagctgaagatacagaagtgaacaaaactgagtccctattcttatgaagctaacatccttgtgtagcagacagaccataaacaaatatataacatggcaagaggatagttagagatgtggatgtgggaaggtacattttcatttagagcggtcaaggaaagtatttgtggtaaggtgacatttgagcaaatctgaattaaatgagcgagggaaccatgtagataactggagggaagaacattttgggcagagggaacaataaatgcaaagccctgaggtagaagtgagcttggctaagttaaaattttaaaatatattaagaataaaaattcaataaattgagtgtaatcactattcaagtgttctatatttgcctctaaagctaaaaagtgtgctaactgaatctcagttaacctcctagaaattaattggttatttagaacaattagcaaaaacattatatcaagctttaatcattaaaattttacacagaaatatcttggttaattatctgtgcttttgttgaggttttattgcatttttatagtcatctgtgctccaagaatatgttcacattttttctctaatccttctaattaagttaaaaccactgtccttagaaaagaccattcttttagtctaggacccttttagtaaaaaaagaagaaagtattctttagaatctcttaaaattgtcaataggtctaacacagcttctttcaatgtgagcaatacattgctactgacaaattaatatataaaaagcctattgtattatttatgaaacaagtctcttggatattttggtaattttatcctggtgcttgaatttttttcaaagagataaatattattaatagtttttggacagttgttcaatattaacaaaaagctatatctgatactatattggtgcaaaatatctttatttttaattcattctagaagagtcttgatgtaaagacaactctaaaatggcatctattccagtaagcagtatttttacattctctattgaactatatggaaatctttacctcttttttcaattatttctcataatcctcctttattttttatgattgattcaaaacaagaaattaaatatcgttatatttcacttatttttgttatatgttttattctatgtgtaaactaaaatatttccaaatctttaatgcagttatttcacagcctgcttttaaaaataacatatcaatattcttggaaataaacttcagaattccagatggtttaatatgtactagttaagtaacccctcagggaccatgtggttccatgagtctatgtcaagccattgccattacaccaaaatcaatggtggttggaacaatcaaagagaagaatggctttgttgaatattgtgaaaacaaaaaaatgcatgaataatttgtaatgagagaaaaagacagagtgtgcaaataattggaaacacataaatatataaggcaagattttcaaaaatttgaattgtacaatgtaacaaaatgtattttctcatatgttttaattaggcaaataacctagctctctttgtgaaatgatagaaaatgcgtcacttccaagggtacccatgaaggataccataggtagttttggagtctatctccctagtataaaccataatgtgatttattacttaagtaaagctgacttttccccatggcagttgcaaccagaggtaaacgtctctcatgcatttcactcagtgccgttggttatttagttttctctcccctgtacctttaacatctcttcttgtatttactctttttccctctccttttgacaactccatcctcatctgactattacactgcctgtctcctatccttgacagccacatttcttaaaagagtaattacattcattgtttttacttcttcaagtcccacaccttcttcaacctattataatctccttcctaggcatttcgaaggttctaaggaaacaagctaggattttcattagcaaacataatacacttttttttttcttttttgagacggagtctcgctctgtcgtccaggctggagtgcggtggtgcgatctcggctcactgcaagctccgcctcctggattcaagccattctactgcctcagcctcccgagtagctgggactacagacgcccgccaccaagcccggccaattttttgtatttttagtagagatggagtttcaccgcgttagccaggatggtctcgaactcctgacctggtgatccacccatctcggccttccaaagtgctgggattacaggcgtgagccaccgcgcccggcccacagttttacatttgcttctcttattgtcagcagcatttgaccatgtaatcctcctgttaaaacctgtctaatcccttagttatgatagccttactttctcttatttgctctccctctctggattgctcttttcctctttcctcagaaaccccataaacttggtatttttagggttctgtttatacagtctcccttccctcattctaaaattctcgtgttctcccatagtgactttatttgtaactgtgccttatttaattaatgctgcttacataaatgacttctcattcctaaacagaccttccttctgacctccactattatctgtctgttcccaagcaaagcctgggagatgtttcaatattctttctaaccatccgtatctaatcagctactaagtcttcagtttacctcctgaagatctcttgacattaggtatctctcatcttttatctccactggtgccattagtcatatctactttccactggaatagaataatttctgtaacatatgtaatgccctgtcttaaaaatttgtcagtagccacttatgccattaagaacaagtacatgttcctcagcagagtattatatcatttttggctatgtttatattcttttgtcactttacttttattagccttaagaaagtctgttatattggttgattcgttaaaagttatgaaatcagattactggagctcaagtctaaattctgtatgaattgcacaagttatatagttctcctctttgtttcctactaaaaataccatgagaataaaagtatttacttcacaatattgttgtattaaatgaatgcttgttaatattcttggcaaataaatagggactcaaaaatgttggctattgccaattatatgtggtttccatgctgttttatactatttcaaaatgtgtgtctttgcataaaccatttccctcatgcaagaatgtactttgacacctttgtttcatcattcaagatttacctcaaacatttcctcttctctgaatctttctcaaagcacacctcatcccagctccttcccctttactcagattgctattgaaatgaaagcttttatgatatttgagcatcagtcaattattcactgttgtactgggttcattttttttttttttttttttgtttcagacagagtcttgctctgtcgcccaggctggagtgcagtggcgtgatctctgctcactgcaagctctgcctcccaggttcatgccattctcctgcctcagcctcccgagtagctgggactacaggcgcacaccaccacacccggctaattttttgtatttttagtagagacagggtttcactgtgttagccaggatggtcttgatctcctgaccttgtgatctgcccaccttggcctcccaaagtgctgggattacaggcgtgagccactgtgcccagcctgtactgggttctaattgtggacttccttcagtctcctgcatgaggctctaagctccctggaggcatggctatgtcatatgcatgtctaacccatcaccattgctcaggtgagagtaagactgagactaagtagattctcaaaagaatttgaagtaaaatgaccaaataaattaatgaaaggctgggacatatgtatgcataaattaagcttcacaggaccatttttccataatagtttgccataagaagagtttttgtacgtattaattgatttttaaaaattttcaaactgcttgtggtatttttctgaatgctgaaattgacagttaatccattcttcctgactaccaataagatatagtctccagctgagtttctcagtaatacatgaatagagagtgtgctagtaatatcactgatttgatgaatatgaatatacaaatagtatggtttagaaattaatcaaatttcaaaattatttacaaatctctgcctttactttgtattacctgaatataggcaaagagagaaaagttgattacaaactaaattgccccattggcttcctcatttaacatcttacacattttgtgtagaaataattactttaccacatgaccaactgtaccttgtactcagaactctgcataatattaggaaacattaatattgatatgataattatagaaatcatctgatcagttcttgtttatattttagagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttggaaaatgaaatttactttgagtagctttatttgtcattaaactcagttactccataaaataggcccacacttattctttcctagacctaattgacctcttatcagaaagtgttcagtatgtttgagatgaaaaagtaatctctaagcttattgcattggtcattagctcttttacagctataaaaccagaagagattatagattttcatcttttataccaaccagcaacagaatgagtgggtttccttctgcagctctcatactcccttcaagagctctcagcccatgcaactgtgaattgatttgaaagctaaattattaactcattatacttgcatccatcctgagttagagtttgttcacagaaaaaataagaacaccatgattcgcctgtcattaaatggcaactgaacaaattgcatagttcagcatctacagggacacgtttgaagtcattcaattggattcatatcaatttcttgaataactgtaaatagcagtgctttctgctggtagggctttgggagaacatatgtgtttctatttagtttacttaaatgaaactctcccaacaaagatattgttctctgtccatgatacccacttaggacaacaaggcatttacttatggttggttatcagtaaaagtaaatactttaaaggatagccctggagaaagcaaagataagtttacaaattttaaggcagtcttaaaagccattctttacataggaaaaaataggctgtctaaatggacttgtgcctgattttccacaaaagtctttcctccatgctgtctttttgtaagttgaaaatattttatcaaaacatgataatctctgcagcattatataacgaataactagagttgggaatgtaacatggtggtgaagagctcagattctaaatctgtaattgtcagtaaacttgacaattatttttttactctgtgtgccagatggtcatttgagcactgggggtataacaggtaagagacaaaaattcttgctcttattgagtttacatttaggtgataaggcagacaatagacaatataaataaatatggtatttcaaatggtgaagtactatggagaaaagcagcctgggagaagggaaagctggtgtgtgttggggggagttggggaaggaggaagtgattcatttcaactctgattgatttctgttttaaatagagtggtcagagaaattcttctaagatgggaggatttgttcaaagacctgaagaagtaggattgcaagccatttagatttctggtgaacaagcattcccaccagagagaacaaaaatcttagtgctgtcactttctgtgtatgagactgagcaacgattgatgttctctaagctttagttttctgctgtgtaatatgtggaccatcctaatgcccgcctcaaaggaatactgtgaaaattaataatgctgttatatatgtagtggagatatatattaaacactgaataaatgttaggtattatattgttatttgggaatttagagtttttctttcatgtcactttattcaactccttcacctattcattagtgcccggtacgattccttgtttgaaataggcagctatagtgaaaaatattctactgttttcagtggcaaatacatgttgagtgcttaagtgctgaaatattagataggagaaaaattgctcaagctcttctttctctgtttttaatgttttgctttactaaagttatatatatagagtgtatatatatgtctttttttaatataatctcctctctactcccattttccaatcgtcagaagcacctcttcaactcttcagctatttttcttgatatttgctccatatacttcagtggcatgcttacattgctgattcttgattttttcaattttacacattacctattcatttcccacaacaagaactggggatttggcttctttctgccatcatatatgtccagtttcgatgtccctatcttaccaatacaattatgtcatactttttgttagatcagtattgtgtggtcatgttgtgactataaagtactcttcacagctgtaccatacatattttttgtttctctttggctttggttcccttttgttaataatgatcttttttattattgatttatttgttcaccacttcatccccaaaattctcccttaggagtataaatttcgctgaaatatgttccaacttcagtgtcctcttagttgctgcttcttggagatgccttgctggagcatttcaattagccatagtctgacctgactgctccccaggtctgcttcagagctagccttcatcaccgtcacctcctagagaccctctttgcctcctccccccagttgaatgctgtttgtatatcccatatatttcttattcttgctttattctcttgttttaatagtgtacatatccaggagcttccagaaaaagggggcataggagatatatttggacacttttcacatctgaatgtctgttccacttacaattagttgcctggatatagacttctcgtatggaagtgatttctccctagggttttgaaggaatttcttttctgtgctttagcttctaatgttgctgttcaaatgtctgctgccattcttatgtttaaaaagttaaacattttatttaatttaaaacatataaatattcattcattgactggtattttagttgtaaagtcaagtttatttctttgaatatgaatccccgattgaatttccttataatctcacatgaaaaacacctgtaatgcatcatctataatttgtgtttcctgttctttaaagagcagtggattctagatttttcatttattgacatgccccttccaattttgacatccttttaagctgatcattttattcctcactgcttacccagtgttgtgctgttctggtagcatcaccaaaaattacaattatgtttattattattaatttttttcatattttattttgcttctattatttgtcttaggttgaattatttggaagtagaacctgaggtgaggattcaagtaaaagcaatttattaggaagtgttcccaattaaaactgctaggaaaatgagaaagtggtcctgaaaaggaagaagttcacatatgagtgtaatatcaaggataatgccctgaggaagctttggagacagtgcagaacacaccttagaattattcggtttactagcagcagccaggttgtttacaaccgtgtgcattttagtcactgggtaatggtgccctgggagggcataaattcccaggctcccaggggtctggggcaagatgggatccagcagcttgaggtacctctctatggaaagccttgagtgctggtgttggactgaaggcacagcaggtactggtgttcatgatgatggttgaggaatttgaggatatatgagcagaccactgaatgaatttgctacattattttataaaaattagctaataagaacccagagttctcatgaacacactacggctcacacaaagatgagttgataatcaccaagaatgctgaaagcaagattactttggtctcagtcaggcactcattgctcttaaatcacttggctcctaatttagattatggggaataaaacaaaccaagagatgtttttaaatgcttgatacattattaaaattgtctaaaaggtaagtgtgattgattatggaactctaatatttttagctctccaggaaattaatccttataacacctaaaattattattggtcaatcctacattctggtatcacacacgttttaagaacaccctattaaatttttcaaaaagtgtttgttgaggacttacttgtgctaggcactatttttgttgttggagttaaaactttgagcaagatggacaaggtctctactctgatggaacataaattctagtgggttgagaccatgaacaaataatgattaatagaaatatgagatagtgataaatactgtaaagaaaacaaaatggaatgaagtattatagagtatgttcaaggaggacccccacccccacccgccatggaagagctaatatatataatctaaggcatgaatgatatgaaagagccaagcatgggaaaacctgaggaaaaattactccaaggacagggaactctggtgcaaagagagggatgaggttgttgttagaaaatctgaaagaaatttatgtatttggagtgtcagggcaaaaagaaaagatgaggttcaaagttattcagggccaaataatgaaaatccttgtaggccatgggaaagaattgtgtgtttctttcactttgttttaagagtcatgggaagctatgagaattttaagcagtgcactgacgtgatctttatatttttgaaggtttctctgaagtgtgtatgcaaaatgcaggcgagaggagagaaaggggaactttataggagggcatttctttagaatgaggcatgatactggagtcaaagagaagtaggcagattctgaaaattatgtggaggtagaattgacaggttatatttatggagaatagataagggactgaggaaagagtgaactcacagattcctaggtgattgtcaggagagactggatggatggttggaccattttctgatctttcgttatgcctataattatcaagtacaattgatttgaagcagcattgctgtactctttattgtatgtagagtttaactataggtaaatgcacgctgttcattcagacctttgtgctttgtgatgatgatttttgcccttttcctgtttgtttatttatttatttattgttaaaacaatgttttgacatacaggaggagcaagaaaaaatatctgctcatattatgccatctgctcctttttaatttctttcaaggaaattctccaagggagtatcttgtctcattgatgcccatttcattgtcagagaccattacatcccaggttttaaccctgacctgtcctgtggctgtcagaactggcttactggagacatttttttccaccatggagagcacttagctgtgcatcctgccggacttctaggaaggagatggtttccttccctcttctgctgaattcaggctgaattcctaaattctggtttgtgacaccattgtgttatattgtatttgtaactcagtagattcattaattatttctgattttaaaaaatcacatgagaaacattccaaattttctggttaatctaagtaatctcttgtctttgactgctagaccctgatctcagaagcatgccggcttgtttacagccctgactgggaaaaggcatgagtagggggaaatggatattgcacaccatcattattgaatacattttagcagccatgtgaattagagtagctcttaataaagagcttgaaggagcttattttggcactaagtgaaataattccttagaaaacaaaatactaatgcaattttaaaatataattcacttctctagaaatatatatttttcagaatattggctcttattaaaatgagatgcaaaaatattatgtgaaaaagggttcataaaaattgaattggcctataaaatatttttatcacttcttctgattataaaaatatgtctattgtagaaaattgaaaaaattataaagtcataaagaagaaaataaaaacaacttgtaatcccactgtcagaagacaactgtggttaccattattggataattctttgatcttttctcgctattcctacatacatacatacatacatacatatatatatgtgtgtgtgtgtgtacatacacctatataaaggatatgaatattttaaactatatagagattttaatgatttgagctcatactgtttgtactattttatacgacttttccatattattataggtgcattggaaaatttaatgactgcattatattttatataccataatatatttgtcctgtttttccatttggggacatttaggttgtttccattatttttagaaactcagatttttcttttatagtaaataacactgaaacgaatagttttctaaacacttttttttacaggttttctcactgtttccttagcataaattcctaaaatggagttatttggttaaaacgtatgaacatgtaaaggttctttttatttattagcaaataacttactatatgcataaaagtatgatatgccttgttaatttttgccaacttgatttttaaaaaatgtaatttgcttgtttccttttgccttactttgattattggtgaggttaaacatttactcatacatttatttaccattcatatttattctacgaaatgccattcatgtttttacacatgcttcttattagtgtttttgtggggtatctatattttaatgattgatttgtaaggtaggtatcgtactcatatttgttttaagtatgttttctaatcggacttttcttaaattttttacaaaacgttattgatatagagaggttttaaggtttatataattaaacctatttgccttttcttttgtagttttatcccatatttcagtgcttagagacattaagctggaaaatatctacttgtcttctatagctttacttaaaattttaatcaatatagaatttatttgatttacaattttggatatgctaaaatagaattttatttataatttttattaaacttccctaccttcatttgttgactaatttgatcctttgtgaaatttcctttacaaaattgtttttgttattattattattactatgtattagtacatatcaagttcatatataccccaggaagtttcagggcagtctctcagttctgctattctgtcagtctttcgtatgaccacattgttataattgtttcaatatgtgtatatacacacccaagtcattttttggtgtgtttagctatttttttgtttatttagactaccagataaaatagttctgagaccctatttatttctttcactggaatttcattaaattttactggtaatttgctatagtctcagaagtctgtctgctcatacatatctgcaaccgaaaaatatacaatatttctccattctttcaaaattatttttatgtttctctataaaattatgttttatacatagatgtatcccatcatgttgtgctcgaatattttaggttgtttatgatttttcagctatttagattataagttgatttttgctttaaccagctttgcatatacatagctgtatttagtagggattttccagagaacagaaccaataggatatgtatacacaaacggtcatatatatacatacacacacacacaagattttataaaggatttgctcacgtgtttatggcagctgagaagtcccacaatttgctgtctgcaagctagagacccaggaaagccagtggtgtagtttaaaagcctaagaactgatgagctgttggtagggagtccagtgccagtctgaaggcctgaaaacaaggagcatggagggtagcagaagactgatactttcagctcaagcagtcaagcagagagtgaattgaaccttctccctttttattctattcaagtcctccagggattggatgctgcccacccacattggggagggccatctgcttttctcagtccactaattcaaatgccaatcttttctggaaagattctcatagacatactcagaaataatgtttaatctgtggcccagtctagttggcacataaaattaactgtcataattgcataaacattaattattataatttaaacttttatcctgtcttattgatttaaatatataacttttttcacttgtttttcaggcacaaaaattaccccaaaatattgataatgttatcttctcatttctaatactttttgctatttcatgtctgatactgttggctaaaatttctagaaaattataataacaattagaaatgtgtttttcttttggtccagattttattagaaatctatcttttgtttttacttttgatattctgtgggcctaatattatttaacatataaattattctgtttttattttcccaggaagtgcatttaaaatcaagtgtgcatattaagatttattaaatgcctttttagtttctattaaatttgtcactttttctttgacctgttattatgcaacatttgctacgtagatttctgaatcttaaaccatccttgtattattggggtattccttaccagatcataatagctgaagcttttaatgtattaatgaatttagaatacttatattttatgacacatattcatctgtaattggaattttagatgggcatatggaatgtatgggaaatagatttcaagccaactacaatccttcagtggtaacaagcattactatgttgagaattactgtgaagttgcaggttcagtcccatgcactctaggtaatgatggaatgtgctaagtggtgactgaatgccctgtagacagaagtctgtatttgtatgcttttatctttcaagtctgcctcctcctgttcctgcccctgttctttagtgctattttgagaaaatgttgatgttgggagtggagttatgcttcattaaattaattagctaagtttttgaacacataatcaaattatgtagtatggcctttaaaactctgagaagtttttagtaaactttattttctgggatggttttcgaaagtaacttttaattataatttttgataattattttactgtatttctttgtgatttgttcaatttcgttagttaattttagcttttaataaattgtaattatcgccgggtgtggtggcctacgcctgtaatcccagcactttgggaggctgtggggggcagatcacctgaggccgggagttcaagatcagcctgaccaacatggagaaaccctgcctttacttaaaatccaaaattagccaggcttggtggtgcatgcctgtaatcccagctactcagtaggctgatgcaggagaattgcttgaacccgggaggcggaggttgtggtgagctgagattgcaccattgcagtccaccctggactacaagagtgaaactccatctcaaaaaaaaaaattgtaattatccagattttctagaaaaatacataatattttctgaggtaatttttcccttataactttaaataactttcatatgtacacttttccatttcttactgaattagtcatttccttccttttattaggttcaactattctattattttttaaagatgtcagaacctttgttcagtcagttgtcaagacctgtcattgtcaaccttttaattttgtccggacttctatttttatttttattgccattgatttcttcaggcttgctttttcttttcttgctttcctttttttggtttacattaccagaaccttttaaaacccttttcctgcaggctatactccatgttgtgttcagaataatttttcaaactccaaatatgataatatattcattatttaaatttttgaattattgtttatcttcggggtaaacttcaagtgctgtaacatggttccacccactactgatgctctgaatgctgcctgcctttcaactgtttcctttctttctgtactctatattttggcattgctggacctgtaatgcccatctctccactgcctctccttcgttctcccttccaacctccccctcctccctgcaccactcatagccttgcctacctggtggcaaactactactcagaagttcactccaaaatgacttctgcatggttgattttcttgcccttactctcagagatagtactttttcctacattctgcactctgcctttttttccaatactgaaaatgagtggctttaattttttttagaagactctgttttctttaaaaagcatcttaacctctaaggcttagaaaagaaatagtatgtactatgacatgcaaataattgcattgagagttctcatgattgtattccttttctaggcattgtcatgcttcttgggagctgagtcgaactgttggggctagaaagtcatcacagctatgccctcagttcaagatcaaatggaacttgatataaataacccaaatgctttttgtgaatatgcttcatgtctgctgctcagatgtgtctatttatgtagtatggttatcttgtctccaataggtaaatctaaaggatatagttgatccataatgcagaatttcatattctgtcctgtatgtcctggcccaccccattttgtattggggtgaaggctaagttgctataacaaagaaatctggaatacagtggcttttaagaacatatcaattctcattgctcatgtaatattcttgaaattagtgctccaggttattgacacagctctgctcctggtgatcattcaggagctcaggttctttctaccttgtctttccactgtcacctaatgacatgttcacaactaggacacaagcacctcagtgttctagctaataggaaggaggagcatctgttttgagagcccccagctaaattggggtaccagtaccagagtgactggcaaccctgccttaaagagaaataaaggggagctggacagacatggctgtttccagtgtacctttcacaggatacttctttcacatagtggacagcctgatgcctatttgtccaacttgtgaccaggggatccttcacacagacaacttgttaatattggcagatgcccttatgactcttgtctgacctgtgttcagtttatacttgcctgacattgctctggtgctgggagcctgagctcatgttctccctggtgtcttgggggaagcccaggctggggagtccctggttcttcagatggatagagcaaattcaatatactactgcagtaggaaacaagttcaaaggtttttacttacagatcctgggcgagaagggcacaatgatttgggtagagctgagaagagtcagtcagggagagaagagcacgaggcattttgcagtatatgtaagggactagagcatggatcattaagttctcactattaaaggataaagcaggaaagtagggatcccagtttgttaggtgggagagaagttatctctgtccactggcttgtgccatttgggtgtggcatagaactggaaatatgtcaaggtctagtgagccctgctgctgatagaagaaagttaaatttctattccaaatgaatgccaaagctacataaaattataagaattcactacaggatcccaggcccagaaatggcacatgtcacttctgcttgaattcatttaaagagaccttagttgcacggaaatacctgcatgggaggcttaaaaacatagcttggcagctgtagcaccattactggttaaggagagaatggatggtccactagccactgccatcacacatctctatttcaagaactgcgtatttgaaaataatagtttgggccttaatgtattaaaaggaactctaaaagatggaagcacagaatgtattattgcctttattttaaaactaccagttagttagaacttatcagaataaaaatattgcttatttaatgtatctcaatatgctttgattgagtcactttggtgtaatgcaaggttgaagtaatggttttcagaccgtataaccataaaaaataaaggtgtttaaaatttttcatcttcaattcctatgcaactgtaaaaagctatctttgatagagtggcaaatatttctctaaaagcaactaattcagagatattctttagtcagctttagtgtgaatgaaaagaattagcaaatataattctgtagattttcaccaaagttatattacagggtgggcaaggctgtgagcaagaaaaaagcttaacaggaaccacaaatggtgtactgagttaggtgtgactagggattttgtcacctaggctgttgggcagtagcaccatcttggctaactgcaaccgccacctccccggttcaagcgattctcctgcttcagcctcccgagtagctaggattataggcggccaccaccacacgcagctattttttgtacttttagtagagacgggatttcaccatgttggccaggctggtctcgaactcctgacctcaggtgatccgcccacctcggcctcccaaagtgctgggattacaaacatgagtcaccatgcccggacactagggattttattctaaagaattagtcagaaaaatagaaacaagtttgtaaatagcaagaatggcttcttctcttccaactgaatgagaatccaaggagggcagaaggacaagcaatacagtatgttaaatgaaatgcagtttacagtgaaaaccgatggagtgcatctagtgtcataatttggattgctcagtaaggaactagtttggtgtcacttctataaagatgtattagccaatggatcgcatagaaaatgcattatcttccattcttaaggaactgtttttagagtctgttttgtgtttatgcccattttaaaatgttttctatttgtggatttcatatataatgatttatcatagtaataaaaaagatgggagttcaaagcatgaaatcatattaggatagctctctgatgactgatatgacagaaagatgagactgatgtttcattctgtaaagcactatcatgacttagctatgaaacaaactcataaatatgttagattgtgtgtggacattctttcatacatgaatatgacacttttagtcatattctgtagatctttaacatggtgcattacctaaaattcaatattattatttttaaatttcaatataccgtattactaaaatagaagggtgccgtatcttaaaatctggattagcttgtatttgattcattgtgtttgaactcacataatggataaactaaaaatctatgaatatttttgagaaattaaagagattgttaaaatttttcatgtcactaatcagtaatttccactgtctgttaggaccaacctccgcatattactcacttttatgttgtgttttaaatttttgcacaataaaatatatcaaatatatatttaaaataaacatatgtatatgtagtcataacttggataaacctaggtacaagacattcagggactttggccattaattatgaaaaaaaatcactgctttagatataaggttgaaaaagatggcatgagtcgctttacatcccatttttaattatgagatcaacttatcactaatgtcctttcaaaccaccctaaaatggggacaattatttcatcttgatttccaatgattgtttttaagtctttatgtaaaattaatagaaggaggtaatttacaggtcctgttaatgaatttgaatgcaaaatactgtgtgtattattgttaattgactttaataatagtgtcatacattatttaaattgaatttatattttatttcatatatgtgtatgtttgggggacatttttaataacttacatttgagtgaaaatgcaaaaatatttcttccaataaaaatgttgccagttttctactgtgtcactgctgtcattgtgtaaagatttgataactggaattttacagcacaaatttgtagtccattaattatgatgatttattcaatatttaataagagcatcccagaaccttataaaagttgaaatgaaaagaccaattgtttaaggagaagaaaaacaaaacaaaacaaaatatgtagatgtagttggttccacataactgtttctcatcatgttcagtaaattcacagaacaccacaatcagccagaaactaagctggtgaaacggtgagccttcttgtttggtctggggtgtgtgtgtgtgtgtgtacgtacatgtgtgtgtttgtattatacacgcattgatatggtttgtgtccttgcccaaatctcatgtcaaattgtaatccccagtgttggaagaggggcttggtgggaggtggttagatcatggggttgatttctcctttgctgttctcctaatagtgagtgaattattattatttttttgagacggagtcttgctctgtcgcccaggctggagtacagtggcgtgaactcggctcactgcaagctccgcctcctgggttcatgccattctcctgcctcagcctcccaagtagctgggactataggcacccgccaccacccctggctaatttttttgtatttttagtagagacagggtttcaccgtgttagccaggatggtctcgatctcctgacctcgtgattcacccgcctcggcctcccaaagtgctgggattacaggcgtgagccactgcacccggcgtgagtgagttcttgtgagatcttgttttttaaaaagtgtgtagcgcctcttccttctctctctctttttcctgctccagccatgtaagatgtgcctgtttccccttcaccttctgccatgattgtacgttcctgaggcgtccccagtcatgctccttgtaagccttcagaaccactagccaattaaacctcttttttaaaaaaaaattttttttaaaattttaaaaaacctctttaaaaaaaaaaattaccggccaggcaatttaaaaaagaggtacattttaaaaaaatgtacctcttttttaaaaaaaattggtgtcaggcgcctgtagtcccagctactcgggaagctggggcaggagaattgcgtgaacctgggaggcagagcttgcagtgaaacgagatcgcgccactgcactccagcctgggcgacagagcgagactctgtctcaaaaaaaaaaaaaaaaaaaaaaattacctagtctcaggtattacagttttttaaattattattatttttaacttttattttaagttcaggggtacaagtgcaggtttgttacatagataaacttgtgtcttggggatttgttgtacatattatttcatcacccaagtattaagcctagtacccattaggtgtttttcctgatcctctccctcctcccaccctccatcctctgaaaggccccagtgtgtgttgtttccctctatgtgtccatgtgctctcttcatttagctcccccttataagtgagaacatatggtacttggttttctgttcctgttgtaatggataatggactccagctccatccagtccgtgcaaagaacatatttcattcatttttgtagctgtatagtattccatggtgcatatgtaccccattttctttatccagtctatctctttatagcagtgcaagaacagactaacacacacacatttttgttccttttaaggaaacaaacataggaataaagtagtaattggaaagactgaagtagtaactgaaagattttgctaagctctctgcgtatgtgggtgggtgtgtgtgtttcttgaagtaatctcttacacttctaattacccctaacaccatagattagtttaattaatcctctaataatttggcctaagagaaatttagcaatgataaggtagtgacaaaaattggttatgatttctacatttttgtatttctgataatttgtttagatattttttaggttaacagtttacagacagtaaaataattcattacaaacattacaaacacttcatgtccactggtcatgatactagataaaactttcattcaacatgctgagatgaccaagtctgtgacaaataaaaatagtactctattttaccctagattactatttcagctgagcaacaacgtcttgattatacctcgatcatttcagtcattttaacagtgtctatatttttagttaattgattgtagtaaatatagctaattctgttgattatttatcactgttctatatgcctattagagttctcattatctcaggtgcagttttaggaggcagttttaacctattaaattcacaaggtttggtccagttttaagagacagaaagaagtaataatatactcacaaattagacttttaaaatactttacctgatttggggccttttaatatatttaatcatttagcaatgtattaacatttttgtatgcatatttatccctaagtcatgtattctggatgcctttgtcttctttctgaacaatgtcaaatagttccagtgtgatttccctttttaattaggctgcaaggacagttggcccctgataggattacgggatggctttgtataaaatttgcttctgattagcagctccaagactttgacatcctacagttttgatctttatctcttatcagttgttctgatagctcctctacaataactgtatttcagccatttctaatgcattggtattgaaaaaggaaaaaagatgtttaggtaggaatttttgtcattgatcagattttgtatgtttttgtttccttaaaaatttttatattggaaatagttcatatttagcttgaaaatattctggcataaataattaacatgataggaaaatgatcgtggataatggagttttaagagcagttaggaattaccctaaattttaaatttgagacaaatgtgttttccgtgatgcaagaactgctgccagtctaaggaagtacaagaaagagatttttgaattagtgagctatataaaattgtcctcacattgattttctaaagtagcctgccaatcagaggtcatttttagttcaccattgcctcttacttagtatgaattttccattttgcacacaaatataagaaatacaatttaaaaaatggtacattaggaaagctaaagtactttacttgactcttagtttacattgccttagtgacaccagccaatgaggaatgaaaaatccaggtgagttagagcaatgatcaaaagaaaaaaaaaaaaagaacaagagtccccccaactagaagaatacaattaaaaaaagaggcagtacacatggttaataaacagatgaaaaaattaaaattcacttgtactataagacaggcagattaaattatttttacctatcaaattaaccagaacaaaggcatgcactttagtgaggatgaggaacatacagattcactggtgaaagtaaatgtacacacaacctttcaagttgatagtttggcagaagttgctaaaaacatttaaagctttcatactttttgataaggctttttattttagaaaacatataaataaaaaagaagaaatacacacaatgatttctttataagtatatattcatagagtattatattacttccacatgatggcatattttgcaggcattaaagtgatattgaagaatagtaaagaagcacacccagtacatagtgttaaataaacaaggacaccaaatatatataccttagtatctaagtcctgtaaaaatatgtgtttacataggaaaaaacttagaaggaaaatgcagaatgcatcaagtctgtgttttcatctggaactatgaatttcctacaacaagcatgttaattatactgaactaatgaaaattgctgattaaacaaagaagtgaatgctaaactcaagccaatatataactgcttttctatgtagaacatgttaacggaaaggggaagcatataaagttaatttttgatggaaatgttcacaaaagtagccaatcaatttaataaaaagaaaaatcaatcagttggtcagttctttcagaacagtaaaacattttgtcagttgccccaactacaattattcctcaattgactgtattgataagctgctttgaagttgtttagacgcgtttttggagaaaaaaatattgttgaaaaatacttagtgaaacttaataacagggcacagtgggagatcattaaaatgaatcctcttgcttggttgaggcaatgtattggaatgcagatcttactgatttactgcaaatatctgtatgaaagtgagcccatatattaaaatctgtgtattatagaagccagaatacaagcctgtttgatgtagttgtgatgaacaacaaagttaattagactattttgtagttagtgggtcatctttagatttctttcgagcattacaaacaaattcattaactaatgacattaactattttatgtccctagtgggcacttagaagaagaattgacagttcagtactttgcctctaagctgctggtaatgatgagtctgtatttgtgacatctagtggaaatagattatccattcacgaggtctacactcagatatgacatgctattgttcttcatggttaagaggcatactttttccagctttcactttattgcgtgacttattcacaaagtttctttacagtaacactgttttagcacacttatctttacatattgcagccattttccacagtaaaaccagatggaaaaatcagggataattggtggcaagctgtatcaattaaagggtattaaatctaaagcaggtcgagctgtgtccttttctgtgtaccttcaattcttggtaccttcagttcctgcacacccagtttttggcaccctgttgctcatgctctcaaccattgtaaatacattgaaggtgaaaagctctaaattatagaatattagaggaagatgagatcttaccaaagatcttccattttcctaatgagacatcagaagtccagaaaatttatggaaattgcctaaggtcagatgtagttagtgacaaaattagaattagacttttgttctgttgccctattatctatcatttccttctgctttgagagactgcagatgactcctttcaatagaatggtgattaagaccatgggctggggagcctcattttcttggttcacattagagccctattccttactagctctgtcactttgggcaatttacttaaccttgctgttcatcagtttgttttgtacaatgatgatgagaatactactcgtattggtaattgtgaagattaaatgacctaatatttgtaaagtgtataaaatagtgcttggtataaattaaatgctctatataaatataaatatctagagtaaattaaatgctctttaaaatataaatatctagagtaaaaacaatctagacaaagaggacacattatctcttatgtatagaatgttgtttttaatattgcagccaaaatgtgctttaatattactaatttaatataaaggaaacataggcaccatatcacatgagttctaaagattaatggaagtcatatgtgatatctttggttaacatcttcagctcttacattttcaaacacacccttcactttcctattgcttagaatgctttttacttgggcctcttttgaattgatggtttttaaaatgcacttttagataacaaaggtaacattttaagtcttagaaaatgtacagaaggagcataagggagaaaatactgagctatgtctaaaacttaataatgcttaagtttggtgtcttataaatcagcctctgttaatattgtatttttggtcttttgtctcttgccacaataatccctgaatattgtcattctacaaacaatatcaaatcaatattaaagttcctatagaatatcttaaatttaagaatatattcctttgttcgcatttttttaaaaagcaactggtctttgttttctttggttttagtactacatttctacctagtcagcggccaaataatccctatatatttattcctttcaaatgacctccatttgcagagaatattttaggggtaagttttaactatttctcttagggactgtccatacttgagaaaaacagcctgaggcttaacattttctgtgtatgtttgaaatggcaactgcaccgtcatgcaggcttcattcttgagctattttcagctctggctgcttttaaaaccaagtggagagtgaagcagcagctacagcagggcgagctgtatcatgtactttcaagtgtagacctagccttaaagaacaatctactgaatggcattgaaaggataagacccagaagagatattattttctctattttaatgctttctgagtgccttgaaagtgatgcttgacctgtgtatcataaatccaaaccagaacattttagaagagtcatttatatctcagcttttcatgcttccattgcagcccatgatagtgcatttcatcatattattagttagactaagtgcctcctagggggcattgtgacttgacatatgcggagctggttgatctgaatggcatattctaagtgagatgtcctgcttaagtcactaagaatggtttcagggagggcagtatattttgcccttttctaccccagaatgacctgaaatgacagctgggttcattctgctgacagtgaacctcttgctctgcccgaacttaggtttcttagaggaaaggaaagaagaatcggttttgtaactcatttgctactggtgacatgacaggctgactccatgtgaatacacgattcagagaatgcaaggaagaagaggaaaacaagcattttgggccagtggggaaagagtatcaccctacattttaaatgagtgtccaacttacttcatataaaagagactcagagaaaaggtttatttcaggccttttgttgaagtaatagtttacacaaaggagaacatggttaaataaagcactgattgagtcactgagttttgagtaagcttatagctactcatgaaattcaggatgttattagaagttagggagcatataattcataccttctcacctttatgttttcacctgtcttaaaagagtttctgtttcttccttgaatttaaaaataaaaccagaacatttaatcagtggtcgaaatattttaattttctcttaatttgggggttggtttttaattttttagttatttgtaagccacaatgatggcagaagatgacataatttgtatgtaaggattgccactcatctgcatgtgttcagtgagaagaacctaccactcatctttggttcacctcattttcttattcatatttgaagtcccctgcaatggtcacagaggaattaggatgcttttgttatctcatactggcttaaaaaatagagcagtttattacctcatgtaaaaagacatccactggtggagtagactccttggttggatgattttgcattcattatatcatcaaagattctgattttcccccctttcttccctgtcatctttggagtttcagtcttgtcctcaggctccttcctcttttagttataagactactcaagcagaaaactaggacagcacattctctatttatagtagtggaggatgaggtggaaggaaaaaaggacatctttcaagtccttaaacatctttccttttgtctgattgactccatcctggaccaaaatcagtaatggggaatactatgagccaatttgctaagtagcatcaccaccgagagctggtaatgcaattgataacaaaatgaaatgggttctttagaaaagaggaaagaagaaatgcatgttgggtaagtagccatcagtgtttatttcaatccgaggccttatgtgaaaaatagtacaaaccattttatatccattaggatggctattattaacaaaacaaaacaaaaaatacagcaaacccagaaagtatcaagtgtgggctagcatggggagaaattggaacactcatgcattgctgatgagaatatgaaagggatagttactatggaaagcagtttggcagtttctcaaacagttaaacatagaattaccatgtgatccagcaattccccttctagatatatacttataagaattgaaaacagggactcaaacaaatacctatataccaatgttcatagtaggtaaaatagctactcacaatagctaaattttgggaacagccccagttgccatcaacagatgatggatggacaaacaaaatgtggtgtatgcatacaatgggatgccatttaaccctaaaaaggaatgaaattttcttacatgctacaacatggatgaaccttgaatacatttgccaagtgaaaaaaatccagacacagaaggacaaatgtatgatttcactttatagagtgactggaataggcaaattaatagagggacagaaaatagaatggaggttaccagagactgtggggttgggcaaattgagagttgtttaatgggtacagagtttctcctggagatcatgaaaaagttcaggaaatattggggatgatgatacaacactgtgaatgtacttactgctattaaagtgtaaacataaatggttaagatggtatatcttacgtctattttaccacacacaaaaagcaatgtagagccaacgggatatcatgtgttggtaacatcacgagcttggaaataagatacaagaatcaataaattagtgtctcttcactcttttttttccttactcctgcataccaagggaaagtggaactgaatgtggactgtgggttgaatgctgttcagcaatacttagtgctctaacttccaaagaccagtgcccaaacattggtgcttattccccataggaaacatggtctctttagctgtgtaaagttgtgataaaccaactgactgcagccattcttttaaaacaaaatgtaatcgcaattataagctttagcaataaacagagggcaaaatgatctacgtcgttctatgtgtttctagtcttcatatttattctcagattttctcgtcaacaaaccaataagctaaaggttggagtataatgccaaatttctatttcttgctttactttttttgaaagaaataaagaatagatactaaaatagagatgaaaatagccttattattggttgtcaagcactttctccatgaagcagggctctgataaactacataaaagagtgaggctcatacctaaaacctagttatgcttttatctcctttggagcagatctgtggatgaggccagtttttcaggacaaatttaatcagtctcacatattcagtctcagagaacctggaagagagagaaaatggtgttttttattttctcagagaaagaaaaaatggggaggtcctccccaggtgtgcctaaaagtaaaagaaagtgagggctccattacacctgaacacaggcaggtcaaactgcattacatacttggccccagccacaaatgtgcagtgccctttaacatatgaatctagatcatctgctaacaaaacatgattcaatgactgtattagtccattctcacgctgctgtgaagaaatacacaagactgggtaatttataaagaaaagaggtttaattgactcagttccacatgtctggggaggcctcagggaaattacaatcatggtggaaggcacctcttcacagggcggcaggagagagaatgagtgcaagcaggggaaatgccagatgcctataaaaacatcagctctcatgagactcgctatcatgagaacagcatgggggaaaccacccccatgatccaattacctccacctagtcccaaccttgacacgtggggattattataattcaaaatgagatttgggtggggacacagacccaaaccgtatcaatgactatcaggttttctgcaatcagattagctgctcctccttccttagggaggaaggaacatactttttaaatattcatggagtgaggatggaaacaaatgtagatttgtatctaacagttaaatgcatactttgtgggaagtggtcatacagactagcatgtacagatgctagtcagtctggtgaaggggctctccaccccaatctgtattcttgttcggcactgtcctaagggtgaaggtcagatgccatatacctcaaatttcttgccttgatattgattgagctcaatcatcacgtatttttttctgaaataaagttgggcaacaagcagaaggcaaaataaactgaagttctgtgatgctaactagaaagtaactaaatgaattttaaacctttctgttggatataggacattcttgcgtctgttttcaaataattgttatataaaatttttagctcttactgctctttcactgaaactcattaatataggatgatgacttgctccacgaacttctttcagttcatacttctttttccttattgtgttgaaaactcaaaggaatgtataatattatagaatatatatattttttaagaccaggtctcaccctgtcacctaggttggagtacagtggtgggatcatatttcattgtagccttgaattgctggactcacatcatcctcctgtctcagcctcccaagtagctaggactgcaggttcttgccactgtgcctggctaattaaaaacaaaaattcttttttagagatggggtcttgctaccttgcccaggctggtctagaacttatggcctcaagcaatccttcatccttgccctcctataatggtaggattaaagtcttgagccactactcctagcctaatatagaatcttaaagctctaaaagataaaaactctctggtcttgttgatccactcattttaaaggattaggccattgaggcaattgatgcctgcagcttgtaagtgacatgttcagtgtcctgtggctatatagtggtagagcaaagctcagggcttaggttatttgtccttttaaattagaatttatttaaatattcaaataaaaggcagctatgaagccttaaaagtacagatctataatgtgaaaagatcacccccaacccttggctttcatgcccattttatccctgtaagatgtctggcagggattattccagggggaggaggcctatttggccagggcctcagttcacagaaggcccagtatcttaaatttagacttttgagcttctctctataggaggttccttagtcccagggattaactgatggatttagagaagatttagagaagaatttaggttcatttatcttaaaattttaaactcaagtttcttctgaattttataattttgtttgggtactacaagtatatgtcctgttgtttttaaattaaaagtgttaatgtgtttaaatgtagacatataacatttatttacatttttaaacctctgtttggcatttttttcagtttttttatgtttttcaggtgtctcaaaaatggacagtgctgggatatctcttgagccctgagctgtcctgttcatggctggtgactgcaaagcctgcttggccaggcagaagctgttcactgtgggtcagcgagtgccactgtttgatagctgtcattgttggaaatttcagctgttcagatcctagccttctgaatccttataggcttttggaattatttgggactcaagaataactcaacgaaatctagaaaccattatgttgatagagaaacagaggaaacaaatggcagagaagagcacagattgtgaaggttagagaaggtgtatggatggggcatagattagctgtcgatgttttcaaaggatctgtaaaacctgagaagcattcaaggaaggagatgaggtagaagctaccagaaaaagcaaagcagagggaaaaaaaggaagagtgggcaaggaagagcaccagtcatggagaaagagaatgagtgagagggacagctcttgggggactttccaggagatgaaaccgagaatcttggatcattagtcatttatatcccaggattctctaaaggaaactcatgtgtctacaatgagtatgtgaatgcggggaaggggcaggggatgaaggaggagattcccctgaactcaacctctaagggcaatcaaaagccatggcaaccgtagcagctcagcacactacacaaggggaatttggctgttttgataccattataatatatcagtcaggctaaattgattgaaagaaaagatcctctcaagttacctcgggaaaaagatgtattttaaagaaatacagaccggaagtggatctatagcgccctagaggctcaaggcatttatagggattgatgggtttctcttgctccagttccttctcctcccctacaccccttttttttttgccctttcctgcccctctgtcctactgttctgctgcctcctccttcttacaaactctccttccctttcttctctctttcctcagttctctctttctttctgtctctctctgtctctctcacacagacacacacacacacacacaagaacacacacacacatacacacagcaacagcagcagcagcagcagcagcagctctgcttgtggttctctttgcccatagatttcattgtttttttactgccagctgactacatcctccttctttccatgtctttttgggtccctccaaattttgtattacacatggcattatttcaccattaggttactactgactggcatagtttcttgttttttcccttgatatattttgaaaacaaagaatccagctagcttagcttactctttcagatctacctataaagtacatcctatgctatgaatcagctgtccatccatctagtgctgattcttggtctacttacctagggacaggttagggtcacaggaacatgaaatgtggatgcttagacaaagaagactgtaactagggtggggagttagccagaagagatcctttgacagctctaatgcaaacgtaagtttaaaagtattatgagatagtagatgcaaatgcagtgaacagagctgtgttgtagaatatggtgtggtacaacacagattccagacttcatttataaaagacaaggccagacgcataagaaagttatgttagctataagagaacaaacagacattggactcgagaggttgatgaatcgctataacattcgttcgtctcccttatatgatatcaaatcttagaaaggcagctgttcacaatttttttgtgtgtctggtaaatcatctcaagctgctgcagattcagtatcatgcatatgacaaaattaggcaagtcaactgtgtgttacatgagtggttcatttcgcctgatgttctattacatttgcagctgcatctgcatctcagacacgtaacattaactgatgttcataatgataaccctgagtcattaaggaaatgttgtattatgtctggtacagtacacttgagaagtaaagagatgaaatggagaaagaactgagacttactgaatgcttgctgtattgcagatactgagagagatgagctacttatgttactgcccttaacaacagaatcctgtgacataggtacagttaccttcattttacaactgagaaaaaaacatgttcagataaggatattttccatatttgaattaggaatccaaatccatcttattctagaatttttgctctccctttatatcaccaacctgtttaattttttttaaaagacatattcaagtcagtatttaaatgagatagccttaggtagtcagtgttagctagtcaaagactcaaactcaaaatattcacaaaagaaagaagagaactaatatttgagcacatgaccattcatgatgatttattccctgtgaactatgtgttattatccccaagttataagttaaggaaattcattaaggcaaagtgacttgtccaaggttgctcattgagagagatgtggctttaatgtgtttttgtttgtttgttttgcaggcttcttttgtcaatccactatgtaaatgttagttttcttaagtcagtcctgagctccctcattttcttctccttcagtttccttttgtaggatagtttcagatgtaagaattctgaaatttataactttagatcccaccttgctctcaagttccctacataacttagatacttttttcatataccgtgaaacactgaaactcaaaagatataattttttcatttcaacagtctccaagtatacctgcaaccccacatttcttgtctaagtgaatgaccccaattactcaagcaagaaatctatgtatcaccctacttgactcagtaggtgctgactggccacctcttgttgtccttgatatgaatctctttcttcctcttcctctaccacttctctaatttaagccagtcctaaacaattgtagtagctatatcagtctgcatttctcaatgccattagagtgaacttcctattgaataattttaatcatatcactttcttgctcttaattcttcagtgatccccatagccaaaagcaaagcatccatactgctttgcacagtagtactcataacccctcatgacctggtctctgtttgctacttattcccaccttcatggtgatatagcaattttgacatacttatggctccctggacacaccgaacactgtcaaagttttctaactttgcctgtttccttcacctgctggtttaccacactattcgtcaagcatcctctcaaatgctttttgattattaagtctttccatctgtttttcagggctgctatgactctttattcacacttcaaatacagcaggtgtcttagtgtactgtaatcacatgtggatttttgctccttggactgataacactgggctgagatgcagtgtgcactgggatggacatactgccctttgtggctggcatgctttctgattaattatatatctgttatgagtggttggtgtttatggcaagcagttgttcaatatcttgaatgtcatctcctgcttactaccaagcaatgtctggcatagagagggtgctcataaatacctgttgattcttgaattaggaatgaatgaatgccgagttatggctggcttcaacttaccctcttcccttcactgcctctggctgtactacactgagctggtcgggtttctgtgacatatctacctgggctggttctgtactgtagcaaaacaaagaataaatgtattttgtgaagagctttcacatatgtgcagaaagtttgcatgtcccattgaggcttcattcctaacaaacaaaatatcctcacttttatcaatgattttcagagacttcttactgctcgtagatgtcctctaatcatacaaatttatacttacagcacaagaatgagaactaagaataataatccagatatgatctcatcattgcaggatgaattatgatgattggatcctgtgagttggaaggccactggcggacactgatacaggcttaatgacatggacttccttcacagccatatcatcttgagcttgtgctcacttgaagtccaggattttactttactttttccacatgagctgccatcacatcagatatgtcctggcccattaaaaaaataaatttgtacttctgattatctcattctgtatacccctttgaccctcattctggtttaggattttctgcagtttgacaattgtgcttttgacatctttcttacaaattatggatgaaaatacataagcagcagagcaaatttcagaatcccatgttacaccacttttcctccagcttcagactgattcattaatcaacattgtttgggtgcaaaatgtccagatatcgattcctggctccaggggtgtttttttttttttttttatttccttctatctaattccgtgctttgtccacaagatataattagaaacctgaatggctcacttaaattaatgagtaccaggcctgtatagtttatttaatctattaatttccagcccttattaggaagtcatcatcatcatcactgtcatcattcatctgttgaaatcaatttaccaaagtaaattcctgtctttggtattagctggaccccagtcctatgtcttggcaacttttaacttagactcacctccagtaccatggcctggaagggcgagattctccccaggcttcctcctgagtcatagggcttcccctgttagcctctctgcctctgtcttctctcaactgccttcataacctcagccacaaactgaagacttttttctggtgaaaaccattcagactaagccttctgtgagtttttcaggtcctgtaaagatggatgtgcacagaggtgggtcaaatcacttattgtgtagacttctgtctctttgttggctctttaagggactttaggccatatgaataaatctgtatctgtatgataggtattgatctcattttgcatatagtgttgctaaactgaagcttaggcagataaattggctttggccaagatccatgactactgagttgtgagggtgaaattttaatacaggtttaaggctcagaggctcacacttgagccattaaattaactcatcctgttgtcttgtgagcacagatttccttccttccttccctcttttcttcctctgtattcccttcattttctttccttttcttttgtgctcaccttatctcctgtctcccttctctctttctccctgacctcatcctccctctatttttttctttttagaattcatgatcacagtaaagttctttcagtccctgggatgctatttattttaacttaggattgataatttacctcacaagccaacttggatttgtcgagaaaactagtccttttattttatgtatagcagatgtaatcttcacgcacctcatgcactggtaaatggaaggaaaaacactacctacaggtcaaatcgatctcaagtttagtctgtctcatgatgtaagcagccccttctgaaatgacaggctctcagatagctttctcttttcttgcttctctccctcaaggatgtcctggtctaggagaggtggggattgtgacttgtgtgtctttacaacactgggagttggggtcttaggcccttgttcagcatatacctgttgaacacacacacacagggtgcagccctagcctctgtagggtcacctgatcccttcagtatgagtcctgggcagggaacactgtcagcttggaatttgcacttcactagaactgagccgagcacgggagtgtcagccaagcatctctctctgaccatgatgctcgacctgcttagcgaggctgggcttacctgttggcctggaaccctcaacccaatggtccctctcacagtgctaggtgtcatgtataggaaagaggcccctggcctaggttcacccgttgtacaccaaagccctcaaattagaaatcggaacatatgttgtctcaccttttttcatataccttccaataaatcttacacgatgaaaaacaggatggatgcggtggctcatgtctgtaatcccagcactttgggaggctgaggcgggcggatcatgaggtcaggagatcgagaccatcctgtccaacatggtgaaaccccgtctctactaaaaatacaaaaaatattagctaggcacggtggcacgtgcctgtagtcccagctacttgggaggctgaggtcggacaatcgcttgaacccgggaggcggaggttgcagtgagccaagatcgcgccactctactccagcctggtgacagagcgagactctgtctcaaaaaataataataataaaagaaaaaagaaaaacgggcaaggttttctgtctccagattagtttttttttttttttttttttttttttttttttttttggtgacttcagacaaacattagtggtagaaggggatattttcctacaatctggttaaccccccgagctggcgtcttcaagcttagtttttgacatacaaaaggaggcaatgaagaaatttggagaatagtttctctagagattgactttaaaagcttttggcttgttgtctaatcatatttttatgtcagaagctgaccatttcttcagcttttctctttgcaggacacctaaaacaaatcttaatcagttccttgggacatggctacctcagacttgttaggatcagcaaaagaagattaaaaatatttaaaatagcccccttaagtaaaagatgggatatatttacagtgtttacttttgcatttgatttaatttgagattttctttgagaagatggaaggaataaagagcagttgagatgttacacttttgatttaccctgcgtatcattccattgtcctctgacccatgtctttagcctattgcatcctcggttgtcttcttctaaaagttgtcttttgtgttgatattattgtccttagtattttaaaataagtcttagttcactttgaactataatctccatagaagaaccaccagcttctaattttatttgtttgttctttgttttgtgctcctgtccctttcttggccatattttcatactaagttttttagaaagcagccagtgaagtagcactgtttctgtttgttgttattcttgttttagtgatatcatttttttctctttaggattatttttaattaaatatttatatttgaggtcttagaaacacttcactatatttgtcttagagcctcaatggcaggatccagtttaatatttcttgatgtttttgaaatatttcataaattccagaataagtgacttagtataccaagcgtttcctttgctttttgtttgtttccctttaatttcaacatggaatgatattattattctaagattcctgtcactgccacaaaaatgaaacaatgtttccttatgggtcagaagtaaatttatggtagacatttcccttccggctccctctgcatatcagtcatttttctgcaaagaaagtgaaaatttattgcatgagaaactttgaaacatcactcagttctcttgtttgtggtcatattttatggctttgagtggggacttctgttcattcccatattatgaacaacagactgttattgtaactcatctgacacaagagtttccacaataaaattaattggaaatttcagagaattgagaaagtatagcttaaattgatctttagttaggtacaatttcttctttaccctgagacatgaagactttaaaatgaagacttaaaaaaaaatgaggctgatacttatttttgtaatatggtgctagttatgtaaaataaagttttgttttaatgggttgttagacaaattttaacgaaataaaaataatgcagaataatctgtctctgtagaagcatagcctcagatttatggtccagaaatctaggagggtggcatgtaatttaaatattgaagggcataacttatcaaatgatatgtcaagtacaaaaatggccttgtaaaaagatgactttattaggggaggaagtaaggcatatagtgaacatactacatagactcacattttggaatcggtatgactacagaaaaccaccttacttggactggatggatttgatagtggaaatgagtggcctgtgaggatggaagtttttgtatttatacaggtttatgcatcagaagttggcactgtctaaaaaatccaaaataaaaaaggctaaaaaaagtttcattttattttgctttaaaacaaaaattcctacatctagtgtgatgttggtggtacagctacttcagtatctacatgttgacattaaaagttgcatgactattttcatattaaatgttatccagaaagtatgacccacctaatattgttattgaaacaccatttccagtcgtgcaattaatcctaattaaacattagcacaaaatttggaagatcagaaagttgttagtaccatcttgaatctcatgattgcagaattaatttaacaaccctgtttgggcataatacattccaaaaaaatatttaaagaagcatcgatttattcagaaggtttatatttgcttcatatgcattcttcagtggtattcaggaaacagctgtcagataaattataaaaatacgtgataaacaaaaccaactcatctttttaattgattttaatctagcttcatctaggcagcataatgctcttcactgatagtagagtgaataatatgaatgcaattacttagcaattcaccatgacttaaaaatatacagagccttaatctattactaatatagtgtaatgtccaaagcagcaaattattggtgggaactattgaagatcagctggtagttagtcatactgctttgttcaaatttaatttcaagaaacaaagaaggagacatgattactggtagtaacagcaatgaattatgggaaactaccactgaatcatttattgattgatagtgagtgaaagtcgttatcctctgatggctgtttgaacagctaatatgaaacgatgcagctgatgtctgtcacgaaacctttgccatattagctgtttcctaattgtcgcttttattttttgcagcagaaattggagcatgggggaagagccgtgaatctaaatttgttttttgttgttgttgtttttttgctgatggagaaagtgcttcttggttttaaattcctaccaaaataagagggaaggaattttatttagttacctgaagtaatgctagatattaaatgatgaagactatcaagattcctccattttatggtatgctttataatattcaacatcaaaggttagcacagccttttgtatattcaagtagataggaatggccctgggtgttactatctaccggatagagcaagagaaagttgactctggcaactgtcattaccatttatttctctcttttccaaacttagcccccttttttctccatagcaattggctagagtcctcttgaagtctgtattgccaaccataagttgtcaggtgtacagtaagttttcaagataggatttgtaaggtagacctaattatcttcttattttggatattgggaatatgcaaaggctatgaccaaaatttagtaatattatttgcctaattattatttaacttggttaataagccctgatttagttacactatcgataggatgaaaacccttgccttgaaaattggcagctgttgtttttaccattgaactgtacaaagctcttccagtctattatacgcattttttttttttctaaagaaaacaagaaatgattggccgggcgtggtggctcacgcctgtaatcacagcactttgggaggccaaggtgggcagatcacctgaggtcgggagtttgagaccagcctgaccaacaagaagaaaccccgtctctactaaaaatacaaaaaaattcagccagacgtggtggtgcatgcctgtaatctcagctacttgggagactgaggcaggcgaattgcttgaacctgggaggcggaggttgtggtgagccaagatcgcaccactgcactccagcctgggcaacaagagtgaaactctgcttaaaaaaaaaagaaaaaagaaagaaaaaaaagaaatgaccaattaagtgtatctgatttaggaaccgaatgttgataacttgttttcagattcagtccataatggaagtctataaaaatgtcaaccagttatcagggcataatgccaggtcatctatgtgttcttatcatcttcaaacagatcagatgtctatcatcttcctgctttgtgcacagatctgggccactatgataatcataatacattagatttacctaatggttgtttcccgggttaccctctcagacttttgcaatgttcagccttgctttaatggtttcttacaatgcacaagtacacttaaattgcagcactggatgtttttctccaaaagtgttatacatggaaggggaagggggtgagaaagatcctgtaattgaatagttaataggcttttcactcaatgaacatgtccatgaacctgatacatacttgttttgacgtctaaaaatgatattcgagatggcttaacttggttgttgattagcaagtctccatctaacattttcagtcaaatatttctctccctcgcttggatgtaagcctagctagctgagctgggggtgagaaggacagaacgagttggtgtgggcagcctggtctgagttctttttggattgcgtgttgtaaatcttcatcctctgggctcaaatgaccaatattatatttttcagaaatcaataatcatgaaattcatcactgttcatttataggtgaataattacacactgaagaggctaattgctattctataatattttgaaaaactagaaaatggaaaattgctaagaaaatttatccattccctttgcaaaaaaagttgggttttgtcaagaatgtgaaaagtctgaaatttttctctactttcaggctaacaatttatttagccttccacagtttcatggcagatgctggcagaagacatgatactcctagatcagagacaaagacttcattacagcacagcaagcaaaacgaactcccttgtccctccaagtgctttggggttgacatagaggggcctcggtgggtactgtgcaattagtgggtttgcatcacagctgaggaatcctaagtttaggaatcctgaatgttttgtaagggatgacaaatgaatctgcctgaactttgctcggaagagaaccactatctttattatattgggccataaacaaagctgcccctaccatctgtttccatgggagacactaactctatattcccagcctgtttactatcaaaacattattgaaaagagttcagaacaaaagcatagttagtatctttgctctcaatatgtacagaaatgtgagagacctatagaggtctagttctaatgtacctaatgtacactgtggactgtgatagcttatgggtaaaatgatgaaaggaccgaaaagcctattgatgagcttgcataatgtatatatttctgactcagataaaaaaaaagagaatatctgggaaacactaccaatggggatggaagtgaaccagttttaccaataaaatcttctaaatagtgtaactaagacaggaatctcattagtcctagattgaattaatgcatgctgtgacacatcaagctgaaaagtactattaatctttgactctatataaaatatgtattttgacataatagtgttagtttagtgtgtatgtcatatatataggtaccagattaagatggattttggaattgttttgtgccttttcaagcagtataatttttaaaaacaaattcttgatacaggtagttgtgattttcttttaacattccatgttaagatgaaaaatactggaattaaaaacccattatgagaaagagtaaatttgaatatttctccattatatagtaataaatgtttgtaaaatcttccttgatctcatgtttccaggttactgttttggaatttgtttggcctttgcataatccttgattgactttggtaaattatatcctagtggaattatccactttcattagcaccactttcttcttcttcttcttctacttttttttttttccttttcagtcagggtcttactcttttcacaggctggagtacagtggtgcgatcatggctcactggctcactgcggtctcgacttcctgggctcagataattctcccacctctgcctcctgagtagctgggactacaggcatgcgccatcacatccagctaatttttttctagtttttgtagagacagggtttctccatgttgcccaggctggtcttgaattccttggctcaagcaatctgcttgcctcagcctcccaaggtgctgggattacaggcatgagccaccatgcccagcctgttagtaccactttctaagcacaagataaaaagcttatctttgcctaaaatatcttcattaccatatttctttaataagacctttatcatctcctgtagtatctgtctgtgttatatgaagttttacagtaaaatttcatatatgccatttggtgggttactatggaaaattttatctgatgttaaagttgtccatcaaactacttgacaataacatctcatttataaacatcattcagatttattggatgatgtattattactcaggttaaataagcattctagtaaactgaaaattgttaatacatacataccacaacatttactataacgttcataacaaattttcaaatgactcaaagacaagtacttttttaagctaaagttgcaatcaaactagtttgatctttgattaatgctagtggagctagaggccttctgttgtatctgatctcctgtgaacagtggcaatttctaaatagttctgaagatgtaatatttgaccaaatctgcccttatctggggttttatttactgcttggcttttctactatcagtatggttactgtcatgtttcacttttaaaagcctgaatacaaaattcataggaaaaaaacgctaattatttctattttgttttttttagagtgtcaaatgcagtgaaccaagttttcctatatattttttcagataaattgaaaatagtaaaatgtaataaaaatataaaatgtctcatttttaaaatgtgaagttcttttagatctaacatttgatagctataatagacttatcataatatcataaaactagaatcccttagtaataatctagcccatcatctttattttacaggtgaggaaattggggctcaaataagttaacagacagactcatgatttcccagattattatgtaaatatatgggactggaaccccagttttccatgtgttaattcattgctcttccataaccaaattaccctgaaactaatatgacattaattttaagttgtaccattacttatatatcactaagaaataagaaagacttctaataaattatgatagtttcattaatgatagcctctcaccccccactgctgccccagcccaatgcatgaatccatcccctcattccctcattgctttgagacattttaaaatctattctgagagtttgggcaagactttccccccttcatcttcactgagttgcatgtcgggaaatccttttgcacaaatagcagtaacaaaatacaacacagctacatatgtttgtgggtatctttctcgtgtttcataggacactttgttgatttgcatgaaaatcagtaattgtcattcctccaatgaagactgttttactcagaccaaatttatgccctgtattttgttgccatgtattcatataaacaatatatttatgtttcagtgatgagaaggtgttttaagtggcaattaacatgtgttgtagcaacaatgcccatagcttagtcaggagaaagagttcgattatctatgtccaagaacaggtaattgcaacttcataatgagtttcccttgcatttatctttgcagtctttgtaagaaaatatcttgcaagagatctcttgatttcagagatgttgacatttaaaataataataataataaaaatctgagtctcagaattggtgaaatatacctccttaagatttgctagaagtctgcttcagaatgtttcttgttgaataatatttttacagaatactatgattatttacttaaaaaaggctcttcagctcttgctagcacatccaaacagagaaataaatctgggactcttgattgcatgcatatcctattctatttttaagctttttcaaatcgaatagattgcttagtaaatgctctttaatacacatgttcaaagttctaactttgtgtttggtgggatgctcttatattacaaaacttagttacaagtagtgaatgtcaaacatgaccatgaacttctaaaattcagagtggtttattcttcattaattttcaaaattgaaatacattttaaaaggacatggtttcaaaatcattaaactcctcaaaggagttcccacttacgtactgtttatctgactcatgtagttgaatattcagtaatacagagtttgattagcgtttttaaattttttactttttggaaaaaataatcttggtttggaatatactgagtctatacagaggacaggaatttaatttcaaataagttttcagattgcttctagctccccatgtcataattactattttgacagttatgtctcatagacatttattttaattgcatatgttagcaattcattttggcatgacactctctaccattgttgtgttgccgaattatgcttacagaaactatgtcagaaattcagcatgtggagaacagtaattaacctgactcatcaattagcttttgtgaatacagatgtcctatgaatatattccagtcattttttttcttttttaattaagtaaaatctcactaccctgattctctccgcaccttctacttctaacctgtctctgagtcttcttcacttaccacctgtatgttttgaatctgtgccctatctaccatcaatagcctgcatatattaacattgtctctcttctgtgttttgcctatttagcctctgtctcccacacacactcttgtcccctctaattcattctcacccttgcaagtagaggaatatttataaaattcaagtcacgtcttgctgcacccacctgctgggtgtgtggaatgattctgggactacttcacaggaaaaaacgaatatccttgagagaggctacaaggctctacaccatcagtcctgccaccctctctgagtctcgccatgtgtgagtctctgtgtctgcttgccacatggacctacattccgtcccttgaaggtagacaccatgcttcttcctctatagggactttgcacatgcaattgtttcttctacctagagcattcttcccacccaacccagcttctcttggccagctccttcatttttcacatcaatagtcacttcaaacattgccttgtctggccacccagacctaatctagggcctctttatgtgttccactggaaatatgaacaggacttttatgattcttatcacagagtacaaagaaatatgcatttattttaatagggtgtgtgtgctggaccacggtgggtttcacagggtaggaattctgtttattcactgcagtatccacaaccatttgcacagcaattagcacgtaagtgtgcaatagttacttgcttaaaaaatgagtaactctactacaatgaaatgggtgattattaaatctaggctgaagtgaaatttatattttcaaagaaaagtctgccataaaaaaaaaaatgtaaccgtaacagtggtccattttaaatggcttttaaagagatttagaatacatggtttggaaatgcacttaataaaaaatatgtcttatcattagagagtcacatatcttatatatttggttaggcacttccacttcccagctgtgcaaataattatctttctgcatctgcttcctgctctacctgctctaaatatgtctccggcttgttgtaaagagaaagcaagtggggtggggtgtgaactataaaacactgtatgtacagtttaactatttaagtatgccatgcagattctttgttagccattgacttgatttttacaacacccttgaaaataatttctgaaatgtctctaacatgttctacattttagattttccactaattaatactgacttttcttttaagtagtctaaattatcatgtatttttagatatcttatgcatttgtttcataaactaacatttgttttgaggacattacctgcaatgcatgtttttttttttttttttttttttgagatggggtctcgctctttcaccaggctggagtatagtggctcaatctcagctcattgcaacctccgcctctcaggttcaagcaattctcctgcctcagcctcctgagtagctgggactatacaggcacgcacaaccatgcccagctaatttttgtttttttagtagagatgaggtttcatcatgttggccaggatggtctcgatctcttgacctcgtgatctgcccgccttagcctcccaaagtgctgggattacagttgtgagccaccacacccggccaatgcatgcttttaaatttagaagtttcacctcatcctgaagaagagctcatatgaatatgattacaagaaaataacatttagattgagcctttattttttctgatgtcatgcaaaatccgtaactatactttttagctctttctcttagccaaagggtagtcaattatgttagtagatgagaggatattattcaactaagtgcaatgaccattttaataatatttatattcacctgaaatgttgatcagacttttacctaggttgctatattctcattttatatacataggtctggcatatagacattttcatatctacctctaactacaaggaatatgtatatacttttttaaaaactgaaattcttttgaaacccttcttctaattctgtctcagtcagttgtgttgctataaaggaatacctgaggttggataatttttaaagaaaaaagatttatttggctcatgcttctgcaggctgtacaagaaacatggtgtcagcatctacttctggtgagggcctcaggaagcttccactcatagtggaaggtgaaagggagtggacatcacatggtgagagaggaagcaagagagagaggaggaggtgccagactcttcaacaaccagctctcaggggagctctcaaggacactaagagtgagaactcactcactcccttgaaaatggcaccaagccattcatgagggatccatccctatgatccaaatacctcccatcaggccccaccttcaacactggggatcagatttcaaaaagagacttggtaggaccaaacaaaccatatccaaagggtagcactatccatgccatgccattattttatatacaaatctggagaagaagcatttgaaatgcaattgtcaaacctatatttgataaattaatctttatttacagcaataagtattgtcttacatctgtattaatataaaatagtcgtatatatacatacatacatatatatatatatatatgtatatatatatacacacacacacacacacacacacacacacacacacacacacacacatatcaattccccccaacccccaagggcatattttcaaactgggcatcaaccaaccaattttacaggtatttttcactgaattcagtctatgttttggactaaagtttatggtccaaattatgtaatgataaattagataagtctaaccattatctttacctctcagatggtctggaataatggcagctcaataaatcctttccctgaaatacagagaggtagatacttgtcttgcttagtacaccaatttccatgttttaccttcaattataataattaaagtgattaaagggtttttattattgacatgaatcatgtgagtcatcttttcccaatgtcaacaatattcttgaacgaaatatatgactaatgactggatttcagctgtaacatgtaatattatcatgtattaaaaatctaatatgataatttatgtattttataataaataatgtatatatttacatattttgtaatttgtatgtatgtaattaatttatggcacactttagtcaatgatagcatttaaatctgagtccatttcaatttgagttgcactaccagcagatttccagcctacattttatatttgaaatgtatttgctttacttcaaattaggtgtatttcttgttttgttaagatactgagttcaaatttatctcttttaaatgacactgtattgacctttgcacattgtctgttgtaaatgtgtaattttatgtgtcaatacagtatcatttgcaaatcagaaaaagaatctggcacctcctcctctctctcttgcttcctctcttgccaggtgatgcctactccccttcaccttctgctgttagtggaagcttagcttcctgaggccctcaccagaagtagatgctggcaccatgtttcttgtacagcctgcaggggcaccagccaaataaatcccttttttaaataaattattcagcctcaggtattcctttatagcaatataactgattgagacagaatcattgcaatatcatttgcaacatcattgcaaattctattaaagaatccattaaatattgtgatttagtgaaagctacttagtaaaaaggttatgttctatttatttgtagtatccctaaggcgaaacctgtaggcttcttagacataccattgaaggctactgaaattattgaattcaatattatagtatctgctagtgcaggccaatatgcgtaggtcaatacccaatcatgatggttaatttcatgagaatattgttgcagaatgttgggtttgagggaacctcccatgttcactgaggttaaaatacatccaaactcatccaacataatttcctaacatgccaagagtgattgggaaagggatacatttttgggatagattaaaataaaaaaagtgataaaacatgaaaacaaatagggcctaaaatcagctaattaattcaaaagtgatcagagaataaaagttctgcaaataaaggttagaatggaactcaaaggaagcaagtaatgctcaccttccctagagagctctaataagaatgtcacattaggtcatgaccatcttctccttatcatgctgctgttctctggctctgttttgatattactgctggttgcaaagtgctttatagtatttagaaataatcagacccttcttactacaaaaaacctcagttctctttattacctagatgtattgtgtaggcaactgccctttggtattcattttgaaggtttagaatgaccctttcagaagatgttaattacatattttgttagggctaagtatggtctctaagaggtagcttcttctttctttatacaaatattatttgtatcctgagatttatatcaaacttttacctaattaccagattttaatattcttattgaccatattggagataattcagagaacattttgttttttttacaagtagttactgaaagaaaagagaaaataactttatattgattttttcatatgattatagattaatcctcaggcaatataattaatatcataattcttcccatcttttaaatgaagagtttacaaaacatatagtatttgttaacacttaatatttactatgtgcctggtgccattctatgtgcttttacatatattacctcatttcatctttacaatagctctctgtattagtcagcttggaatgttataataaaataccacagactggctggcttaaacaacagaaatttattttctcaaggttctggaggctggaagtccaagatgagagtgttacatggttagtctggtgagggccctctttctctcttaccagtaactgtcttctcactatgtgctcataagacctcttctttgtgtatgacgagagagagagagacagacagacagacagagagacagagacagagacacacagagagagacagagacagtcagagagagggagagagggagggagaaagagggagaaaagatgagagagagggaaaaagacatgtcgggaggaagccagggagggagggagaaggagagagtgtgcaggaatgagcacaagtgctttctggagtctcttcttataatgatactaatcctatcagatcagggacccaccattatggctttatttaaccttacttccttagaggccccatttcaaatacagccacacaaagggttggagcttcaacgtacaaaccttcagttcataacaccctccaagctaagttctaatcattcccagtttacagaagaggcaattgagacactgagggtttggtgatttgctggatgttacccactagcaagctttagggctaggattcataccccggctgtctcactcaggtctctctctgcccttaactgcattagccagagatcacagagaaaaggcaaaaagagtagagatattttatgatacggataagagatgagaaagggaacttaaaagattcacattttctacttaaaagcaaagttacaaagcctgtggaattgctctgacttagaaagaacttgatcatgcttttggagtctctatgtgttctctctctgttggttagttttaaatcagcctgcctcacaagggagcctgcatttgattcccaagcccacctcacatttactgaatcaaagtctctgggaaggtggcagtctgagactgtgcatttttaaagagttctccaaataatttgtatgtgttctaaggtttaaaattcacagcttctcgaagaggtgtccagctcaggttaggagatataattggaggtgatacaattatgtttgggccaagcactgggccatgtgtaagctcttgctcaacgcaaaaatctgatatgcaccaaatcctttaaaaacagctctccaaggaaaatttaggtaacctattcatactgctggcatgtgctcctcctgtttccaccctcgtttattttggatatttttccagtcctggaaatcatcttccattttggcaccatttcttgattgccatcttgataggacttttgtctgcccactcccccacaacaaccattcctgtctcccactcactttaccacccaactccctttcttgtctattcctggatgcaggacaccacatagtactttctaactttgatattgcctatgacctagagagtggtaagtcatccatgtgacttggtttgagaggcactgacaggctgagtgactcaacgttgtttcaaagtctagttcctatggtgtgttgctcaggcgcaatttacatcgtatggagcacttactccaagatatacacgagagaaaattctacaattggttttgattgggaaatacttcaaattgatctataagttgtagataaacaagttcttcagggcaggatgtgaaaagcacatgcacgaattctcttgtgtgtctccgtgtatgtaagatttggtaaaagtttagagctgtatatttttcacattttcctaaatgtttattaaataaacatttaatagacacttgtcatagtaaaagttctgaaaagagaaaaactaattctatgtatttcaacacatcaacctccaaatttatttgatcacagaacccatattttctgcataggtgttttgattttctgaggacctaatgttttatgcactagtgtattggttcatttcttgaggcttaatttcccaaagctctttttaaaaacacaaaacacttacctggggcagagagtatggatgatctctgaacacttctagaaaattttacaacagagatttgaaaagataaggatgtagagagtgcaggacaaagataagttaatctagggcacatgcactttgagataagagggtatcatgaaagaattttaatggaaattttgggtataactggggtgattagggatgttctgagttaactccaatattttattttattgattgagacagagtctcattctgtcacccaggctggagtgcagtggtgcaatctcggcacactgcaacctccacctccctggttcaaacgattctcctgcctcagcctcccaagtaggtgggattaaaggtgggattaaagccatcatcatacctggctaattttttttgtatttttagtagagatgaggttttaccatgttggccaggctctccttgaacccctgacctcaagggatctgcctgcctcggcctcccaagtggtggaattacaggtgtgagccaccatgccctacctccagtatactttggagggaacatgaatgtaagatgcagaagaacgaagaagatgatgaaagaaaaggtggatatgaaggtgggagatttgaaagcagattttatgcccttcacagatttttagatgccaaacctgtcaagaagtttgagaattgagatgtagatatatatgtgtgtgtgtgtgtgtgtatctctatgtatctatcttatctatgtatctatgtatctatctatgtatctgtgtatctatgtatctatctatctatttatctatctatcctacctacctacctatctgtcatctacctacctacctacctacctctctctgtatcaagagaactttacatttctaaaactaattatctcaggtctctaaagttaagacctgatgtcaatgtcaaaagtcagtcctcttcaaaacattttaaatttgtgatgttcctgaacaacagaaggcttaacatcctgctgtgtgtgaagataggcgcaccaccataaattagaacatgtggagcttttgtttttcctttgactttcaagtccatcatttttattagtgttcttagaacccctttctctgaagacagactttgcaactttctctaaagtttttaaagagacaaccactttgataaattgaaggaaagcaagaacagagagcttggattttatctgtttttttttttatttttccattagcataaatataacatacaaggaaaattcatgtgtgccttaggtcatgactgtaatgcttgcatcttctctaggaagaagccgtttttttgaagttggtataaaagtatgtgtcaagaacactaccttgaattttaccttgaagtcataagccatccacagaatgtgtacgtttaggcaaaaatgctcattaaataaacttacattctgtctaaaagtttgttgtaaaacttatcaattgaaatttctcaatatttgcaactatgtcgtagcaatgtatagccacatatgaagggccaggtgtaacctgcattttcagtttggcacattgcccttctgtgatattctgctcttgggcctttccttttccgcttgtattccttttctacatcccttcctatgtccccatactgtcactctgttcatcaaagcctgccttcaggagaggagctcacagacgaattcataataagtattaataactgataaggctgaacacattacaggaagatttcattatattttattaatgttaatccctaataccaagtgaattaagttctctttgtaaaattttatccgccagcaatgtttaggaaaagtaaactgcagtggtttgtggagccgctggaccagcttacaggagctaattgttaaaattttaggaatttttgtaagctgggagttaaacatagccaccgttgttaaatatgaaattatataaacttgtaattaagtagatcatattgaaaacgattatactcaaaaattatgtccttattatatgactatattttaatactatccatgctcttgagtacattcttgtttattgtatttgtgggatatataattgcatatttcatccctactccactccagagacatattgttagcttgaaattagtcatagtagatgtatttacattatggaaattaccaaatattacaaataggggtatgttttatcgttttgctgattggcaagacttgagatagtactggagaacatgttgttaataatgcagattaaacttaaaagtacaacatagctatatgctttacattgtttaatatcacaaaaattgaggaaatactctcttagtatttgaaaagtattatccagtttagcataaaatgtcactgttaacattctgacacatatttccttcatttcactctgttagtgttatttaaggtaagagaaaatatcaaccgcatggcagaaatgcccttttcatcaattgcaaccaggttggtggctactgtgttggttaattttatgtgtcaaaaaagctagtccatggcacccaggtatttgagcagacattattctagatatttctgttaaggtgtttttatgagattaatatttaaatcactggactgagtaaatcagattacccttcattctgtgagtgggcctcatccaatcagttgaaggccttactagagaaagactggccttccttataatgcctgcatcctctttaggcaaatgtagttttttgaataagtgtaattcactatatatctcattagacataatgagatataaaagtatgtatcaagaatgcttccttgaattttagcttaaaatcacaaaccgtgtttacttctaggtaaaaactctaagtaaatacatttgcattctatctaaaagtttattgtaaaattgagcaattgaaattctgctagctgactgactcttctttctctctctctgtctctctgtctctctctctctctcagagatatttatgtgtatcctgttggttatgtttctctggagaaccctgacttaatacgaacttggcaaaaaccaacaaaagaattatgtgcaaatgaattggctttagggaatttgtaataaacaatattgtatgttttataattatttgtgaattgtgtgctgtacattctttatatcagtaacatatatcataaacatatatatacatatgcacatttttcttctacagggcaggatgtgaaaagcaagtgcatggtttcttttgtttgtgtacgtaagatttgagaaaagtttagagctgtttatttttcacattttcccaaatgtttattaaatatatttaatatagacaaagaaaaactgcatatattattcttaacattaattgaaagacagaaaagaaatttttattttctaaatatagaacagttactattaactgcaatgtatcttttgaagtgaaattccaaaagtaattagctgttgtttaataaatataatattttcacaaacagtgccattgggatagttctactgcaaaggcaaggttcatgtgtgaataactgcaggtgttcagttttcaaagcctctgaaaacccttgaacattgaaacctacatggtgtgttatctccttaaaggagatatagtttgagtggattccatggttatttgaagtgtgtagttttataatgccccagcatttgaaattcaagatttaataatctctcacctaccaaatcatcaaatggcctttcataacaggatgctgtaccattcatttcaatggcagccatgggataatatgttctgaagccatgatattgataaagagcctggctaccatgaggaaaaagaaaaagaaagattctgcttggacttaatatgtttttgctctttcaaaaggcaggataatgttaactttaatttattcagttatgcatttttcaacttgcagcattaaagaatgtagaaaatagagtaaaagaaacagatatgcaaaagagtagaaggccctttgtatgaaaagtgcctccttagtgttcagttattgattttttttcatgacttggctttgcaatgaatatgatggaaagacaaaatcaatatgaaataaaatttatgtaagtactgttccatgcgatgcagattttatacatttctggagtataagtttgttcttgcaaagtggttttaaaagaagtacatgaaatcagtggcagtaacaacgctggcaaaataagcactttatttctagaatgctggtaatggagtcctggtttctaattggtactttatagcactgacagattttaaattgggctgatttttggtgcacactcctttatgcctggattttaaactcatacttagatttagtgctacttgctatttgtatgtggcaatatgaacaaaatattttcattactatttcattttcagaagcacaaaaacctaggatgcggagaggttaaatagctcccacccttccatattttccatgtgagaaatctagtatagaatgataaatgtcaggtctgaaactaaggtttcttaattctcagtttcaccccagccacccagtccacaccatcattgttttgtccactatatcacagccaagattaggagaataatttagcttcttcaagtctccatataatacctacattcacattttggctacatctgttcaattgtgacaacttcagataggaccaaaaattttgacttcattggccctctgcatctatcaagatgattgtaatggacaaaaacaagaaatgaatcatatctgcatcattactcaaagaattatcttcataagtcaaaaagtgtgctagtatcattgcaaaagatgtcagacaagaatacgtgcatacagacacatgcccgcacacacataaggatgttgtttgtaatctaagagcactttggttcttttccactcctgttcaccaggaattgggatatgactgtggggtggagtggcaaaattaaatgaataagccctgatgaattattctgttgtaatagtattttctcacagtggacaatggaaataagagtggaatatcaaggcagagggaaaattcacaaattactgtcctaaatggagaaatgagagaacgcaatagtgaatcttaaagaggaaatcacagcaacacaggaacttttaaaagtcagccagtttgtttgcccatctgaaaggcagtcccttctcagatatccaagtgaaattctgcctttagagacaggctttttccgttgtcgaacaattataatttataaactatatgttaaagcaaaactctgccttactatagcttaaactaaattctgtgattctggaataattttctggctctggaaataatcagcaaatgatttgtgcattaatttattcattccctcagtcatagagtaaatatttaacgagtacctataacgtattaggcattgtgccagatgttcaatgtatctaactctttcttcttccatatgaaattccttcaaatattggaagtcctgtagtcctgaagttgttttagcgttcattactcagagggcgtaattctgtgtttttcactgttctggtctctctcttctacttgcattcaactgtcaaatggaaagaagatgaccattggagatatttaattaaaggaaaagcatttcttatttcattaattatgatatggcttcaggagaacatatagtgtacatcacttatgagaaactcaaaaactggtgttagcactttgtgaccaccattctattattttgtgttttaaaaatttgccgctactcaggaggctgaggcaggagaatggcatgaaccaaggaggcggagcttgcagtgagctgagattgcaccactgcactccagcccgggcaacagagtgagactctgtctccaaaaaaaaaaaaatgcctaatgttgatgaactttagagagtgataaattgttcagcatttttatttcaaggtgtatgactacgatgctgtgcccattaatttagctcaggatttctgaccttacattcttcattagagagacacatgtctaaatgtttccttttctaaaaatcagaacacttgtccagcagccaaatgttcttccatttctcagaagagtcgttattcaaaaaaccagtatttttggttgataggcaacttatttaaatagttaagcaagtttctaaacttctcagctattgagcattattttatttttaaattaatgctatgtagcctctaagaaggaaatatctatggaaatgagaattggagagcttgtattgaaaataaatcctcacctggattaagtttcatctgtatgtgctgtgaactattggggaatgaaatgttttacatatgaaaattctgttgggttgtaataacttcttggtgcctatttattcttatagaaatctgtcctgatgtgaaaatcacatggacagtaaacttttagatgaatattgtaagtttcttataactttttcagtcttctttttgttgcttgcctaattctagcatttccctgtatatagattttggtcagttttggggtggggaaagggcaacccaaattttagaattatgtgcaacagttataaaatatagtgtctggctgagggtcgatgggactcaattttctcaatgtgcatggattgtacttacaaaggaatcttggtgtctccattgtttgctcagttatatttctcagttgtttccttgtatatgtattggatataagaggtaggaggtaattagaaagctaatattttaatgaattggcctcttcttactttattgaaagataaaacataatttactttttaatttttaacatggggaaagttactgtgctgtcattagaactcacgcaggttactgtgaatttcagatgaaatacatgtaattatttttgtagctagtatataacttgagaggagttacagctttgtagttacatttgtgggctctagagtcagactgctgtggagtaagctcaggcaagttgtttaacttccttgcatttcattttcttcttctgttactggggcctgtaatagtaactacttcatagagtttttcaagggattaccaaaaaaaacaaaaaaaagacaaaaaaaacccacaaacacctaaaacatgtaaatagccatggtaatgccagctaccatattactttgaggaaacaacttattgacttcactcacttattttgcttgtgaatgaaattaaagcagataattctgacaaaatattctatgaatggtttgatggtttgtttagtttgtattaaagttgacatctgtaacttttcactataagctttttttttttggcaggagtgggggattgattatattagagtttgtaaagaaagcctttgttgcatttcgcagaggcatgggatttgtaatgtccattcatggtggaaagacatatccttatacatctgaccataatttgaaagaattttggcactattcacaatagcaaagacttggaaccaacccaaatgtccaacaatgatagactggattaagaaagtgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaacatcacattctggggactgttgtggggtggggggaggggggagggatagcattgggagatatacctaatgctagatgacgagttagtgggtgcagcacaccagcatggcacatgtatatgtatgtaactaacctgcacaatgtgcacatgtaccctaaaacttaaagtataataataataaaaataaaaaaaattaaaaaaattaaaaaaaggattttggcaaagcaggtaacatgttgaatttcaatattaggaatctttaaaaatatgaataatattttaatggtttaaatatagaagtacctaatattaactatagttttagaaatttaaaattttattgtcaaagaattttctattcttttcagttgaattgaagaaatgcatttggcaattatttagcctattgggtaggtgatatcacttctgaggacagtctgaaagtaagcacaactcacctagtaaaattccatctgggtggcagtaatgccggtgagtctttggtctctgccctgatttcagttccacagttcgctggtataagcagccattttaatttcaaatctcacatatatatgtatagaatgttagaaacaatttggaattcacgatttgtgtgactttaaatcatttagctattctaaacctcagtttcctcatctgtaacaaagaaagaatctttctattatcacacctcatgaattttatggtagagatcatagctttataatctatacagaattatatgtttataagctattctgtggaatttgtattcttctgcagaatttatggcccatggacttattttttactataatagaagtttagaattacagtagaaagagaacagggatgggactaaaaagacctggatcgttcagttcagctttctgtggctccatttcttcatctatgtaacgagtggactggactcaatgatatctaaaaattcttcctagccctaaattttaactataatataatttcatgatatcattattattttacaggaattatttcctgtgtaaattcacaaaatggaggaaatagttttgctttcccttcagatgtcaagaatgaaactaggagataatgtgtgagatccttataagtatttgtaatattatatatacatataaaatataggcacacacatgcttatgtttggttacatgtttgaataaaatatcatgattatattattttgtgtattttataattgaaaaaatataactaaaaccaaaaacgtgtttatgtaccagaatacaatatttcagctacttttcatccagaatggaattttttttgttgcttgaattacttgtccaagtggccatggtttctattataggtactacaatgaatgtgcttatatgaagtacacattttcttcataagtatagtgtatatttgttaaatgagtgaaaaatatgacctgcagtaaaaagaagtaaaatagcttgtgttttttatacccaatgctaagtttgaatataaaacattgtgtataaataatttctattcaaggaaaggacctcaggattaagctccaaataaaaaggcactggatctggaaacactagcagtatttttgaaatgtccaagggctataaaacaaagtggatttgactagaactgttttcaatttgcacttgcctcctgggtatctgttaaaacctgcttatgaatagactctgactgatttgtgaagggggtttggcttttgtttcatagctgtgtgaatcattcatgtataagccacaccacttccctgttttgttatacattacactacaagttgtcctctgtaatttaaaaaaacagtcatttcatgatgaaacacaaactagtgtatgttgctttggttaggtctgcatgtgaaatagttctgaaatcgttactctgactacattattgagggtgcaggggactttttggtgaacttcattctgctcataacatttctacattgtctttgaaagtctccaactgatcccttagttttcctcactgatttttctttttgctcttcttccaagacctggcatttcacatattatttatttgtcttaatttgttcaggttgctataacaaagtaccataaactagatagcttatataaacaacataaatgaatttaatataattctggtggatgagaagtccaggatcaaggtgctgacagattcggtgtctgttgagggcttactttctggttcatagatggtgccttctcactgtgtcctcacatggtggaagggactagctagctctttgtggtctcttgtctaaaggcactaatccaatccataagggctataacctcatggcctactcatctctcagaagccaacagcctaatatcattacattgttgatgagatttcaacatatgaatttgggaggagggggtcacaaacagtgaataatccttcattctctctgctttttgctctgttcttctcaggtatgctaatgattgtaaccacagctctatgaatcaccagctccaagtctttgtggatatcaggaaaatatttacagctgtcttctggacactactacttgaataatccacatttacctttaagtaccctgtcttaaacctaagtcttcacttctgcagattcctgtggcagtgttccccagattcccgctgcagtgttccccagatgcccactgctccgttccccagattgctgctgcagtgttccccagattcctactgcagtgttccccagatgcccgctgcagtgttccccagatgcccgctgcagtgttttccagattcctgctgcagcgctacttttcttctccccacctgcctcgcaacactcttttcattctctctagagatattgcataagttttgctccccctcatcttgattttaatagtcattggttttttcagactgtgttaatattttccttatctaaatgagtagtctgctaagagctctccttaccactggttcatctctagtcaacctttggacatgcaaccagattagttgtaaccttactgcttaaacagtttgtatggtcacttagtgtttaaagtccttcataacctgacccaaattaatttttgatattcatttttcccctttcttggactcctcatttatcttaatttggaagaagctgctgctaagtctaccaaaatctactttattcttcttcctaggaacaaggcaaggctagggattctttacagttaagatatggcaatataattaacttgctgataatgaaatgagagaaagtgctgtgttacacctctggggttataagctgagacatcaggtatattttcccgcatttgcttcctactgactggaatccaaggcaaccatgtggccatggagaagatgacagtgggagcaatttaaatcccttagtaactaaatgggatggagctgtccccatcagtatttaatctttaccttggtatgattttatggaagcaaagtagaatctttttctttaagccactaagttttttgtagtctcatgcttctaattaatatttcttaatttttcatataaacattctgttttgttcctaggaattccatatcttggcagaatggtgataaccaaaaagcctcatgttagtcaatgaaaccttctccaagaatagcaaatatctttctgtagatatactgcttatcttatattctggcattagagataacctctactgccatcgtaggggaattaaaactataagctggtccctggattgctggaatatgtccgatgcctccaattctagcttccatatgttaggatataacttaagttgttttaacagaccaaaagagaaagtggcttaaacaagaaaggtgcttatttctctagtgaccgtcccaaacagtcctatacagggggatagagcaattgtattctacaagatgcttcttcagtcttgtagttctgctattcttggatatattgccattgttcacatggcaaacatgtgtcttcaatgctacattcccttttcagttagtaagaggggaggagaaggaggagggtccaactattcatattaaggttctatgacctgtaacttgcagatgtaacttctgtccagattccattgttcagaacttgatgtcctggtcagatctacctacagtggtggctgggaagtgtactcattgattattaataaagaaccatgagcccagttcaagcttggttggtttcataactaaaaggaaaaagagataatgagtttcgggggaaactagtggtacatatataccatggcatactatgcagccacaaaaaagcacagaataatgtcctgtagtggaaacataaatgcagctgaaagccattatcctaagccattactaatgcagaaacaaaaaaccaaatactgcatgttctcacttaccagtgggagctaaacattgagtactcatggacataaagatgagaacagcagacacggggaactactagaggaaacaatgtgaggtgagtgcaaggactgaaaaactatctattgggtactatgctcactgcctgggtgatggaatcaattgtaccctaaacctcagcatcatacaatatacccatttggtaagcctgcacatataccccctgaatctaaaataaaagttgaaaattttaaaaaatgaaataaagtgtgacgatcctttatgttgtatagataatgatgtagacactggattgcgtcttttacatttatttggttatttatttctcacctctatttggacaaaaagtcctccagagaaaattctatttcttagcctattttcagcctcagaagttaacatggtttctggaatatagtaggtatgcaatacatgcctctttaaagatctaagaatattctcttaaatatttctagtagaagagtgaattgtttaaccactttgtaaaaacaatctggcagtgtttacatagtctactgtatgaatcagtaatttcatttctagtcatatatcagacataaatgcatcagcatgtgtgcccagagtcatggatgaaaacgtccatggcaacattgtttatagcagctgaagaatgaggaatgaagcacaaatttctatcaatattataatggatagattgtggtgtattaatgcaatagaattctgtacagttatagaaatgaacaaactatagcttaatgaaataacttggataaatatgtcctccaccaaaaagagcagaaacattaaaaaactccacactacatgttcctacctgggttatgttccatcctatgttagaaattaggattgtggtttccttgggagatgaaggaaagggtagtaaccaggaaggataatgaagatgaggttctgatgtactgactgtgtttcatttattgatttattagttgcatgtatatattgtgataaataattgaattttgtgttttatacttcagcaaataatgttaataaattagtaactgcatgattgatatgctcagtgaaaaaggatctagaacaggtcagttataaattgttgccatggctttttggatgggtgtcctgggataaatactcaacctccctgagtctctcttcctacctcttctcacagaggagaaagaagatttgtctgtgatttccaaagtttattccagatctggcattctatgcagaaatcagaaagagatgaaatgactctgtttcatatctttttttgagactgccttacacagtagctcagggcaaattaaaagaaaagaaaatctaactttttgcatgttcatgcttaaaccaagtcaatgttctgagacaccgataacaggcagcctaaatgataaatctattatgaagtatttacattactattactttgaatatactgtagtttttccagttggcatagtgaaaaggtgcatcactcaccataatacgtagagcaaacatcatgttgtagttctcaatctttggggttttacatttcagtatcccttatctgaaatgctggggaccagaagtatttcagatttcagatttttttaggggaatgtttgcattatattacccagctgagcatccctaatccaaaaattcgaaatccaaaatgttccaatgagcatttcctttgaacatcatgtgggcactcaaaaaattcagattttggagcattttggatttcaaattttcagagaatggatactcaacctatagtgagaatttaccataaatagaaatcagcagcctcaataatttcagtccatgaaacatttaaaaccaagaccaatgtacaactcttggtcttgtacaatgttggtgttgtacaatgtacaacaaaaccaatgtacaactcttcaaaataaaaatgaaagtcctgtaatgatgacagtcagcacttaaatcattcccaagtaccagcttatacttttaaataaaatgcaaattgatattgttttactgataattaagggcaaagcttcaattattgggctttttaaaaaatccattttcagctagagttgtttgtacattttatggtgtagatatagccagagtaggatttagttggaatttttcagattacataattatttaatctacttttgtccaactttgctttgtctttatagaactaacagtagcattggtgatagaacatatgataatcttgcctttcttgattatactgcatatggagttattagtcctgactctgctcctgtaatctagaatataagttaaaggaaaatgttttggaaattcctgacaactagtgagatgaaaaatcacctttaaatatgaagtatgtattttgaattctacaaacattactgctatggtaccttgttttgtacaagttatatattagatacacaatttaatagtataacaaatcccctagaatagtagaggagagaggaatcttcccctgatatgtttttgtaatacttcttcctcctcttcagtcaatagggaaatgtttgttgaaagactactttgcagacatttagaaagatacagagtaagtgtaagatgtccctccttgtccttgaggagtctctagtcaggcacaggtaggactaaatgaaaaacaactacagaactaagtagaagagtgtacaataatatggggaatgtggaacaagttatacgattaatagaaattcagaaagaaggatgattattctggacagtcataatctcaggtgatttcaggaggaaaatgagctcttaaaaataactaactgtgttttgcctgcgatgaaggcggggcaggtgttcaggcagtgcaaatacatggagtcagtcagaagtcctattgatcttttctttgtagaggctctcatagatgttcttaccttctttctcagtaggtgaggttacctcttaactcaccgagaccatcaaagctttctggcctgagttccctcatctgaaacagttcaatattgtctcttcttctcatttacatagctctatagtttcctgtgttcttttctctctcctgctggtctttgaggaagcggtatcagtatttaattcttggtccctttttttaccctttctgacactgtccctgagtaacctttccagattcttccatttcttactctccactgaaaaatgtatgtggtactcttgaaagttaagaaataaaaataaagatttggcttatttatttcttcattttattatgatatttgctggattctgcttgatagttaacagtggaactgtaagtatatcccctactctaaactcactgagggcagcacatgtattttttatccttattttctctcattgtaccatgcacatagcagatgagtaatattggataaataagagactatacatttcttcatgcttcatcattttttttctttcatcctttcttccattcatttatctgtcctttgaatagtcaaaggattttaggtagtctatgaaaataatctaaaaagtaagagaacaataaaaacataaatactcattttaaatgttttttcatttatcttgaataaatttcatttgatctactaaccctactcacctctcttctatattacttcactctgcccaaccaatgcacatcttaaaaatgagcagtacccttgcagccttcattttatcatcacccactcaatcttgaaactctctagtttgacaatatctgaaaagctactctcctgaaattgcttcctccaaggtcactcaagaatatatacttaaaaattcaaaacacttttatcatttttcactctctgctttgtggcatacaacagtattctactcgtttcttaaatgcgttatcttccagcttaccctccctgagggttgctgtcatagctctctgcataagtttggctgctccatctccatcacaagtactggctgctcttttcccccggcttcctaagctttggtaagtgattaagacttaggcatttgtgacttgccttctctctcttctctttccttcagagattttatttaattccagtgagaccctcaatgtccataatgacagccagatttccattcacttctcctgcagcatccagtaggtcaatgaagaattactcttcaatgactctgttccatttacaaatcaacatgtgtggagtagagaagtttggccttttctgtctttcttttttttttttttttttttttttttttgagaaagagtcttgttcttttgcccaggctggagtgcagtggtgcaatcttggctcactgcaagctccgcctcccgggttcacgccattctcctgcctcagcctcctgagtagctgggactacaggtgtccgccaacctgcccggctaattttttctattttttagtagagacggggtttcaccgtgttagccaggatggtcccgatctcctgaccttgtgatctgcccgcctcggcctcccaaagtgctgggattacaggcgtgagccaccgcgcccagcctttctttcttgatagcattgttagccagtcatcgaggttttaacgtttggggacttttttttttttttaatttctccctttcattttcctttcattttgcatcaccagtgctttcattagattttcttttcctctgattattttctttctcctgtcttccctttgcaccactctggtgaaggtcttcattcctcaccagtctgctatgaacatttccaacagatctccctacatttattttacttacttccatcaggcctctatgaattaaaccccacgacatacctatctcctcaaaatactttactgtctgtctgttaccaacatcagcaattcttagccctgatcatcgcaattatctgtcagggccagctgcataatttgcagggcccagtgaagaatgaaaatatgggaccccttgttcaaaagcagaaaaaagtatcattaaaggaactagaaaatttaaactttcctgattttccatggcctttcactcaacttgtcatgatgttttatttcaaatttgtatttaatgttgcattaagaaaaatttaaattttaaattgttaacatatattttactgttcatctctatattttgcagtgaccattctaaatgcaaataagaccatttaacttatttgcataaacagtaatgttacacagtatatagtttgtagcttatatgtacatatatatttctctcttgtcagaacagtggaaatgtggcacaaaactatctcaactgatttaactttttgctttggtctcatttaccaacagtttaacttatcttacagatgaataaagaagactgaaaagcaaagaaactacgggttcctttgtctttctctttccttctctgttattttcagttggctaatacagaaaagtagcgtgagcaagaaaggatatgacaaggttctttggtcatttctatcacctagaatgccattgcttcctttctaccctcaaagcaattctggttcaagcagaaagcttggccttttgggggctgtcagcacccccatttacccagtcataggcgtagcccttaccttgtactcactttgagtcttgctgaactcccacttattttgagctccctggaattcagtgctcacgggtcattttgtactctacatgtgaatggagtaagaaggaatggcagcagacaaaattactgataaaattattaagaatttcatgacagctacaggagagtattaagccaaacatggggctttgggagatggcacagtctgaatgcccatgaagccactactgtttgtatggatcctttaaaaaatagtctccagcctcagcctctgttaatcacagtctccagggaggggtctagacatatgtatctgaaatcaacaacaactactgcaacaacttcacaagtgattttatgagctgatataaaagtctgtaatctcttaggctagcattagaagatctttataatcaattccttaactacttgcttaattttatcacattactgtctactttgagcccttgcctatgactccatagaattatttgatgtctctggttatattttgtgttttggtccaccctgtgatgctcatgccattatcctcaatctcagtgctcattctctccttactacttatgggaattatgctatcatttctcttaaacacatatcaaagcctaagtcctctctaaaaccttcccccactactccagcccacagtgaatcctccttttcctcagtttttataggacttaggttctagccatttattttatgcacattattctgtagtgtgccattacttattcttttatgtgcatgttctttcttcctcactagactcagggtttctttagtacttggtattctgttgaggcttaaaatggccatgctaggatctaagagttatgatagttcctagaaaatcttaaggaataaataactctaaaaaataagctggcttctatttcctaatttgattggaccacagtacttttcaggaaggaatttacattcaaaatgtatttttggccagtcaccgtgacagtgcttttaaaattatttaatttctgaaatttaaataaaattagtaaaattcatctgaaatgtgatgccttagctgtgctgttacaagtctctagaaaagttgtaaaatctattttctacattttttccctttccaaatgagtagtttgagtagttttcctaaaagacagaattttcaaacaaaattaagaaactgtcttcaatgaataaaaaggtaactttatcagactgacatctgtaaacttaatttggagccagaaagaacagatataattgaaatatatattatatatatatttctatatatatatttggaatatatagatatttcatatatatattgaaataaatatgttaaatatatatttattgaaaaatatattaaatacatatatttaaaaataaatatattaaataaataaatatatttatatatttacttaatctttcttgttttttggtgaaaacaagtggcaatgtagtgtgaccttatacaaagatatctttcttggggaggtgtgaaattatgaggtggtatccaagtgtttggcttagaatgtctgtcatgactgtcaaagccattaatttataaagtgaaattagaaagtaatgtgtttctcccaaacacaccaatgtgcatgcatgtgatattcttacaatacattaattaacatcatcacttttttttataaactatcagtatatctagataatttataaggccctcttccagcttcaaatgttattttataaatttttgaatgtgttaagtttaagagtgtatttgattaaggcttagtgctaatggaaatcttattaaatgttattagaaaaaagatttctttaaaaagataaatatgttccaatactatactaattttagaaaaataaatttaatctttttatatcagttatctaatgtcatttaatcatatagataaaaggtctttaagttctaacagagttaatacaggatcgtcatctaattcaaatattaaaatttaattttccaaccatggaaactgtgctacatttatattaataatcactggaagtattctggaggttcttttgtgcttttttcttaggcatttaaggagactggtgaatagccatacttgccatggctatttttttgttcactctttctttagggaaaaaaatagacaagaaaaagcataaaagaataaaaagaaatgcatccttgctgtggtgtttcatgacatttctgcacttgaacatctggaaagcctagtgtgacagtgacaaccgaattgacaaagttgctgactgcatccactattacaaaaaaatatgggcactaaaagcgccactttaattctgaaaagctcaatacagtgtctcttcattttggccttgaagatagaaagagaaaccacatttattttgaagatgcattctgagcattgtgcatcgcacacattggaaaacaacagctccaaagaaaggaacatgcattataggaaaagagaagagagcagctgtggaactcggtctaattgcggaccctagatgggtttgataatcaaatgactattctgcataaactagaagtaaaatggcaaaacattaattactcctattattgcttttatatattgagatgtgggacaaaatgcataatacattttaagaacagaatctaaaggaaaagaaaaatttctacatggaaatatctgcagtgtcaaagaaaagatgccacaggaagaaagcagccctaaaataaaatgccgacaggcataaaacaaaagttatatatctataatatgctataatttaacgaagatacaaaatgaagaggagtaataatataaagataatgtattaagtctttaaatgaagacaaaatgtacattgaaatattttggttaactggcaggaactaaacaagacttttgatgttagggctgattatgctgaagtgttgttatttgtgtgccactaaattttatgatttacctccacaaattgcatgagcaatttatggaactatcatccagtgaacaaaagacaggataacaaaatgaattaatattacagtacatggtgttcaatactattattctagtgggaatactctcggtctgaactgatccagcagtttttgtgaaatgtaaacctcttcaatacaaatgggcattcattactgaaatctggccataagtaaaaactgaaacctaattattccctgttaagttctagagaaaaaacaatcaggtctgtgactactgtactctgtcacacttcaaaaatagcggccagctccaaaaatctaggagcagcaaaccaccaccaccaccacaaaatgatttgctgttctgctattaggtttttggaaatgtgtgttattaaggatattttaacataataggtatatgagccttaagaagcccaagtctagtctctgcctcatacctcaggaatcacctcttctactctggaaagttaaaaccatgctttgagttagagtaaatttatcactaaattcaacttaactcattggatgtgtcttgatttctagaaaagattttgatttgttcaggacttctctgttcataagcagcacaattggaaatggactccaggtatctctatgccaagtacagtcatcttccatttactcttctaattaaatttgaatgctttcttttaaaacttgagattgagcccatgcattgacacttatttgctccagtttatataataaaaacattgagagtgtacgactgcgtgtgaaaagaagaacaacgttttctataaattgcttcatcattacttacggatcaataaatatgtgctgataaattacacattaaggactcaaccatttatgaaaaataatagtaaatatctgcatttctctgagccattgactacatagctagggacggcctgcagtggtaagctctgctaattcgtgacttgatgcccattttccctgccctcattcttaatagagcccaatttgtttggggtatcaatgtgagcagcacaagcaatgaactgttatctagctcagttaatcttgacagtacttttcctcaatttcacagccttctttgtagctgtagatgtccatgtgctcccttcaagctgctccaagagtttcttgaagagtgtttgttttcattatgaatggggtcagttgtagccagcagtgtcctttctcctcccttgctcctcttgggccttgaacatacacgaaaaggtcaagaatccctgaaatctcagtcctgatatgtttgagttgctgaaccgctgatagcagccacctacctccatccagtcttctttggtgagaaaaacaaaactctatttgttcaagctactgctagctgaattttctgtcacttgcagtctaatgcattgctaaataagatttcatggcttagaattgaataagctcattttaaacactaggggaagagattttaaaaagggaagggcagatgccatgaaaacatacttaaaaagttattttgacttcttagaagtttatttgaacacttcatgtttcactgtgattgtctttacaattcttcagtcaagtggccagagatagaacaatttgcaattgccgtgaaaccagaactcatttgcaagggttatatatatatatatatatatatatatatatatatatatatatatatatatatatacacacacacacacacgcatattatacataatatataatatatatttatatataatatattatatatatttatatattatattttttatatattatatatttatatatttttatatattatatatatttatatagtttttatatattatatatatttttatatattatatatattttatatattatatataattttttccctatggcagactcagagaatggcctgcatttattgactattgcaatcctacttgatactaaaaatatgggagaaagagtccatctatagaatcatggaaagttagactggtaactgtcttaacctagccagactctgttgaatatattaggaattaagcagtatatgtttgtgaaggaacagtggacattgctatgcagaactcatccatatggtgggttagttcttaagcaacagtcattaatcttgcctagaatattcaaagagcatggtaaagtccagccctatctctcaggaaataaaattttggtgactaagataaggcaaagggaggttttaagaatcaggcaatgattctgggatgtcaggagacattatagctgtagttgattttcagaacagattacgagtcagactttagaagtataagtaaaaggatctagaaaatggaagcaagagtttgcaaggatctagacacaatgttaagactccaaccaagaggcttggggttctgaataagtctctaattttaatgaagtcatagagtgccaatcaggaaactgaactggagcccaaaaataaagatagttgcagagagtgcaggggtggcacttagcacacaggggctcagtgttcaatatacataccaagtgttagtctgcgcaggtaaactaatgccttaccccgcacactcttcaagttgagatttgtaacaccagtggacccatttacatatcctcataacccatttactctgggcagcacattccacaaaacagagatactaactagcaatacttatggtagtttctgcttaagctgctgactttcattcattgtaaaatgtgactcatggatagatacatatgtatgaccaccaatacataaattataaatgaagaaaaaatcatatggccagtagtttactgggaataatgcactctgatattttctatcatattcaattttttactattacttactgaaaacaaaaaaaaagttgtgattgacaaaactgatttttgacccattaataagtagatcagaacctacagtttgaaaatgctgccttagttcctatgaagatgaattcttcgttcccaattgtgctattccatctccagtttttcaagtcatgattcttccagccacactttttttttccagttattgcaagtgtgtgttgtcccagcggtgctctccataatgacagaattcttctaccaatgctaaactccttgaagattgttacttaatttttattcaaccatttgcaagaagaaacctggagccttcttaacataggcatgctgaaacccagtgataggcagtttctttgtgttttctggtagcaggtctagcctctatttgtcagtcatttatgggcccagagtgcttaattagtggcagaaagggacataatagtgagagaagcatacattaaaaaattacttgacccaggataaggatgtggaacactgttggctgagagtgctaggaatctgctgctcgtgagacaaaattccagtttagttggccaggctaaccaccattggctagaatcatacaaaaacacttaaagcacaaaaaaatcacgtaagctgtgctctgaatgccctacacttacatgtattttatgtgtgtgtttggtttgtgtgtgtgtgtgtgtgtgtgcctgtgtgtgtatatatatatatgtgtatgtgtatgtgtgtatatgtatatatatagatacacacacacacacacagtcatgcatcatttaatgacagggattgagaaatgtgttgtgacatgattttgtcattgtgtgaacatcatagagagtacttacacaaacctagatggtacagcctactacacatctagggcatatgatatagcattttgctcccaggctacaagcctgtatagcatgttactatattgtaggcacttgtaacacaaagataagtatgtatgtatcctgtatccaaacatatctaaacacagaaaagctacaggtaaaaatgtgatataaaagatttaaaatggtacatctgtatagagcatttgccatgaatggagcttgtaggactggacgttgctttgagtgagtgagtgagtcacggtgagtgaatgcgaaggcctaggacattactgtacactaagattttataaacactgtacacttaggctgcactaaatttatttaaaaaatttttcattcttcaataataaattaaccttagcttgctgtaatatttttactttataaaatttttcatttttaaacttttgattcttttgtaataaagtttagcttaaaatacacattgtacagctctacgaattttttatttctttatgtccttaatttataagcgttttgctattttaaaatttttattttattttttactttttaaacttttttggttaaaaacgaagacacaaacccacacattagcctaggcctctccagggtcaaggccaccaatagcactgtcctccacctttatatcttacaccactggaaggtcttcaggggcaataacatgtagagctgataacaagtctgccctgataacatttcgttccgggattcttcctgaaggactgcttgatgctgttttatacttaatattttttttttattagtggaaggggtacactctaaaattacaataaattatattataataattaggtaaaccagtcatatagtcatttattatcataatcaagtgttatatatactgtacataattgtatttgttgtatttttgtcccatggcagcacagatttgtataccgcagtgttaccacaaacacatgagtaatgcctctcaccgctatgttatgatggtgttgatagaaatttttcagccccattataatcttacgagatcaccatcatatatataagtcgttgacttaaacatcattttatggtgcacgactatgtatataaatatataaagaaggtacttcaaacacaaatattataatcagcacagcagcatcaagcaaaacaattcatctgccctgctgttacatgcatagcttccaggaatagcatttccaagaatctgttgctctgcttcggggttcagaaagaagcctggataaaagatgtatgagaaattccccatgattggcttttgtatctatggcgtcaattcttccctttcctgtcatactttaggcatgcacccataaattgttgctgtgtgccacctcttttttttaccaatcccttccctgcagattctatccttggacttcagcttcagtttgacttgactttatactctgtggttctgcaatccacccccaaagcatcagaaatagctgtaaaatagctagtatgtagcactctaaagatgcagcattattaaatagctagttgacttttgctaacatcatcattttatgtgtctaaaattagatcactttattttttacgtattgctgatgagtcctaagaacagttgtcccaatggtttcatagtctaaaatttgttactgaggagcacatgagaaattattttttcatttatgaaatggaatgaaaattgagcatattggaacagaatgttcatttacattttaagtcagcagaataggaataatcaaatgaatgactaatactaatagaataatacgtaatactgatatttaataattaaataaaagagttaaagagttaaagagttttcctgcttatagttgtagacattgaagaatttgtttaagagcatgataaaattaaaataaaccctttttaaaaaattgtccctggagtaaagttctgcattacactaatgaggtactgttggagattttatattcttaagttacattcattgatttttacttttgacgcaagactaaattttaccctggagctcagtattattttctgccatgtgttaatttcttgcatgaatgccttatttaccttcatttagactatgctgcaggtggaatgcgagcagtacttattgctgatatttttgttggccaaagctgaaggacatctcagggtcttgaatagctctagggtttcatgactatgaaggcgatttcaaggtttgacttgtcatcgtggaagactggcttcttaaacataatcctatgagccatgatttaaattaacaaaccttatcaatagcttcacaacagttggcatctgttttaaaggactcactttttatttaagattgcattgtaaccacaactcagttcatcctgtaggagtgctcattgatacaataattgagtcaagtactcttactaaacgattattaggttttagctgctgtgttataagctatattttctctcttaaagcagtcagtttatagcatattattcaatcccatgtgcattacaaaacttatggccataaaatttacagtgtggtttgttttaattcaaatgcatttacgttgatagttttaataattacacgtttctatcaagagtagttggaaaggaatacagttgataaactattataatagttaacagccactgggcttataaaagaacctatggttatctctgagctataattggtaagtgtgtacaatacaaccagatttttctaaggtgcttatcacctattaaatatgcctattattctttcctcaaatacttgaatattgggacagatatatacagcttgttttcaccctaaatagtaagttactgtttcaaaacattttcttgtgacttgtgttattatctgactcctttaggaaaactgtcattgcaaagatatgataaaatcatctttaagaatcctagtattctcctggaggtgattctttgtccccttgtggaaaggggacagtgctttggcataggcaatcttggattcagctcctgactatgcttcttaaaagcagcctcagtcagtcttccagtttttaaaatagaaataagtacccatgtcaatgggttgttggaaagattttaggagataacatatgaagtatctgactcatagtcattgcactgtactgctagtctttttctatgaaaagtcaccttgagcttaatagttatcaccacttcattgaaaatagactttaatgtatactcaacctccttgggtattccattgttctaggtattcagctgaactactggaagagcaaatttggagatattttataagggtcagaacactttagtttaataataccattttaatttgccaaatggttagtgatattgtaataatgttaaaaaccaagcaaacacaagcactttgttcacagagttgtgttattggtcctcactgaatttaagtatttaccaatcatatatccttgagtgaaattttagataaatattatttgcaggcattaattgattccaaagggagtctttgatgttctctctatagtcctagggaataactctggtttctttaaaagattgctggacctaaaggaaggaaaaaagacatgtcagtcctttgttcttcttcaatacttataccttcccctggtttttcacttctggagtgcctttcttagtttctgatgcaagcagcaaaactagatagccttgtcatcagccttcattccagttctgccatcccaacctggtaggaattaggataaaaatcacttcttcaaatggcagatcctgtggcttagactatgaagattatgagattcccactttaacccctaatcagacttcagacctagtctcactttctcaaaggaaaccctaacccagctttccccttgactccccacctttgtcttttagtaccctatccccacctcatgtgtagccttctattttggtcccacattcctcaactagttcaggaagtttcatggaatcatgtgctcgtgtttggaaatccttactgacaagccctccttgggctaaatatcatccagataattgtagccttattccacatcctgtgtttactgatgcctaaaaaaagaaacataatctcttcttggtgacaaacactttgataaggaaaaatataaaacttgagaaaaaacttgagaaactttagaaatatatctcttgtttaattagagagtttactttgggatcaagaaaaaggatgcagcaatgacttggactttttttttattcagtagcaacttccaagcattatttcccattcttttgaaaactctttcactgaacttcttaggttaaggtcatagctctcgatatggatagcatttcaccttaccctgtgggggattgatatcttatctaagggataagagcagtattgaatgtgttttagaaaccatcacgttacccacccccaacacacatgcacacacagacatatgtagattttatgtatggaaacttgcagatataggaatattttatatatttgcacaaagttataaagtcagggaaaaatagaggtagttcataaattgaagctattattaatgctgaagatgataaggcactcacattgaactctaatattttcttccctacttattaataatggtgtttatgacagtattttaaacctagcacagggtgcatctttttcatcaatgtcttcaagttcctgtttctgggtttaccaaagcctctaactggtcaagattagtccagctacttccaatgttgaggctctggtgcattagaaaatgaagaaatgtctaatattcttatgaaggatgtggtatattaagaattttaatatgaacactgctttcaatttgtcatgtcagtgtgtctgtgactgtgtggtaaaattcagatagagacaacattaaaatttaaatctaagggcctttaagaaggtgagatccaggctgcattgccctctaaagttcctcaaaattaggcctggcaccttcttcctcaatgactgagtgactatgaacatgtactctgtggtcccagcaggtgtttcttaaatctggcagtaatgctgaagtcagcttggcagcttcaccaggaccactgtcacttggcatgtcctgctttaatgtgtgaagctgacttactcccttctcctttttgtgttttagcaagcagaacttcatgacttgtgttgccatgagttacccttggaagtgtaccatttctacataacaattggatttctgagaaattcgtcaattgtgtcaaattgcaactttcaatcagatataattcaagtgagattaaactatatttagaacgtttaaccctgattcctgttgggtaagacataaagaaatccactatggatgactgagccttcagcacaatttcacccttaaattattagactgtaatttatggtaacatctgtttctgacactgtatcatttccttaaacttaacgttttccttatgtcaatatcaagttcattccatttttattatggcattggagaataatgtataattagtaacagttatttgaaaatctgtaaccacctgtatagtcttatttgcataataaaaagggagggttatcagctgcacaacaatgctgctctagtctgctaggttaatgaggaattcagttggtgagcagagtgaagtatttatcttaaaattaaaaagagccttacatttaagtaaatgattttcagaatgaacgtcttcaatttaggtggcacacatcattaatttctctgaaattgttttgtacatttgtttcttaaatgttgactatataaaatgccattaaatatatttatttgaagtaatatgctctagtaggcatgatgaggtaaatgtgatttaactgaaatttatacttggatttttaaatctaattttacatggagcttcaaaattctcactgtgttaatgaaattatcaccatggaaattttacaacatgtttcccttaaggaatttgaagtcttttcaccattttcagatgatttgctttttaaaaaaatcagctgtcagattatgttggatgattatatcattgattgtattacacaaaagaaaactggaattgaggaggcaaccctgctgatttgctgctacctctacagaacaagatctgatattgtaatactgtgatagagtaaaacctataaattctgtaagcctaattgtttagatttctagggttgattttccttctttccccctgcctttttattttggaaattgtaaaagtttaagacagctgcaccactgccctgggcatccaaaagagagttctctgccacatgggggcctgtggtgacagtggagcatcaccccatgaacagacatcaggcagaggcatcaatcaaagccattgattggcagtccctccctactgggaaacgatcattcaaggacaaaccttggaggttctaattgttgttatacccaggaaggaagacctttcctgctggagtctttattgagctcttgtatgtctgacttctccaagcttggcttcctacattcaggaacaggatgggagtcgtactgtggcggtcacctttcttctgtgggaaccacagtgcctttagggattagtgatacaattgatgtgaaaaaagataaatggctgcataatgcagttattctagccctttgtcttcagatcaggtctgtgttctgggaagcttgttatcactaatagatatcaaagtttacacaatacttggactttttctagatctgactatgaactcatacagcttaacctgaacatatgtttccttgtttttccacaaaaagccaggctatgtgaaaagaagttaaggagagagaaaatgccatttcaaatattatatttgtgtaaaattaacttgtattctttcatctcaaagcctctatgttgtttctttttcttcccttcactcccctatactgtataccaccagaatatatcctgtgttgcagaaagctttgatccaaagtcctgttagggccttaaaagcatgtgtctgaactgcctactttttttaagccatagccagagaaccacagacatgggctttaaaggctttgtgttttaaagtttttttattgatacaaatatttgtacctatttatggggtacaggtgatattttgttgcatgcatagactgtgcagtgattaagtcatgatattttgggtacctatcatctcgagcatttatcatttctatatgctgggaacatttcaagtcctctgttacagcttttttgaaatatacaatagattgttgttaactatagtcaccctactctgctatcaaacattaaaacctattccttctgtctaactgtgtatgtgtacccattaaccaaattctctataattctcacaagctctcaccatctacacacccttttcagcctctggtatctcttattgtctacctccatgaaatcaactttttttagattccatatatgagtgagaacatatggtatttgtctttctatgcctggcttatttcacttaacataatattttccagttttgtccatatttctgcaaaggacaacatgatttcattcttttcttatggctgaatagtgtttcattatgtatatgtagcacattttctttatccatttgtctattgatggacacttaggttgcttttatatatttgctattgtgaacagtgctgcaataaacatgggagtgcaggtatccatttgataaactgatttcttttccattggataaaaatgaagtagtgggatagctgaatcatatggtagttctatttttagctttttgagaaatttccatactcttttccataattgctgtactaatttacatttccaccaatggaaattagtggatttctcagcatcctctccagcatctcttattttgctgtctttttaataaaataattttaactagagtaagatgatatctcattgtggttttgatttgcatttccctgatgattagtgatgttgaacattttttcatatacctgttggctgtcatctgagaaatctctatacaaatcgtttccccatcttaaatgggattttttttttttttttttttttttttttttttgctgttgagttccttgtgtattctggatattagtcttttgttggaagagtagtttacagatattttctcccattgagcagattttctctttctctgttgattgtttgctctgctgtgcagaagctttttagtttaatatagtcctctttgactatttttgcttctgttgcctgtgcttttcaggtcttagcgataaaatgtttgcctagtacaatgtcctgaagtgtttcccttatgttttattttagtagttgtattgttttaggtctcacatttaagtctttaattcatcttgagttggttttcggatatagcaagagaaaggagtccagtttgttcttctgcatgtggatatccaattttctcagcaccatttattgaagagggtatcctttccacaatgtatgttcttgatgcctttatcaaaaatcagttggctataaacacattgatttatttctgtattttccattctgttccattggtctatatgcctgtttttatacaaataccatcctgttttggttactatagctttgcaatatattttcaaaaagaataaagatgcaggcatcatactacctgacttgagtaaggtagtagtgggaggcctccagctttgttctttttgctcaggatttctttggctatgcagggtctttttggtttcatatgaatagtagtagtattttttctatgtctgtgaaaaacggcattggtaatttaatagagatttcattgaatctgtagattgctttgggcaggatggtcattttaacaattttaatccttctgatccgtgagcatagtatggctttccatttgttcctgtcctcttcagtaactttcatgagtatcttatagttttccttatagaggtctttcacccactttgttgaatttattcctacgtatttggttcattttgtaactattgtaaatgagattgccttcttgattttttctcagctagttcattattgatgtataaaaatgctactgatttttatatgtttattttgtatcctgcaactttactgacttatttatcggtttaagatttttttggtgaaatctttaggcttttccagatacaagtttatatcatctgcaaggaaggacaaattgacttattcttcttcaattttgatgctttttctttctttctcttgcttgattgctccagccagaactttcagtactgtattgaataagagtggtgaaagtgggcatgcttattttgttccagatgttagaggaaagactttcagcttttccacattcaatatgttagctgtgggttgtcatatgtagtcttcactaagttgaggtatgttctttcattgcctagtttgtagagagtttttatcatgaagggatattgaattttatcaaatttttttgcatctattgagatatttgtggttttgttcctcatcctgttgatgtgatgcatcatgttgattgattttcatatgtagaaccatccttgcatcactgggataaatcccacttgatcatggtgtattatcgttttaatgtgctgttggatgtggtttgcttgtattttgttgagaatttttgcatctatgttcagcagggatattgacctgtagttttaatttgtgtgtgtgtgcgtgtgtgtgtgcttttctcgttttgataccacagtaaaactggcctcttcaaatgacttagagagaatttcctcctttccaattttttaaaacagtttgagaattggtgctagttcttctttgaaagtttggtagaatttggcattgaagcaatctggtcttagacttttatttgtgggaagtttattttttattactgacagtctaattactcatttctcattattgatctactcaggttttctatttctttctgaaatataaattcctctgtcaaagaatttatccactttctctaggttttctagtttgtcactgtgtagttgtttataatagtctcgatgatcttttgtatttgtatggtatcagttgtaatggctcctttttcatttctgattttgtttgagtcttcttttttccttggttcgactagctccaagtttttcaattttgtttatcttttcaaaaaaccagcttttcatttgattgttcctttgtgttgttttttagtccaatttcatttagttctgctctgatttttattattcttttgcttctactaatttggggtttggattgttctggcttttgtagttccttgaagggtatattagattatttatttggaatctttctacttttctgatgtaagtgtttattgttataaattttccttttagcactgcacttgtatctcatagatttttgtgtgttatgctttggtttttatttatgtcaagaaattttttcatccagtggtcatttaggagcatgttgtttaacttccatctatttatacaatttccaatgttcctcttattgatttctagttttattttattgtgttctgagaagatacttgttatgattttgattttttaaacatttgttaagaattgttctgtggcttaacatgattgatcatggagaatgtcttatgtgctaatgagaaaaatgtgtgttctgtggctgttgggtgaaatgttctgtaaatgtctgttaggttcacttggtctgatgtacagtttaaattcaatatttctttgttaattttccatgtaaatgatctatctaatactaagagtgaagtgttgatttcttcaattattattgtattagagtttctctttccttttacgtctagtaatgtttgctttatatatctaggttctccagtgtgggtgcataatatttagaatcattatatcctcttgctgaattgatccctttatcactatataatgaccctctttttcgctttttaccatttttgacttaaagtctgttttatgtaatgtaagtatagttactcctctttgcttttgattttggttgttcagtatcttcttccatccgtttactttcattcagtctatattttttttaacaggtgagatgagttttctttttttgtaggcagcatactacagttgggtcacttttttagtctattcagccaatatgtatcttttaagtggaaaatataacctattaatatttcttaagtataacctattaatattcattaatattgtttttaatatgtaaggttttattcctatacttttattaattgttgatttatggttattttatgtttctttccttccttttctttctttctttttttccttcccatttttctatctgtacagtctggcggttttctatagtggtaacatttgaaattttttcttctttgtttgtgtgtttgctctacctttggtttctatcttcttctgtgttttcatgatggtacatatcattcttttgcttcttcatgtaggacttcgttaagcatttcttgtaggtacagtctagtggtgatgaataatcttacgttttgcttgtctgggatagactatatttctccctcatttatgatgtatacatttgcagggcttaatcccctttgttaaaaaatttttctttcagcactttgaatatatcatctcattctctcctggcctgtagaatttctgctgagaaatcccctgttagtctgattggggtttctttataaatgactggatgtgtttctttttctgttattaggaatctctctttttctttgacttttgacagtttgtctatagtatgccacagagaaagttgcattgtatatttttggggatctctgagattcttatatgtctaagtctcttgctggatttggaaagtttacaacgattttattaaataggttttctaaccctttcagtttttctttgcctttggtgaaacctcaaatttgaatatattgttgttttatggtgtcacacatgtcacataggctttgttcattctttttaaaacattctttttaatttgtatctgcctgggttatatcaacaaaagcctgtattcaagttctgaaattatttcttctgcttgatttagtctattgttgttgaagcttttgaatatatttttattctatttactgaatttttcagtttcataatttctatttggttgtttcttatgatatctctttgggaaatttttaattcatatcctgaattgttcctatttttttgtattgttctctgatatctcactgagcttttaaaatatttctatttgaaattttttccaggatttcatgtatttctgtttgattagaaaccgttgttggagagtcactgtattactttggaggtaacatatttccctgctttttcctgttgcttgtatccttacattgatatctccataggtgataacaattacttctttcaatattctgaatttacttttgtagaagatgacattttgctgaagttatgtctatggtattggttgggtagggcactttggctttgattctgggtgcatgcagtagtgtagtgttcttatcattcctttggttgttatctgcaccagtcctgtctgtgacttcctcagtggcttaaggtgtggttgttagtggaggttgtggtgaagttatgctgcagatgggacacaggtgggcctgtccttgggctccagaagtagcagcagggggacaagtctgcttctccttaggccccagggtggcgtatgttggcactggtattagtgaattcaggcaggctgatttttgggcctccaggtggctcgctcagatttcagtagttcagccgtgggccaggcagtttggtgggttttcaggcccctgggcagtaggcaagtgaaggcaatggcagtaataatggtagaaataacttctgggtcccaagtggtccatggtggtgttgttagtggctgtgatgggctgggtggaccagtcctcggacctatagatggtttgtgcatatgtgtgcccactgtggtagtagcagcgggttgggtgggcccaacttcaggcccctggttggagtactcaggagccactgttggtagactgggctgggtggcccctagaaccccagtcagcatgtttggacacctttgagttggagccaggcctagtagaccttttgtcaggtcccatggtggtgcttgcaggcactggttatggtaggcagggatggatgatccccaagcccaaggcagaatgctcaggtaggagcagcagcgactgcactacattcttgctactgaggagggcaggtttgctttcaatggcagcaggagtatacaggtggctagggagtgtgcactttgcttgtgctttggccccaactgttgtagcccactgcagcagcaactacaggtgtgggagtttgcacttaaagtgcttgaatatgcataacagctttgctgcctggggcaactgggcctggcaaaggtgtcctatgtggaagtggcccatgctccaatgactcacgctttaaccttggaggcagcagccagctgcagcagttactgtaggcaaggcatgccagagggttccagatatgtggagatgcaagggctgttttgtgtcctgggcaggatgtagtctggtgagggccaggctttttcaatacggtgccttgctgtagctatttaggactcggggtgtgtgtgggatacagcgtgagctccctctctggagcagtgccttcctatggtcttcaggcagatccctgtatttgttttggggccatcagggcctaggggctttcccatggctaggatatagaagtccacagtaggatggtggactataggggttcactcttgtcctttccccacattggggagctccccccaaatcccagacaatcatgactgaagaggctgcttcactttcctctccttccttgtgttaggtgttttgtgtcacctctgcgtaggattccagtgttttctcttagatgattgtatttgaagtatgattacctactcactattttggtttttctttgtggaagggatgaataccagctgctgctagccagccatcttggagacccaaaggatttttaaggcataaagagtaactttatctacctccacctattctcttactctgtccctcagaaccttgagatgctgagtgaagggtctccagatcctttctctggcttgtttattgttgggtatcacactgccttctccctttgctgaccttcagctcaggttttgagtcttttggtacctagggggtcacctttctgactagagaacagagaaaggagagtgtgttaagacttttccagtgaaggaagctgtcagcagagaagaaatcagtgatttaggggaagcctgatccaggacatgtaatttgcagggtgtactgagctgggggtaaagcacagaaggggaggaggggagaaggggatgggtaggtaaaaagagagaaatagggataaaggagagagataactagatagaggtgattaaatataccaatatttattcttccagaaactttaagcaaatattcatttattgcatgagacatcagtggtcataggatagaagagtatataactgattctcaaggagatacagaaaaaccaaaaaaaaaaaaaaaagaaaaagaaaaaagaaagaagaaaagccaaagacttagtttggccatgacactatagaaccaattgtaggaattattgagaactgtttatcattaatggctgatcatgatgccacagactaataattatgaaaattgtgaatgtacattatttgattgttacagcacacggttagtatatagtcactctaatctttaactttcatgttcaattgcttagaatttaaatatttaggtaactttgcatgagacactattcattccacaaattctttgttactaaaacaattaggtacagagtactgaagaaaattgcaaaaaatcaaatgtgcagttgtgtcaccccttaacatttactgtggggctacatttaaacattttttattttattttattttattttattttattttattttattttattttttgagacagggtcttgctcagtcacccaagctggagtgcagtgtgatacaatcatagctcaatgcaacctcgaactcctggtctcaagccattctcacacctcattctcctgagtatctgggactgcaagcgtatgccatcacacctgaataacttaaattttatttggagagaaggggggtcttcctatgttttccagactggtctcaaattcctgacctccagcagtcctcctgccttggcctcccaaaatgccgggattataggagtgagctaccatgccgagctacatttaaacattaatatttaaaagcagtatttcattcttaaactttatgtaattacgtgtaaaatgctggatgcattattttaaaaatgcatggatgcttaacttgggagaatctgagctaccatgccgaactacatttaaacatcaatatttaaaagcagtatttcattcttaaactttacgtaattacatgtaaaatgctggatgcattattttaaaaatacatggatgcttgacttgggagaatagaaggaaaaaaggaaggaaaaaaggaaaaccggtatctatttcttatttcatgagtgataacatctgttctgaaagatctgcattatggactgaattgtatccgtgaaaattcatatgttgaagccctaacttccaatgtgactgtatttggaaacagaaccttaaaaatgtaattaagattaaataaggtcataagggtgggaccctaacccaataggactggagtccttatgagagaaggaagaaacaccagcgcacactctctctacgtgtgcacacatagaggaatggctgtgtaaggagtagcaagtagtcccctctgcaagctgaggagggaggtctcaccagcaaccaaccctgctggcaccttgaccttggacttccaacctccacaactttggaaaaataaatttctgcatttaagccaccccatctgtggtattttgttatggcagcctgagctgatgaataaaacaggtgagtatgtggggatatcccctccattgttgtgtcttcattccagttctgagtcaggagattctcggaatttcctgggagtaacagttccatccaagttacaagttgcgttaggagaaagaaaaggctacacctcagaaatgatatagcatttgttgcaagagctcaagctagcctctctgtgaatcagtgcaaagagaataaaagtaaattcaattaaagacttctgtgatcctattgccaagtttctgtacaaaatcaattattattatttattaacttttaagttcaggagtacacgggcagatttgttataaaggtaagctcatgtcatgggggtttatggtacagactatttcatgcctcagacgttaagcctagtacccattagttatttctcccgatcttctccatcatcatcctccaccatctggtaggccccagtgtctgttgttcacctgtatgtgtccatgtgttctcatcataaaatcaatcattttttatgcgtataaattggggtcagattaggctatgaaagcacagcatagtatacaaaaatattttcagcctatagaaaaatattgttagttaaaacacctcactgatacttaacttaaaaataagtaaatcatcattatactgaatcaccacctcttctttatcttttcaaaaatggtcacactaaagtgacttccttagcagatgtctgggtctttatttttgtatcatcagcatctagcacagcactagttacattataggaattaaataaaatatattcgttgaatacatgaatgcaattaaatggtgtatgtctagatttttcaatatatagggtattttcaattattgttaacagatctagatcaaacaaattaattttgaaaaagtctttacttgtaagaaatgattatatatctaattattttcaaggttcttcaactcaaccgccagctcttattttcctaacacaatctttgttttcaatttagatgtttacaaatatattaatccagcactggcttgttacacaataggaatgatctactttctgctataatttattcctagaagaggtgtgtctttattatgccttattaaattaatgtattacccaaaaaatctttgtttcttaaagtaattaataagaggataaaaaagaggttaaaatacaatttgaaaaattaaatttcttttttacattaaaccttagtgtttttattacatgatacattttactgaaattccagtcaatcacaatatttaatgtgggcatgctgctcttatggttaggttggattgactatgttttatggaaagaaaatataaagataatattactaattacattatgatactggtagtaattttagggggagaaggcatatttgctgctagtgtgtcttctgttaatcatatctattgtccacccaagctctggccctgaaaaggcagaaagaagagcagttttagggtctctgccctccaatagctaggacaccgaccagtgtaggaaggtatctttaggcccttttgagttctcctgtacgtgtgactttggaaactgaaagagaatttttgaaggaaaaaaaaaaattgcaaatcatcagaaatcatcaggaaaagaaacaggtttaccaaatctgaaaccatatactgtcccatgcattagccttatccccatgaaggcacctgtgaggcaggatgccccagggacagcagtgtctgctccgtcacctctgtgcacatggagccatctgttacacctggccaccagtgccttcatggagtagttaatgtttgagtctccctgaattttggattcatgtgtcctcacatggtggacaggcaaaggggcaaacaaattccctcaagcctcttttaaaaggacgctaatctcattcttgaggggtctggcctcatggccttgtcacctcccaaaggccccaccttttaatacttgcacattggtaattaaatttcaacatatgaattttggaaggacacaaacactcagaccgtaatagcaagcacttaccactggctattacatatttcctcatctatgtatttgtcttgatgtaagattcttgaaaggcggggcctaggctgaatcgctacgtcaacctcagagcttacaacagtaatcagtgcaccaataaacatttgtttaacagatgagtgaaagaatgaatgcttattctttatagaccaggaagaaaagaaaatgttactgttacaaatgagaaaacaaattccaaatggctaatagtttccttggcaattataggccattggtagcttacattattgaggacttttctttgaaaccaatcccagggaagctttcatccctaagtgggtgatttattcaagttatcagtgtgagtatttggcggctaaggaccgggagaagatgacagaggaaagagagtttgtgagaggggtttatatatgtggtaggtctgtgggtctagaaaatgagtcaggttttgccaggtgtctacttggtagaagaattagaggatagcattctccctttggaaccatttaatccgttgaagttgcaaggtgctgagtctgctgtggtctaaagagtgaatctgcttctataaatgcctctttaatatcatggagccatgtggagctctttgccctgtagcacacagtggatcagaaagcactgggccagtggtccatggcttcctgcattgtggcggcctactctgccaggagtccttcaggcaactaggcaagaaagaagtgagaaacatagatttaacactggcaaccactgtactcgctttacaatgcttatttttggaaagtggttgttgtaaaaacaattctttatgtgtccttgaacatgatacttcttcagtttccattgtgattgccaaaggggtatattcatacccttttgaaatgaagaaatggattctctattgggtttggcttttgtgtttcttaaacctgttagcatcatgcatagagcagaaatatattaattgaactctatgaaaatacttcctaactcatagtctaactcaggtttcaaatgactacagtggctagggaagttagaattttttttccctagaagacatgtctcatgatcttttcctctctctctctcatatatatatatgagggctgtatatgggggtggggggtacaattgcatttgttactttttttcggggattatcagcctaggcaacagtgcaagttcttccggagtcagagcagaaggaaatatgtcttccatatatgtgtgtgtgtgtgtgtgtgtgtgtgtgtgtgtgtgtgtgtgtgtgtaacaccattcacacttgaaagttgtgggaatttaggaaatgagaacttttgcctatctaaagaggtaaacactggaagttccagctgatttgtcatgtgggtttgctgtgatgcaagtttgtataattgttaaaataaagctgaaaatattatgtaaaaattctatattgaatattggcatctagttctactttctaaaaaaaattgccagccaacactgtgcagcatactgttcaaattaaagacacgtgtaagctgtgattggctaatggccatcaggttgcggtctctggttaaatgctaacgggcatccatctccacatttccaccattgcatttgtgcccagtaagcccttgctgttgtcatcacttgctttgtggagggacctcttctcctctagattttctctatgttctctccaggatgtactcagtgtctacaccaccaagcaggctttgaagctctgagtttctatccagagagcttctttttccatgtgctgtcagctggatctctcaaggacacatagtggctctgcctcaggtgtagacctccttgagccattcttgaaggaaagtcttcacatggtttcaactctgcagccctcctaagatggccttttcaatagctcttcacctccccactcccatctcttcatgtgccatagccttgcccctctgcttgagccacaggcactaacgtgtatttattaggtggaagcaggcccccagccttgcaaggcaaatgtttgtatgtggtagagggtctatattaggtgtagaccctctttctgtatgaacatgtcttagactctcttcctatatgaatgagaacgtaatgatggacctctgatacacggtgtagagtaagggagtgggggctacaattgcacttgttactttttttcggggattagcatcctaggcaacaatgcaagttcttctggagtcagagcagacggaaatatgtcttccattctgattcatgtttcaaaaatgaaaaaaaatatatgaatagactcccttcttttccaaaagaatactgccctggtattaaaggcaactactgtgacagatgcaaagcaggagatgcctatgtgtgtctttccccttgttcaattctatagtctgcaattgtaactgttgctctcagtgactagaattgcaggttggcaaccataaatctggaagtgacattctagtaaagaagacaaagcagaaaaaaaaaagtgccataaatgcattgagttctctcctgtgtctcattttctacaacaacaaaaaataagccctaaaactgtacctaaagcctttcttgctgtatactacgattattcctgattcattaaatacttttgcagctgtaatcaaacttgtttaaagctcacgtgttcatgggctagaaaaacactttagaaaaaatgtgaacaatcaaagcacaattgccagcatattattattggtatttttcagcataatgcagtttccgttctagtccactccactttttgaacattttatgtctgtaggcatatgcaaatacaaatccctaatagagttcttattgtgtcagtgcttgagttatatttacttgccagaatattcataatactaggtgcctgtgaaaaccattgaatttttgtggctaaggttgtattggagagataatggcttgaaccgaaaatgaccactgctactttgcatttgtgaaatgacataatctattttctctttttgataatagtgtagggcacatttttaacacctgggaatgaagcttttccccctttctgtaacttcttacgttgttaatgttaatttgagcaccattactcacaaacttttggtgactacagatttgaatattaagactatataatcagagattaaattataacatagtggaaatatcagagataaatttatagcatagtgggaacatgacagtaggtctttattgaaattactgctttagagagaggaaacggtaattaaaaagagaaagctattttattgcttcatcaaatagtttagatgttcatcttgttattttgtcactttctatactggatgttaatttttttaagatgaaattattttatatgcaatcgaaccatcttaaaattaatcttaagaaaactggaaaataaacatttatttctccaaatgaaaacctataacagtattataccaaacaaaaactttgcatgtattttcaaatcctatttactctggaagaatcctaggtttttcatttgggcattttgaaacatacgttggtctaatggcatatttcatatggagtcccaccagtcatcagcaatctagaatcagtgtctgaagaagattctcaaatggaggcattagtgaagtttggaagggcacattggactatcatcatttcaaagatggacacgattctatttccttatctgcttgcagagctatttaagaatcaatgtcttatttttcctgagtcctttataaccctattcatattttcaattgctgatgcctctttgagctacgagttctactttgtgcataacgttgaggaatttctacgtttactgtttctccttacttcactcatctccttcattaatggctggcaagtcaccgaatttcacttttctttacacaggtgtaaggaaaattgcactttagtcatgagtaggctgaggcagccttccagtgcagcatgactcagcggatttgcagcacaggtgcacaaccccacacattatgtaaccacgccacgtgaggcacattaggtgatcatccacgtgagcttgtgcttggctcagagccattattgcctgttaaaagttatgattaccctgctaacgctgtacgtacagcttgcgcctaggcttactcctgcccagagcgagagtaaagccatgtcaaaactgtctgcagttcctcaagtgtttttccagccacctgccactcacccaccaactccccttggacctcagtaagaacctgacaataggtcagctcactgttattttattattggtggttaaagcttgtggtggtgggtggtcctgacttcattcaggaagacattgtacaagagttgtagaagaggagaaaaactaataatttggctaatgttgtggaaacctcgaaactcatacagtcaccttatgtaacactaacctcatcagggcctaggatttgcatagcagactgagcagattgctagacccattctttaggctgcctttttatgattcagcattgttttctaggcaatttttaatgtttttggagtgatgaaataaaagagggaaaggtgaactagagaacaaaagataaaactcttcccttcattgcctcacgagaaaaattaaagtgtcttttttaaatgagtgatgattccacctctggacacagctcaaacgccattggaatgcttcccctattacagggaagtgttgagagaaaaagcaattgtccagagagttgatgtagtgtagtagtgtggatcctgtttttgaattctggctataactgtgtgaccttaggcaagttgcctaacatctctcaattataaaatgaacataaaaattgcaccaatattatggtattgttatgaagattaaatacattaatacttacacaatagttagaagagaaattgcaacatagtaaacattaggtatatcaaacatacatgtgaacagaaagcgtaaaagaaagcagatattcaaggagacttccagcatgccaattttcgagttcaaatactatctttccaaaacaatccgtctgaagtccgagaacacactcaatattgttgattaaatgtttaaataatatttattatagctagcatgttcatttttagacaggttaaatttatgaggcagcaaagttataatattatgtgtggtcgctacaatttatggtgcattttggtccctgtataatcaacatgcactgttcatgtatgcccattttataggactaggagtataatgatgatattttaaattattatagaggccaaacattgttctatctttgcctttatagcatattgttgatcatatctcaaattcatttgaaaaatgaatccttgttcaggaacacaacatccaattacaaaattactcctaggggaaaatacaagctgttttatggtgtgatttccaggaatgcattgtggtgtgaagtagaaattacctacatcaattttgttttctttatttatttcaagactatctctccctacaagttttacctgctttgttccagtagtttataatttggtaaataagtcagcatttcatttttcttatacagctccctgttcatcccctgatttctgtgttgcctttgcctgaacctcctctagtttcattaaatttaattagtatcaattgccagtgtcagcacgttgaattgctttataaggctgtataaatggcctctgatggcttcagtgtaaatcctagtcatctggatcaggtatataaaaacttcccttaaaagtggtctctgctatgcaaactaagttccttctcatctctatatcatctcatttctatatcatattatttcctcattttcctacagaaaggacttggggatatagaaagggcgtatgtaagagttctaaaaattattaaaggtttgagaaataatttttaagagaaaatgtcaaacggttttggagtgttgcccagccactttcctgtactcacattcacccagcatctatctagtcttcctaaccccatctggaagctcagctccactcctgttcctggaggaaggccagcctatgttcaaaactaaattagccttgcatccatttcttacctcatgattcgagctaagcatgtttcctggttccatcatctgggctctcattttattccttttgctcatgttctcaccttgtacctatcaccagttccctttttgccctctttaagtcctattttgccctatttaagcccttgcttaaattgattgcccaggtaaacatttttcctggattttattatttattttatgagatccctgttttctgccatcgatcttccttttacccagaatgtctgtgtctttagcttccatttcattcagtgttcagaatgtcttcatagcatgagtgccctttttttgagacatccatccaccccctggcactgaaactttctgatgggagatcctacccatgcccatccttgttagctctgtagttacggaacctagaagagtccacagataaccagaggtgccagaaatcaacgctggactctggtaactcaaatttacttattaaaaaatagagacaatttgtttgccagtaatatatgccttttaatttttggtgaaatgcaagattagaaatgttcttagagcatttagagatcaagtttgattaagggattagaatgggaaatttaggcttaggagtcatcacacttatcctatcatgttaatccccctctctccatggtcaaaaactgctgttgcctcccattgttgtcaacattacactcacagtccttattagagtggttaagaccctgtgatctgtattcattcctttaaacccacatatgcttgattctcctactcatatcctgcgatctaaccaaactagactactgctttatttccaaaaccccacacaatagccatcttggaccttttgtttattctgttgcctgtaggtggaattatccccttatccctatcagaatactatctagctttcaaggcagatttcaaatgccactttatccacgattaatttcctcttttctccaatcagatgggatcccttcctcctttgaattcacaacttaatttgttttggcatctcttattgaatctattcttaaattctgtcttgtattactggtatacaataaaacccagtctaattaattagagggactcaaaacatttttaaatgcttaaaatgttagcacacattattgggaggctgataaaataagcgtaggcaagtctgtgtagctagctggcctgtcgttcccaaggaaaggctggctgctaagatcaacccttctaaatcttggctatagtttggtgacacccactggacagggtccataaaaacttacatttcagtgggcatgattccgcctgctgtttttggctggaactgccaggacgatggtagcaatttcaggaatcttctctttggtgattcctcttttgtcagctggatccagggaatactggctgagagaagtttaggaatgcagggatactcttctgcttttccattttctaaaactcagttgcttgccatcttctgtcaaccttgccttccctcctgcatttactcaatcatcctcagaagatacgagctttaattctaatcatgtccttcccccagtattttgaggaaggagtctaggcagcacataagagccaattgccaattatttcatgccctaatttgctttactgccaaggcacctttttataggatttttgctatatatatgtattaaaggctttagcagggcaggggactatctttgtaatccatcacaatgcgtagatacactttgtgctcagtagttttagaaattagattgaagctgagactaaactttccaaggaaaagagcttacaaatggattttgttaagaagtggtaggaaaaaacagtgatgtcaaagaagcaagatgccacagttcatttgctggtgtagcaaaaacaccagacaaagttgagcaagtcatataactctgagctcaagattatcatctttaaaatgctgatattatgtctactgtatactactactgctgcaggctatttttcactcaacaaatactgttcacgtgtcagatgccaagtgctgggtgttaggaatacatcactgaaaatcacagacatggttccagctctcatgacatttccaatctaaagtagtgttgctattttatgctttaactatgaaactattaaggacatagttaacataaacattataaaaatctcccgagtcctaaagattaaaacaacctcctggggtttcagaaatgattaatttagagatatctatacttacagtccccttcattagatcccaaagataactagacacaggactgctctttaagtgtaaccggaataggcaacacttttgctatgtttctagaagcactgggcactttccttgtaatttcctcaaatacctgccttatcttcttggtctgttagctcaggctttatcagaaatacatttgtgggagtgggtgtgcacatgtgtatgttttaagccattgagactccgagagttttctttgaaattgcaaatactcttcaggggataaaacacattcagttatcatcagttgtcagtataattggtttttctgattcttttcttcatggcatctagccgagttcactgggaagccagctaataatgtgctgagtactgggccaagcaccatttctgtagttagacttacaacttgccccccttttgactctgctactctctattgtttgttatcttatcctaccaataattgcagcttttcatgtcctcatcatatttcccatacactgggccagaactggtgctagaagaatcttccctgtggttttccacccccaactgaaggttggtgtagagcacagaagtccaacaaagccaatgtaacatcacccaatgtgaactgacacattatgtgaaaaaaaagggggggagtgtgtgtatatatacacatactcacaactacatagatatagtatacatttgaagaaagtattggttcttacactttctccttttaagtatagagtgagggttcttttctccttctttgttcctccacttcgattatgtacaaactcccttaaggtattaaaggtgccctgaggagccagtgtgctcgctctctgtggtatctcaacacttaactaatcgtgcctataaagtgacgctctaagggctcacttaagaagaggagaagagggttcaggtgcctctcaggatgtaaaatgatgagttctggatgcatatttctaacagatggacacggcattaagaaagcagccacagaaggcagcaggtggagcaggcagctggaaagcgcagccacttgcaggagcacttgacattaattacacctgttggaattctcgcccaactttttgctttcaaatgtgttctcagtataatcactgtgaggcagggggaaaagaaaagcagctgagggctggaaacaggaaatggagcacttgcactgagagcaaagagaaagaggtgggccagggggacggcttttctggctcatgcccttcaattaatcacatgtccaaaataggagccacgggtgctattacttatagtggtccagatgattccatcttggggctgaagaggacaatttaaaaacaattaaacaaatgttcaaagcagtaaaagcaggagtatgcattcagtcctttagaaattaaacatgttgctctgtatctgaagagattaaatatatacatttaatgttttgtatcatctgagctcatttcaaaactttcttgggccatgtagtgattttccaaatctctgagattcttcatttatttctgcctgtacaatgggatcctagctttctctaagctgtgtcctagttatcagcacaacttgcatcttctgctactctatggctcacagtgtggctcctttcatgataaacttatatcattgcctgaagctgtgtggatgttctagtctgcttccgctattctttctctctggaatgcccctgttagccttacaaatttctgctcaccattaattgtgaactcaagggttaaatgtgtaataaagccttcagtgattgtcccaggcagacctgagccttcaccctcctcagagtcacaggacctttcccattcattttcaaagtgtggagcaccttgctgtgctgggctggcctggaccccctcctctgggccatgagctctgtgaggagagctccatttctactcttctgtagtttcctccttccccccagctcatagtcccccactttatagttctgactaaatgtgatttgaatataagttgcctttacctggaggtataggtcccaccactgaaaaataattttaacccaatctcagtatctcctgagaaaaaataagatgcggctttcaaaactatcaattgtcttcaggtttttgctcactttccagtgagacttaccctgactaccactgtattacaaaatggcaagcgccttaggtattaatgtgtgatgggatttttgctcattatggtatgaaatgatgtgaggtaaaacatatatttttataaggaataaggatggagttaaaaaggtctgttgaagtgaagtaaagaggaaatggaaataaacatgattgtgaagagatggctgcggtttaacaatgcatccagctgaagaataaatctacctctgctaataatagaggttgatttttctcaccaagatgactggcacacatttatgtagacctaaatgaagggaccgttgcactagctcagtaatgccggagccagaatctgtgtagtaagacttttttgtttttctctcatggtttcaagatgcctgccagagcttcaaatagcatgcctattttcaaaaggaatggagaagagagttgcacagagacctttaacacatttatcaggaaagcaaaagcttcaacagaatccactctggatacagttgccagtgtctagatgggcaatgccttgatgtcacttagcttcccctaggacagagtaaagaaaggaaggattttactttcccagcctctgtcctggagctgggagagaggaaaagggatttggaatgatctctgggttacccaaccagcagtgtctgccgcaaaaataactagtagataaaatgaattggccaaaataagtaaattgaaagaagacattcacttatagtggatatataagtaaaatgaataattcaatcaaaggataaaataatatgtcttaggacaaatgcataaactagatgtatgtatcaaatacataattttaaaaacaagatatgagagcagaattgtacaatattatactactcatgtcattaaaacacacaaaatactgattattaaatggatatatatatatatatgtataaatgtttaaaaacataaactggaagatacacatcaaattcagcctagtagttgccttctttgtggaagaagagggtaatagggaagaggaacaaaaggaacttcattttattttgcaaagtttcactcctgtcacaaaatcaaatggtaaggctggtatgtatatgagagtttggtgagaaaaacaactagaagaaatagtaagagtttaaatttagttctatcactgaaaataaatttaaaggagcataaaatgaaaacacagatgggattctaattgccacgaaagcctaagaaatagagacataatttaccacgggaaatagtactgaatgaggaagaagccccagaatcagcctttgactttggttctgaacttactcactttgaactttagctttctgacttgaaagatgaggatttttgtttttattttttcattgttctttagaaatatttatcgtttggctgggtgtggtggctcatgtctgtaatcctagcactttgggaggccaaggagggcagattgcctgagctcaggagtttgagaccagcctgggtaacacggtgaaaccccatttctactaaaaaaatacaaaaaattagccaggcatggtggtgcgtgcctgtaatcgcagctacttaggaggctgaggcaggagaattgcttgaacccaggaggcggaggttgctgtgagctgagatcgcgccactgcactccagcctggtcgacgaagtgaatctctgtctcaagaaaaaaaagaaaaaaagaaatatttattttttaagaatattaactattttgtaataaggcatgctttaaaacaatctttgcaatttaagtcataaactgtggtggtcctgtaaaacatcaaaattgttcatttatttgatttatatttattgaaagcttactatatgctggaagcctaggaaatagggcataaatcaatcaaaagttctagtgctaatgaaaatgatagtctgactggggccagagatagtaagtacatacttagtatataaggaagcccatgaagcaaaatgtagcaggatcagagagtactcagggccaggtgacagtggaactaatgctctagtagctagattaggtttctcttacaaggcactatttagcctagaaagaatgtaaaagtcaaatatctttcacaagtaacatttgctatgagtaatttaaattatatattatataaaatatattaatatagtaattataactgccttgtattttaatacggatttgtatgtgcttcaaggggttttgttctttctttttgcacacatactgctttttatcatagcactcccatccagacaagaagtatacattctctgctttgtagtcaatctctttgtgtcagtttggatggaaacctgactttgtgtcagtttggatggtttgattcctacacatctaatatcttgagcggatattcctggatgaataatggtaaagttatctcccttaggaaagcttgttgtccccatcatgtctgtgttacacagccattggatatacaacattggctggagtggggaaggtttgggggattttcttatcagctgtcttctgctcttagttagtgaaatctaacaagcacccagaccgataacatgtgagtttccatttgaaagtttggctcttgtttataaatattaatacggttgaaagttaatatattttgaaaaatgctttaagatgttttaaaaaaggcttttaaagtttcatattctgcaagagtctggacaagtaaaatacaattggcctttgaacaacatgggtttgaaccacacaagcttacttatgctcagatttcttctgcctctgccacccctgaaacagtaagaccaagctttccccttccccaaccattcaacatgaagatgacaaggatgaagagaggattccatttccacttaatgaatagtaaatatattttctctttcttatgcttctcttaacattgttttctctagcttactttatggtgagaatacagtacataatacatagaatacacaaaatatgtgttcatcaatggtttatgttatcagtatgacttcctgtcaacagtaggttattagtagttaagtttttggaaagccaaaagttactgtgtgaggggttggcacccataacctccatattgttcaagggtcaaccatacattatttagatttgatcaaactggatttttagtatgtttttgattttaggtcatcacagaactcaagggatttctgagacaaatagcctaatggaagattaaacgcaaactgaaaaagatcttaatttactgagaaaactggagataggaactaaggtttaaaatctgagtagctgagaagctgccacttattccagtgtctgaaacatggatatattgaaagattgaaagaaaatcttataattgaacagtgagcgtctttggatattgtgtaaaaagctctataaaagataagagcctgatgttagcttggagaaagtcccccttgccttattaatgttggtaaaactttgttactactcaaaaaatagccatcaactttaaaaccaacaaacattttcataagccactaatattgaccatgccatttagttctaccttatttattctttgacttccaggaatagattccctttcctcctctggagatcatgggattggaaattttggccaatggtagataaatacaaagttgttgtgaggtctgcatgtgtgctggaatatacatactgtggttagaaaagtgcctgatacatagtaaaaacaccatatccataaaattaatataatcaaataaaccagaaagttaatactatcaaaattaaagagtagtatattttgtaacttttatatttgctgccagattttctttgttccagttgccaaaacaaatattggctgatgaaaaacctaacttaaacattgacccaggaaaatttgggtttcatctctaagcaatcttctctgtgctgtagtgccaggcagagggctgttctctccctaatatatcattcctgctggaaaccaggaaagtctaatgtcaccattagaatttatttttttctgtcttggcttgcagattaaactatacatgtctctgaaagctaacagcttattattaacagttagagcagaggttaaagaaaacattcctaaaagaatgagaactagggtaggatttggagctatgaagtgaatttagtgagggaaagaaatggggaaagataacaggagaggaaagtgaagctcaaaggcgaggtggaaaggcatagaaccttttatagcttacatcttacttgtgtctggagcaggccctggcctgtctatatagaggagaaaaaaggttacctgttaaccaatggatgatttcagttgaagattcctagacttcacattcaagggtaaaaagcagaatgtatcaccataccaggactcgtagtttcctgctattcaaaactccaaattcatagtcctcattcctggaatactatttaggttggtgcaaaagtaactgtagttttgacattgaaagtaatggcaaaaactgcaattacttttgcaccaacctaaatcgtgtagttgtttcaccatgtatatgaatccagttattctgttagatttggggccaaaaaagatttgaagaattgctaaaggatagaacttttctgatatagctcaatgttgtgataaatacatgctctgaaaaatgaaggaaagctatttagaatagagaatttgttccaacgtaaaacaaatttaatggaaggagaattatcctaataatcgattatgaaagaaaaatactcctctggaattttgtatataatggctcaaagacacgaaacttttatattttaagaagaaagaaaagtgaaaataaaagtgctttcatataaatgatgaaaatgaatctgtaatacctgttcattcatctacagagaatgttattagatcagaatgagaacatcctaataaagaaaggaaattgaataggtaggttatgaagcattacaggatgcacaagaaacagtttgtaccctcgatagccacctgaggtgtgtgccattatactttccaaaattagtgaaattctaattcttttagaaaggatattttccattaaagattagaaaaatcaagaaataagttctttttgatgaaactttgaagttaggatagcagcaggctttatttcagttcctgccgtgtttctttttcctttagaattaaactatgtatgttccaggagaaatgattgtatcagttaaaataaaaattaccacggttcttctaagcatcctcttttagtgtatttgatagagaccatgaagttttcaagggagactgtagtctctgcacataggagtatcagattctgtgaataacaagagacaaaaacccaatgtcaaaatgtgagcctgctgtattggcacattggtttgagtgttctgcttgtgcgggcaaaaggttgaccattgaattgaagaatgtgcttttcagagtaataagttcttaccatagaaaggtcagctaacacagagggaagattatgcaactgagatcgagcgtgtcaacggggaccctcaaaagggaattgatattatggcagacattatcttctgttttctaagttctaacggaacattttaatggaactcagagaagactaaatttgttgtctgcacaactcttattaacattttgtcttgctccacagagagtgcgtcctgcagtaggtgagacatgataaagtatttccaacgcttacaataatgaaatgttagcatgcttgacctctgcagctatccatcattaaagaattaattttctggacctgaatccatttatttcctcattttagcgtatgtttggttattaaggggaagggagagtaaaactttatagatagaaggagaaaataaagttattaacctgtcttgccaacaacccattttatgtaataggggaaatgttgaactactcattagctattctttctctaaggttaaacaggtaaaataaaataacccactactaagagataacaaatgttgaataaactgggtttgaaagaaatattataattcgtttttaaagggaagaaaaatgctcaggaaattctcaatttttattttcctttttccacttgaatgtgaaaaaaattatagaattatctattttcaggtggataagaaactgcataattgaattatacaaaaactgaaggattttcatgcacaaggagaggattctgaagcactataacttaattacagatttaaaatcatttaaagaaattctttttagaaaagttacttgtctataaactatgtattggggttctccagagaaacagaactatcttaatccacttggactgctgtaacaaaatatcataaactgggtggcttataaacaacaaaaatgtattccttacatttctggagtctgggaagtccaagatcaaggcaatcgtagattgagtgtctggtgagggccaacttcctcataagtggcaccttcttgctgtgtcttcacatagcaaaagaagagagtctcttagccctttataaaggcaccaatcccattcatgagggctccacactcatgacataataacctcccaaaggccctacctcctttcaccgtaatatcaataatcaggtttcagcatgcatattttggtggggacatgatatggttaggctgtatccccacccaaatctcatcttgaattgtagctcacacaattcctacatgtcgcgggagggaccccgtgggaggtaattgaatcatgtggggatcatgggggcgggtcttttccatgctgttctgatgatggtgaataagtctcacaagatctgatggttttataagagggagttcccctgcacatgctttcttgtctgccaccatgtcccacgtgccttttgccttctaccatgattgtgaggcctccccagccacgtggaactgtgagttcattaaacctctttttctttataaattacccagtcttgggtatgtctttatcagcagcatgaaaatggattaatacaagacacaaacgtccagacaatagcaagaacatatatatatatatatgtttccatatatatgtttccatatatatgtttccatatatatgtttccatatatatatatgttcccatatatatatatgttcccatatatatatatatatatattcccatatatatatatatatatatatatatatatatatatatatatatggaaagagagagagaaagaagtatagtactggctcatgtgattgtggggactaaaaaattcaaaatcctcagcatgggctggcaggctggaaaccccagagaaccaatggtgcagtttgctagagaattccctcttgatttggaaggccagcatttttgttcaactgaaaggatgaggcccatccacataatggaggacagtctgctttatccagagttcactgatttaaatgataatctctttcaaacacaccctgcaagttaacatataaaattaactatcatgcatcatatatttacaaatggccaagaattaggatttactacctttatatgcaactgaattggaagcaaaatgttctacaaaaagaactagttaaaaataaagtgtatacagtgtacaaaattgtgaactttttactctttcatcatttcagtgtcattaccagtatatttccttctctgaagatttagaagaataggtaagaaagtggcacggataatagtaatgttcactgtccttaatgcacctgataattttatccaggtctaattttatccagttttgaacaatcaaaaaagaaatgtgggatattaatagtccgcttattgcctgggctggagtgcaatggcacaatcatggccttttgggctcaggtgatcctcccaactaagcctctggaatagctgggaccacaggcatgtgtgaccacacccagataattttcttttaattttttgtagagacagcgtctcactatgctacccaggctggtcttgaactccttaacattaacagtaatattgactttaaatcagtatactaagctctctgttagtgatttaaaaatttaaaaggtggtgtgtgcctgtatgcctagctacttgggaagctgaggcaagaggatcacttgaacacaggaatttgaggcttcagtgagctgtgatcatgctgctgcactccagcctgagcaacagagtgaaaccttgactttaaaaacaagcaaacaaaaagctacttagttcaggcttatgaggaaggtttgattaaaatgtaaagcttacattttaatcaaatggttatcaaatgattctctttgttgagaggagggctgtaactcagtagtagagttgtgagatatatctcatttaggaacaaatatgctaataggtgagaataatttccttattaattacttgtgtcttatccggagccctttctctggcagttaatttactgaatgccagagatccttgcttctgtagtcctgaacatgtttgcacttcagacattcttgggcagtcagaacaggactaataatggcttatgcagatatttttcataaatttagactgtacatcctttgcatagaataaaaattgcatcacttgtatttctctgtcttgattcatttgttctccttttatcttaactttcatggatgaaagcacgtattcatacaaaccctcaaattttacagatggacaacatgttgtagggagatttttaaagagtgtagctcatgtcttattgaggaggaagatacaaagctagatgagcatgaagaacaaatacaaaaatgtgtgcatcaagaattttgaatagtaaaattctgcttttaacttaatacttatcatgtttatgcacctttaagaaacactcctttccattactaaattttcactttattttaaaagcttaattttttggaattaaggcattttgtttgcattaaatgcttactgaataaaatcatagatttatttgtccagttgcagttggactctgttagttttctcatgttacattcagataaaaaaagtgagacgtctcagaggaatgctggactacaaagaatttgtctttcaaaggtaattaaagtataatttaaacttattgctgctgtgtgtaccactttcccttttgaattatgagtctataaagacatggaagtttgcaactttaaatcactctgcagttgtcaattaaatgtcatactttggggcagaatataaatggagtatagcctgttaacaattattaatatagtatcagtgcaaattcatacatcaaaagagtcagtgataatcctaaccacctgtgctgatacatagtgtgaaatgtacaactactctttctcgtagtctcctagtctcccagaaaaatgaatgcgttgttgaacagcttaattaaaaacaaaagaataaagtaacacaacacagagggttttaaaatttggttttaatttctgaatttcacaattgtgtgtgtgtgtgtatgggtgagtaaacacacacacacatattagacactcacatatatcttgttaaggcttattttcaactggttgacttgcttctaccatgcaaagtatattgtcaataaattcaagaattcaatatttatcaggcgaattagcttcatggttaaatagttatggactgactaccttcttaatcaaaggtgatgcttttcttttttaagtttatcacaaagcagatttatgcaactgattaggacattaccctgtagtttcggagatcattgcatttaagaaagggtttgaatgtgatctgaactgcaacccttcctaaagagatagccttagataaaacaaatataactatcatttcctagcataaattctgagcaattatgtttgtgactattgcctaatattatcaaataagaagttcatttacattcttcatctttttttgttttccaagacaaatcagaaatcaatctgatttgatctgggcaatgtgtaactcttaaaatagcttatataatttttaaagaaatattttaatgtcaatttaaaaccttggaattagaaaacaataattttaaattttgttttgtaggtcctagtaaggcagtaacattcgttattacatgattgtgctccttctcatagggcagtgggtgtgcacagcatgggtataaggatgtgcacaaacattgtgtatttctggcctatttatcttccctatttcaggactggttctaagagttcttggacatcaccagtatgctgagcaatttggacaatttcagttccattaggcattaaatgaagtcagggcccaaattccctgttaatgcaacagtttatgccatccagcatcccagagaagtatctctgtagccatttatttggttttcgatttaagaagacccgcacctgactggaacccaatacaactatcattaaaaaataaaatcccattgcccaggattgttttgttcttcatgtgtacttcatatcaagttattgtcctaattgcctcatgccttttagaaagttcagttaattcaaagagatgaattaaggaatgaagtttaagttctctgtgtctccttaaaacatttctgagctcaactctcatttgaataggtaatgaggacaagacaataaaatctgagtagagtctctagctcttgtttgtgtctaccttgtttttttctctctctctctccagttaaatgccatccaattatctcctgcaaatatctacagaattgttcgttagtcaacattatgatacaggttgattatgatattagatgattatgatattagacagtgattggtttaattagtttgtgaacatttgcatatatagagagctcttaataaattgggaatatatttgaatttgatcttcatatagacattttctaaccttggggatgcctttataattgctgttgttttctttgtgtttcattatagaagccagaattcttcttgctaataatgacatgtagataaataccttattagtgtagtaacacttccaagaggaaagcacattttctaagcatctcctgaaataaatgtcttttttgaagactggaggctctgaagctgctaatgagatatggaagggacattctgtaaaagtgacaagttattttaatcaaaaaggtcatgcatgtcagatagtattattgttttctgaagtggcttgactcagcccaagtcagtgagaattaagatttcaattatacattactaatggctgggacacagggttagtgaggtagaggtttaaaacctaagtgttgctgaaacgtcgtcttgatttactggtatcactgctaagtactctgtaaatgccagcagtttataccatgtcactaaagcccaagagtaatgtcactttagaattacaaaacagaaggcattctgtgattcaggcagcacagctaacttccaaacaagatttgaatactaaaatgaatgtcttatctttgagaagcaaaggcttttgaatgttcaagtcagatgtgtttaattatttaaaggatacttagtagatacttgttttctgtaagatttctgatcccttaactgactttcataatgttgaattgggatccaagaagaatggaataagagagagatcttgggattaagtgggggtgttctatgctttttttcacttatcctttttttttttttgagatggagtcttgctctgttgccaggctggagtgcagtggtgcgatctctgctcactgcaacctccacctcccaggttcaagctattcccctgcctcagcctcccgagtaggtaggactacaggcacgcaccaccatgcccggctattttttgtattttagtagagacggggtttcaccatgttggccaggatggtctcaatctcctgaccttgtgatttgcccacctcggcctctcaaaatgctgggattgcaggcgtgagccaccacgcccaggcctcagttatctttttggcttgcttattcttcttttcatatctctgtccatacaaggagtagttgctacatgaagagggtactgtctttgaaggtaaagaaagctttttcatgtgagtctgataataggtatgcatatactttaatttatgtaaatagtttaaccagtgctggaaaaaaaaagcatcatacctccaatggaatagttctgattattcagagaacctttcagacgaggaaaaacagaacattttccagggagttcttgtacatctgcatgccccacggtgctaaattttggctttgcatagatcccctgtgaatgcagaccttcccattagccactctctgtttccagtcgctttcattccatcacatatgaagatcaagcttaatgttctcaaagagggagagcaagaccaagcacaccctgcagaatggcctgtggagtttcagctcttgatagacttgtctgcgacaatttggtccatgctgcttcaaatggcaggaagagtaacatcacaggagggtaaaatattttccaaatctgatttaatgataagacactgagtgttgagagagcaccgaattcaatgaagaaggttaagtgcaaaacaccatgattttcttgagatgtgagtgtgttgagggagggggatggagagggagagcaggcaaagggagcagaagctggagaggggaggttgacgggatccagatcagcatatcttactaggttagtatttaatgaactggccagtatcagagtgatttggaggtgccaattaaaatgtgaggagcactgcaattttgtgtccagggttaagttaaaactatgtaatctttttataagcttgaaacattttctgtaggttaagtctagcaaaaatattaatgccatgtaacctaacttttttttcatagaaaaaatgtccagatttctttccaccaagaagcctgatatttgtagagttgttgttgttgactctgatctggatgctggagatgaaaagatacatgcgaggcagacccatgtcaaccttcagaggagccatattctagggatttcttgacagtgtgcttgtactaatattgtatttattgctttcaaactaaaatgaatactataatagacttaacacaattgtgaagacacgcaaagagggcaaggcttcttaattctgaaagtgtcaaagaaggatttattataaagaaaggtgactttaggttagatgttaaggagagatttaactgcatagggcttagatgaggaggaattggttatgatatttcagtttttgaacacagaatgaagaaaggtgacaaggatacccatttcattatattgtgcctttgtgtgattttagtgcatatgagagtaggaaaaggattgggtttgagcttccagaagatggaaacataaaaccgtaccaagtgtaggattttaagggcctaagttaaggagtttaaacaatatttataaataatgagaggcattaaatatattttttaattagaggtgactgttactgcaaaaaaaggatactctacaagaaatataaatttgatagcaagataacaattttgagatgagaatgaatagtgaacaggtggcaaaagacaagttaaaaggatattgcaataatctaataaacagaagtgtttgtccaagggttatcaatatgagatgcaaaagaaacaatgaagttgggcctcaattcaacctcacaattgaaagacactccctccttcccattttccccttctctctccattccctattccttccttctttcctccattctttccttaccacccccacccccgcccccaacctttttcctttacatgttattcagtgcctgctatgtgctaggctgtgggagtgaggaagagagtggatcaaaggtaatgccagaaggtctagcttggcagagtagtagggctattaactatgacagggaacattttaggaaaggagcagttttgcagcaaggaataaaatgactttgaatttggacaaattgatttggaaatacctgtgggactttcttattgagatgtccagcaaagagctgaaagagctctctgacattactgcagctgagtctggaacaaacaggctgcctggtgagcagtgtattcctatcactaggaggggataagactcggtcagatggccttgggtcagatgtgttagatggaactctgatgagggattattagcactcttgaaccaaacaggatacagtgcccttccagccatacaattctatgtctgcagacatctgtgcaagagaaacagagggagagagctagaaagagacttatgtttttcatctgtaaccacaactattaacataagcattaatatatctgttgacattttccatattaccatttttagcttcttaacctgtaaagtaaatgatgggtggactactaaggattgtctaatacccactatttccacactacccccccacctcttgtctgattatcaaatattcatggtatttgctgcaacttaaatattatttgatactttctgttctcaaccaagttatggtatatatatatattttttttttctagtaataatattaagtgtttagaatattctcttataaattaaactcaggaaattttatgcagttgttcttcatggttttattctatttttataaatttgctgctagtaagaaataaaggcaagctaatgttttatcacaaactctccattatttatttattttttttgagatggagatttcctcttgttgcccaggctagagtacaatggcacaatctcggctcactgcaacatccacctcccaggttcaagcggttctcctgcctcagcctcccgagtagctggggttacaggcatgtgccaccacacccggctaattttgtatttttagtagagacagagtttcaccatgttggtcagtctggtctcaaactcttgacctcaggtgatccgcccatctcagcctcccaaagttctgggattacaggcgtgagtcaccgcgcccggccagactctccattctttaaagtgaaggcttagttcaaattattattaaaattgctgttgttactattcttaattttttagttcctgattttttttattaatagcagtaagtatactcaatttttgcatatacttttatggatatccaaggctttgaaaaatgtgtgaaatggaaggctatttataacttcaacacatgtataagtacaacttacatatgattctaaaatgtagcactgaccaatactgtaatatcagtaatatcaaaacagtatattactgttttaccaatacagtaatatactgtaatatcaaaaagaaaaaagatatagaacctaccttcttattttcatttgtatgtgtacttctgaaactgcctcctacatatgaaaattgatcatacctcttgtgagctttttctctgtattaagttcatgataagcaatgtaaatcctcagaaaagatgttaccaccgtttagttatcttttatcaactcaatagatgagttaagatttaaaacatttgcctagggaagtattttgcactggtcaattctcacagttttgtgagatgaatcactttggtcattatcaaatgatacatagcagttgagacatgtattgattaaggtaaatataaatgactttttataataaataaaagaaatataagatttaacattcaataagcaaaattatgacataaaaattaaaataacacttcagatggaagcatacactggaaaataatttggagaaaatctggcaaaatgtgttaaatttataattttaaatcctctgatttagtgaccccatctgaaggactctaagcaaataaacgtacaggtgagcaatgatgtatgtacaaggttcttgattgagcataaattctactggtaaaaaattgtatcaggccaagagcggtggctcacccctgtaataccagcactttgggaggctgaggaggggtgggtcacctgaggtcaggagtttgagaccagctggccaacatgatgaaaccccgtttctactaaaaacacgtaaaattagttgggcgtggtggtgggtgcctgtaatcccagctactcgggaggctgaggcaggagaattgcttaaacctgggaggcagaggttgcagtgagccaagatcacaccattacactccagcctgggcaacaagagcaaaactttgtatcaaaataattgtttaatacagtagagtacaaacaaacaaacaaaaatcaattctataaagttaaggaacaagatgggtctacatgtactgtcctggaaagacacatgacatgctgttgagtgaagataaacacaatatatatgcaattctgtttataaatatatgcattcaaagtctgaaaagattcacagatacacaccactctattagcattctttcatccagtaagtactaagtgagtcccaattattcactaggcacacaacatagtggcaaagagacctatgaaacagctaaaatatattgtgacggcttatggtatgtttggtttcaattgagggtgcaagagttgcatatgggcaggaaaatcctagcctagacttcttggaagacatttctgagaaatcgatgttttcactgaaactagaaagagaaggaatacttaaccagggaaaaatgatttaatgtagaaaagcagagacaacagcatctaaaaaagcctagaagcaggaaagagatgtaatgtattcaagaactgaaaaagttaggtatgactggatagtgtgtaagaggggatattgttatctttgggactgggattatacttgcaaatttacttacaattttataaatttctctttttgttaatgaagatattcctattaacatgaaaataatttaaaaactagctaaaattctaacaaagaaaaaataaggaaacactttaaacatgctacagaaaaataataagaaaagacaaaaggggctagaattataaagttgaagtctaatacaacagagtagcattatatattgagccaaattgaaagagacaaatacagtgattttagaaaatgaagatacttcttttatataggctatttaaggagcattaaataaagcagtagtgcacatcttttaaaattagactgctatcgtagaagggcccacaggaatatttgtaccaatacagctgtaaaacacttatcagactttttcagctatttttcttttgcctcagttgcccaggtatatatactggggcaaaaagcaagatctggtaaatgactgttggtgtttttctttcctgtttattacagtgtagttaataatctttgcaattccttccaaaggtatgagccgactctgtatctgtggttctccaccttggctctatgttacactcaacttgggagattttttaaaaaatttatgctcaggccccacttcaggccaattagattattaccgctggcattaggacccaggcattaaatattttcatattcccaggtaattcccattcacatctaagactgaaaaacatcactgctctaggaaggtttagcctatttaacaccttcaatgtataagtcaagttgcctagcagaaaaatcaggtacggtttcactcaaatggatgactccaaagatttgagtcaagaactcagaatgagagatctcattcatggactggtttggtgttgaggttgcctgggtgtttgaagagtgttatgtgctgaatgaagatggaatccttggtgtgggtacactttagcgatatataggaggactataacgtgaatatcttaaacacattgaagttgaccttaaattcatacggctctcagttttctcatgagtgagatgagaatgtaactaccacattacgaagttgtgaaagttaaatgaggtgatatttatataagaaatgtgcacagtatacttcactcatagttcaaaagcttcaaaaataagaaatagagaagtaagagatgagtctctttcatatctaatttgagtattagacatttgagtattatagcttcagttttggtttccacattagttatttttttaaggtgggttttctttcacagtagaaagccaaaaatgttagatagaaaaagtatgtattgtcttgaaaaggtgaacagttggacattacgttttgaaggtattgaaatttttctaatgatctgtttttggaatgtgtatgtattggatttatcttgctgtatcataagctaccacaaatttagtgtcttcaaatacctgtttattaggttgcagttttgtaggtaagaagcttgggccgatgtgggaggtttttctgctcagtgtcttacaagtctgaaatcaaggcatttgctgagctacattattatctggaactcaagggcctcttctgagctcatgtgattgtagcagaattcagtgccttgcatttgtaagtctaaggttctcctttccttcctggctgttagttggagctgatgtcagcttttagaaacaacctgaattccttgccatgtggctcctccatcttcacagccagtgacagagaatttcccacactttgaatcaatctcccactctccccctcccccttcttctctcatattagataagcaccaccgaagataattctgttatcttttagagccagccatatcacagaacttaatcatgggagcactggcccatcatattcataggtgtctttcacgccaagtatggagatgattatacaaaggtgtgggtcattgggatgatcttagaattctgactactccagtatatgagacaggtgaatggactatatgtcagatgttactgggattttaaagcaaggaatgagaagactattactgcctcacgttttatatgcatttcttttcatttgatatgatgtttaaaattattgattggagatgggagatcagctgtgattgattccctacaggaaatatagaaaaaaagtatagaaagatatcaataaggaatgtaaaccttttgcatatgacttttgtgtctgggaaagacaatgtactcttattttctcccttttttattcttaataagtaaattttctcatacaatttaatttcattacaaatacatgccaaagacatgaacaaaaataagtcttcataaaggaaggacattccacaaataaaaattggcacacgtttattgtttttatggggattgggggaagttgtgttgttccacagaagaggccaacagcagcttgttggtactctcagatacggtgagtgcagtagtttccgtcagttccacagatttaccacggaacaaggaacgacccaggaataaggaatgccccagcttgcagcctcttaaagctgtaaaactactcagcacttgcttctggtagttgactgctatcttaataattccctgtacctcttaaagacatgatagtgttcatagccaggaaatgtttaggtttgatctacttttctatttgtcagaacccaatgaaggaaatcaatctatttgtttttcaagcataaatggatgaattcttggttgttgctaataatacagtgtcttatttggctaataccattttgtttagaaaataaaagaaatcataacattctttttaaggtcctttagtagtttgtagtaaaactgaattagttgctgtagatatttgaaccttaagagtgtgtgtgtgtgtgtgtgtgtgtgtgtgtgtatgtgagtgtgtatttgctgctgatgatcaatcagaagatccttaggagaagatcttttgtttaaaggtgtttaatttcgatctattctgtgctctgttatacttattactatacttttaggagaattgaacacatataaatgtaatataaaagggccattatgctactgtgtagtggattttaaactggagcgtgaatatccctggggttatgtgaggatgttccattggcatatgaactcagagctttgaggatacaataaaacaataatttgtttggctaattgacaaatcgaatggctctgataactgggtaacagatccattttcaaatcaggtggtttacaattctctactttaagcaaaatttcagagaggcctaattgagttgtcagccaatatatgattaaaataatttttgatggaaaatcattgacttttggcatataattgagaagtagttcaaggacttgagcgacattgttataatggaaagagtttcttccatttccatctatttatttgtgtgaacaaagaaccttaacagttatagcaataaaaacaataaacagaactcttgctgggtcttttctccttttaacagcaagtattagtcatccatagcatgtataaaataaatgggaaaaagccatttcattaagagattcatttctgatcattgcaatctttgtctaataattacttgtcacagttttaagtttttgctttgataattatgctcttttaataattttaatggtaactcaacccaaaagaaattttttttacacctagagttatatggtcacagggaattttttttaaaaccatctttagatacaattccttgttgcagagaaatatgatcaatacaaagactttcaagcataaaatttattatgtaggataaaaatcagtggggatagaaatatgagttcaaaaagaaatatgacttaagtaaaatttccagcaataaataagatcttgttcatggaatgtattagttcattctcacacagctatgaagaagtacttgagactgggtaatttttaaaggaaagagatttaattgactcacagttctgcatggctagggaggcctcaggaaacttacaatcatggagggaaggcaaataataagcaggtactttcttcacagaatggcaggatggagtgagtgcaagcaggataaatgccagacactatttataaaaccatcggatcttgtgagactcactcactatcatgagaacagcatgggggaaaccacccccgtgatccagttacctctacctggtcccaccctcgacacgtggggattataaggattatggggattacaattcaagatgagattttgggtggggacccagcaaaacgtgtagtttgtgctagtattttaattagtctggattctttaaaagaattatgtaccagttttattctaaaatatccatatttttagtatgctacaacttatattctttgctatttacacttaccaggaaaataaattgttgacctcaaaatgttttagaggtacatggttttataaaaccagattaggaggttacattacgttgtaagactagtgctgttgtggaaaggactatccacgaaaccactggcttttcctatgttgcaataaggggtttggtttaggggctaaggacccagctggctctgacactgacagtggttcaccttcctctgaacttctatggctctcattaatcatctgaaacatttgacactttgcatatgtctggtggtgctgttgatttggaatctaaaccataaccactacttagtagttgaaaagttaagaatttacccccattgttgatactctaattttcatgtaatcagaaatgttacctttgcgataaggagttcctgtactgctctctctgccccatattttctagtgtgaccagtttgtcaccaaaggttgggtcatatagatttttgccacaatttgagcaagctcctattacatcattaagagtatgtcacagttagtttcaatgaaataattagccaattggatttcaaatagtaaaataacacattttattatatgtaaataccttatcttccaaaggcataaatttaaggtaatgataattgatatccagaatgcttctgtgtacatacatgttatatgtttcaattactaagtcaaaatatgtggtagaaatagtaaggaacgcagagtttcttttcttcttaaggaaataaaaagattgacttgagccaatttttatctgaggaatgttaatttgttttatttaatgcagcttaaaactctacaattaccctttctatgaacagatacttaatgagtacataaacacttggttcctgtatttcctgaaatgttccacactttagagctggttctgctgatgaaagttgaagtcatgggcaggcatgagatggggtaggcaaagagtatactgtgaaaagagaaatgagggcctctgatattaaatattgcccagggagaggaaaaaaagtttggaaggatcctgagtaggacaattataaaagagaacctggagcttgcggggagttcaaagcaacagcaagagtctgtgccatgtaatacttagcaatttagtaaagtaaggaatcaaaaatgcccactggaattttaatataaaatatttttggctgggcacggtggctcatgcctgtaatcccagcactttgggaggcctaggtgggtggataacaaggtcaggagatggagaccatcctggctaacacggtgaaaccacatctcaactaaaaatacaaaaaattagccaggcatggtggtgggcgcctgtagtcccagctactcaggaggctgaggcaggtgaatggtgtgaacccaggaggcggagcttgcagtgagctgagatcgcaccactgcactccacagcctgggcgacatagcgagactctgtctcaaatgtgtgtgtgtgtatatatatacatatatatattttaaggacattaaaaaaatcaagggagaggaaaaagtctcattttcttctataggttggctaggttaaaaaaaaagtttcagggtggtcttttgtagtcagttttgttcttatatgtgatatttctagtgagaaagcaataacaaaaacaacaaagaaactaaatttttttgaatggtaactagtatgagcagtatctttctgggctggcagtggaggctgtagaggcatggaaggcaggatagtagggaaccatttgctttggtttccttctcgcttcaaccaggagagagaatgatgttcaagagagagaaaggaaaacatagcttccatggcaaaagaattacacttgcattcctttgataactggaggaaagaggaaggaatggataaaggtctaggcagtattgtgtggctggaagtttgctgtaatgtctaatgaagtaaaaggaaattttgctgaaaatgaaggtggtggtggtggtccatgatatcagaagttaaatacaatagagaattttgaaaaacaaacaaacaaacaaacgaaacggaatatttcagggttgctagaatgaatggatgaaagtattaaagtgtaaaattgagtcctcttgaaggcgaaggtaaagtaacataaaggaatatactaacatccaatcaaattagaataacaaatatttactgagttaagacattattgaatgtgatgaatttgaagggacaagatataaacctataaaaaggtacataacagaaatcacattaattgcttctataaagctggctgactaggaagtgtttaatgcaaactggaactggagaaaccaaagctgggatgatccaatcggagtaattcaatggccaactaaaatggcctttattagtgggagttaagtggagttacttccagatactttcactgtcccttgtttctgcgttgttcccttgtggtacccactaaaatccgtttacttttacctgcctctaaaaatagctatatgtcaaaactactaaaggcccataaacttagtcatattatcatagtttgaagcccaggtctaccacttaccagttctgagaacctggacaaattgtataaaccctctaaacctttttattcctatctggtaaaacaatgaaaatgataacctatgtcatgggtgttgtgaggattaaatagactaaactatataacaaccttagcatactctatggcatataaaaacctactcgatagttgtaccatgttattgttattaactttcttaatagaattcttaaggcaaaagggtattgacatatctctgtctacatcatttattgtcattgttataagtgctagttagtctaattcatttcattataattagtaagtggtaatatagctggagaatgaaactcattttgatccttataagggaatcaaaatgatatcagcttttcatttcagcagcctgattatcattagatgaacatcaatatcaatttataaaatttacaattttataaaacatgttatagttaattttttgtttgtttagatgttgaaaaggacactttcttttcaggtctcaagatacatatgggcataagccataaaatctatatttaattgacatcccatttccttctttaccatctttgaaataaaacatttaaaggttgactctggctgtgtacagtatcaataccgtggaatcagtgagagcccaatagttagttattttgacaatcagtgtttctagggtgatccatatccagtgtgcattctcctcagggttacattgcttataaattttatttatggttcatataaagttttatgttccagtatttttccaaagaacatcttttatgtccatgtgccttccctcagttatactgataactgtccattttgtattaagaatcacactggaagtagcttttatgatatttctgaattatgaaagaattccattccatttccaatagaaccatgctacaactaaaatatatcatggctgtgctgtaagctaattgtaataaaaaccataatttgggcgaccttctgtagcattgtaatggcttctgaaactcactttgtcttggtcaagtgaagatttcaggtatagagccagattgaccacagccatcactgcttcttccccagagagaactcagattattggaaagttttctactgagagtagaatactcttgtccttgggcaatagtagctcagaatttagttattctgcccacaggcctccctaaaatgaatctcagtttggagaaaagagagaaacaaagaaactaggatttttttttttttttttagattctgagatagcatccaccaacctgctacgcttactctggggaccttgaacggtgcatagaaaggctgttttgtttttgtttgttttataaatcaatttatttttgaacttcctcaaatatttacaactgtgggtggaaggaaataattttccctctcaattctgccttggagaggacacatttctgtgccctttccagcccaaaaggaagagtaggattagaaagtctgatgtagacaggatttaccactttatcataggtcatgtgcagctgctccgtaagcaaatagtaaggctctcaggactttttccctgggagttagaagtctctccccttcttcaagtgagaaaagcataatctagtagttacagtaactggtgcccttgcatatgcttctccaccccctccaataagcttcacccaagtcagctccaggtggctttcctcttcctcatagtatctgcctgtatttaaacagcaaggtttttttaattcattaaagtttgatttactgttaaacgtattaaatgtgatatccctccatacatattacaaatgcacgtcttttataaacctgtatgtgtttttatgtcgattgttattatatgaataatttaaaagcagtgaattgcagtagtcctctttggcatcataacaacatcccaggaaactttgtgctctgctgttaccttgtattatggcatatatgagggggagctcaatgttctgtccactttttgaggtgaaaatcaaacataatgaaagactaacttggtaaagcaacgttaaattctgagttttagctctctaaaggaaaagcataaggtgagggaagggaatttggttagttctattgacatttgatgactgtttaccatgggccaggctctgccagcagggttgggaactcacaggagagaaacacgagaattgcatcctcaggacattacaatatactgggggagatgaattcaaaagattttgataaatgacagatataggcattatagacatcaaggatgaggacgagccttgttggtgacaaaaggtgacaaggcagttctaggaaaaatataccaaaaacgagagagaatagtaacagaggacctggcctttacagacagatggaatccctttttcatggttgaaccatgagataaacttgcacatgctttaagtaaaagtaggaaaaagcaaagttaacatttcttgcttacctaagggatttctagtagaataatgtatataaggcaccaacctggttatgtggagttgctcaaaaaagagtaaattctctttcatccacttgcactggcctcttactagacaactcactattttaaagatgagacaatttaaatgtggtcagaaattaaggtgtagtcagatgaattggtctttttaaaatatgaagtcagctccatcaggtaaaagtccaaaataactttctttgctgtaaaataaaggtgttaaaacattggtaacatttttgtaaatttcagaaagattttgtttgtaaatctcttttgagaattttcttggctagatgctgtaatagttactaaatatttcacaagttcactatgaaagagaagttgaaagcctccaacagaacgaactgactgaaatattatgtctgtcattcattattattattactgtcattgttattattttaacaaagcattaataaaatttatggttagaggcaagtaccacccatactcaaataaatttattttgatttttcaacaaattggtttgcaatcttgatagatgggaatgtttcatttttattacaatcctcatgaatcacagtaaaatctaggtatgaagtctaaaagcttgtatcttgacaacatttaacacaaaggaagggtatttgagaaaggaaaacagtaatgttaatataaagatgctttttattaaaaagtcagttatttttaatccttccttgctttcttcttcctttccttttctcctacattgccttgtgtttctttttactgagtgatggaataaatgtcaggtctattaatgagggtaaatagtaaagcttttaaaagattatttattttagtaagggtctcacaatttgctcattaatgttgtctgcagcccaccattcccaaaacatttcaaatactataaataatatgtgattgtactcccaaataactaggttattgtccaatcaagaaaatagtttccttgatagttggaaattgaaagttagctaccaagcttgtgataagtcatattcatattaaaaactacaaaaaggagctcatgatggcaaattttacattctaacttcaatactgaaagtttgagaataacattttattaaagaatttcaaattaactagtaaaatagtatttaatacataatctttaccatatttcagtgataatgcctttgccttatttatattttggacatctgaacatactttattcttgttgacataatagattgtttctctttaaatctaaattccttgattatttgttgaaataagcacatgtggaaaatgttttttagaatgtgtatcttgaaactttttcttcttaaaagaagaaaacttactctaagggacactttgaattttgtttcagcatatgtctgcttaatttgacagataattttaccgtgctaaaatggtaaaatgcaattgaacattttttttgaatggaaaaataacattttagttgtgaatactttttgatatcatcatttgaaagagttgtttagaaaaatagacctgtatgttgttccaaattatagattttgtccttaaaataatattggcaatttgatataattgagctatgtatatcttatgtgtaacaactttcagcacacaacaactattttgtcaaccatgtcagtagatctagtacaacgtgtgatcagaagataaaggtgttaagaaatttgaatacatttctatttattttaggctgatatgtttttaataactctagcttcatagatatcttgcattaaatacaatctgtttcaagcaatttctcttgcaatattctggtgactgttctctataaacatggccaactagcctataaaacatgttttatttaattcattgctacccgtttatggctgcaccatgtggtaggaatccagaagcatcaggtctactgttcttataacgttcaagtggcctccaggtgataggcacagccagctgtcttggaccagtgccaactcacaatggtcttatcaaccagcaacacttaggaaatcactgagacagccaacagtcatttgtggaacaagaaaggacgtggcagtttggctattttttaaatttttccatctgaagcaggaattatcactaactggagtttattcttttttttttttttttttttttttgagacagagtctcgctctgttgcccaggctggagtgcagtggcgtgatcttggctcactgcaagctccgccttccaggttcacaccattctcctgcctcagcctcccgagtggctgggactacaggcgcctgccaccacgcccggctaattttttgtatttttagtagaggcagggtttcaccgtgttagccaggatggtctcgatcttctgacctcgtgatcctcccgcctcggcctcccaaagtgctgggattacaggtgtgagccaccgtgcctggccaagtttattgttatttgttaaaagaatgtttgctttttggtgtcttcaggtattttcaaatagaatgaataaaaccattgtgtgctggtctcctagtccttcatctcatttccctccatactccatgactcaattagtttctggggttgggattaagtgcaccttatgctaattagaactataggttttactccttaaataactcccattggcctagctttgattctttaatgtaacaaagatagatgtgggaaaaaagtgacctatcaaaatatataactcagaaagctttttgggataaacatatttaatacaggatttctcagttatatattctttttttacttagataaaacccccaagggaaaaataggtatctaatgatatatcctccattcaaaactgtgtattgctattgagaagttttatgtactattttaaataataattattaataaacatatacaagcaatgccaaataataaaaaatgtctgtctttttcctgtggagatactcagctcatgccaatttggttccctaaacaactagaactggagaaagctgtgctgtgacgtttgaaatcgaaaacctgaaaaatgtaagcttcttatcaacttccaaatttggggcaaatctggatcctaaaatcaagacatctttcgtaagattagtatccaacaagacaagaatattggctattgtgaagaatgctgctgtgaacaggggagtactactataatcttgtcttattatgattcacaatagtcaagatatggaaacaccctaactgtccattgacagataaatggataaagaaattgttgtttctctctctctctctgtgtgtgtgtgtgtgtgtgtgtgtgtgtgtgtggaaaatatatatatatagggtgatggtatatacatatatatatatatatatatggtgatggtatcaaaaagataaaatgactgctctacaattattctcattttgaatttcattttaatttacagttttcaaaactaaatgccacctgtcttttgacactgttttcattattgaaggttttatagctttaattttatattaataaaattaattatgtaaacatttgcttgcttttaggagcaaagcataggctactaaagtaaatagttcattaatttttatgtcagtcttggtgctatttacatgcatagaaatgaaactaaacgaccccagggaacttacagagggttggtttcaaatccatgaattaatgcaaatggtaaggttacatcatttgggtataaggtgtatgctttggagaatggaaaataagcaatcaaggtaaagtagccctagtgcctacattattcatgaaaatgagatcctgacattatattctaaggtgatgttgtagaagatagagctaactatttgtgcaggtacactataaggtcagtgtgtgtctggggtcagcttgccatgtgggcagaaaaactcttctgctgcatctttatttagaggaaatccacagagctttcacttggcctactgtattgctaatgtttattgccaccgtaactgaaattcctacaagttgagagcaattgtatttcatccattttaagctctcatcagttaaaatatgcattatatttattttacctctaagaaaagtacttctgatttaagtataacttttcacaaacttaagttttatcctgattttaataatgctaaaatgtgaaaaataaaaagccaccttaaagttgttgaaatatagtactgcttttattttattaagagtgctgctggcttggaggtaaagcttaaatattatttttggaaggctgtttcaggttgacacagacatttcctgcggggaatgagaggtcagagactatatccctcccattagcacattagagagagaaatgtcagaatattagacttaatttggcagggtccttgggatttctgcctctgtttctttgtcttcctatatttagttgctgtcaatgagttttggtatgtacaaatagatttaagaacatacatcagtgtctcatatattcattattattttgttaatatagtatttctttaattctaaatttatttaaattaagcagtgaatttgaaaccaaccccctataattcttgtagattgctgtactaaaatgtatttctagaaacctggttatcaaacaaaacaaccaaatactctgttcttaacatttcatcgtcttccaaaacgacactttcttagcaacttcaaagtggcaactgatggtttggtaacgatataataacaaggaataactcctatattcttaagagactcagaatttcaattcttaccacatatacatctattttcttaattaaaacaaaaagtcccagataaagtgtaatgcccagaacttgaattttaatgaatgcaaatgagcccaaagtgagaataatcagctgaagttctaggatggaatatttgtcttgtatttaccttggaagccactagcttttactcaactataaaagaagcctcaggagtgaatataaaaagaaaaaaaaattatagtaagagtttgagaactaaccaatatacttcattaatacattgaattttagtgtgaggaacaatataaatttcatgaagccggatgaaaaaagaagagatccttgttatctcttctgccttttattttaactctgtggataattttttccctatacgtctagaaacctgggttcttaaattatctccaaaaatatactctgtagggtttatagcctttaaatgtaagggtagctagagagcatgttactctcactaggtaatggggtacatctttttaacagaaacatccttgaattgctaacacatatcttccactctggtagactaaattctgttattttctgttgtttgttgagaagatagttcaaaatcacaccaaaaaaggcagtgccattattgtaagtgtcattggcatagatgtttttaatctcactgtagcgtgattctttggttaattgtctctctgctgcactagtctgtaaaagcagtacgtgtaaaagcttgttcaccattgacgtgaatggtagatcaccaacactcaccacaaagcttgacacatattacattatattaaaatattgaaatatcctgtgacttgacctcagtggaattggaatgtgaaaaaccatcttttcagaaagttgtagaaaaccaaatttggggtaccatccaatggtgctgagaaactgactttataatctgtttttatttttttgcttttggagtgactttagtttgtaaactttttttttttggctctttaaagggaatagcttttgaatgttagattagaaatcagactatgtacagagctattcagctctgaaaactgtgataacttgctaaagctatgtttacaaggagaaagtaaaaaacaacatgaatgattttatagtatatgtgggctggtaaggacaattatagaacatttcagttatccagaactataaagatttaacttctaattttcatataaataatttcaaaaatagcaaagaggaaaaagtaacattgtttaaaattgatatctgtctgcataacagagtatcatacaccacatttcatttacatagacctctggtttttaaaaaaatcataatgaatcatgtgtttcctaaaatactccattaatgttacaactaaataaataaatgtagacataggagtgactactattaggaagtgaaagaaaatttatttaggtgccaaattgacagttttttaaataattgttttgtttagaaaggtcacataacataaaaacaagtggattctataagaaatcaattactattcagtgtttatacaactttttaaatagaaaaagaagttctcttagttctaaatatatatatatatatatatatatatatatatgcaagcataaatgtgcattgcacaagagggttagttactcaaaggaggaacattatttgccatgcgttaattatcataattttgccatttccacattgaatcataatcattgttaatttaaatacaatggtatgtaacttattcattcaacaaacatttattcaatcccaggaatgcactagagtgctatacaacagtgatacagagacgaattcatatgctgaagcaaattctagttgaaaaaggaaatatcttcatatttggctttcaataaaaatgttaatatattaaaattataaccaagttctattgatatttctcctgcattccacctctgataataaataaactcatccttcgggcactctctgagttggatgctcccggtatatctaatgcctggatattatcagacattctcagataatacgtggttggggatagagggaaaacattaaaaatggtaataatataaggtagcatatgttaagagtgaaatgaatggttaatgaataaatagagaaaaccttattctgggtgctgaatcactgaggaaattacaaagaactaagtcctcatgctttttgctttttaaaatttgttttcctatctgtccctttttttttcccccttaccaatctcctacttcattttctttctgagttatttcaaatgtctccttgggtattatcctgaccagtaatccaccctgcatattatcaccaaatgagtcattcatagactgctttggccatagactatgatctccaccttctttactctatttaaggtagttggaaacctggcctggcgatggcactcattctcatttaacttgctccattcaaaagaaagtgctaactttcttttacgcctttattgcaaaaaagaatgagagaaaagagtaatcttgaaaaatataatttagtgagaaagagctgacaacccttgcagtattatactgtacttgaattcacaaacgctgagcatgtgctttgcatggtttataaatagactttggcaagctttgaactgcccacactgtgttctgagctttgagcaaagctctgctggcatgctgaaccaacttaagttctaatgtgagttataaaaacacaaggatgactggctccatttggagcattgtgttagccaagcaggtaaaataaattcatggttagacctcccctcccacggcatccctttcattcctcagaagataattctgatatctcttcttaaccagagcagacaatgcaactattcctctttacagatacgatgttttataagttaaaagaacaaaatgaacaaaaagaacacaacattcattttattgttagtcatctaccagaaagtggtaacattggggatggagataaaaatctggagtcacattttcatagacttacacattagtgacattgtttagacacttaccatgtgcattattttttctaaaaagcattcctggtaatgtgggaccatcttacatattttaatattaggtaccatactctttccatggctatatatgcatacagatcgttaaactcaacatgaaagaacccatatttcacctctgatggtaccatcatcttttaccatttcatgtcctcatctttggtaatgccaaacttgttcagaacttgttgatggaatgcaaattcttcaccaaatgcttttgaatggagtgcctaatatgtgtctggtactgttttaccaactggatgttttaattctgggggcattaataagacatggaattttgtacacataatacagagctggtatggcaaagtgagtgggagtgacctaaaatgtaacatataaggccaagccaatgaggttttgggggaacagagttgcctgtaaccactgcctgttgacatcagagctacagaggggaggaagacagtgaacaaagggcactgcattctcagggcagcaaaacagctgcaggggctcaagatggggcagcagggatctcaacaggtgaatggaggtctgcaatgggaaatacagagtacatgcttaaatatcagtggcgcaaggatcagtatcaggccagattgccagactttaaagacagaatgcagacactagactagaaattgacataggaaattataatactgactagagctaaaagtgcacaaagagaacatttggatttttgtgtgcatgttccataatttgtctggactaaaatatcgagctaattccaaagcaagtaatagcatgtgctaattattttcttagtcactaactttattgaatgaatgattttccaaacttggatatgaaccacttttaatatcttgggaaaaagtatctgaatgctattctgatctcaagtctggttttagggtttattgtagtagccatttagataaaatatctgtggtacggttcatttggattaagaacacatcagaatcagatcctttcattcaaaaatatttgtttacaggatagatcttcagtaaagagaatgcagcctgaatcattcaaatatatttatgagaaagaatataacttacctgagtaattcctggccagtcataaaatgctgaggagagaagttcagaagaaaagagggagggtggggaaggaagagggaagccagacaggaaaggggagaggaaatgaaataactgaaaccgatcaactgctttgtttcaaaggtgaacttaaagattaaaaaaattttcagtttgctgagaatgatggtttccagtttcatccaaccatcattctcagcaaactatcacaaagacagaaaaccaaacactgcatgttctccctcatagatgggaattgaacaatgagaacacttggacacagggtggggaacatcacacaccggggcctgtcaggtggtggggggatgggggaggtatagcattaggagaaatacctaaggtaaatgatgagttaatgggtgcaacaaaccaacatggcacatgtatacctatgtatcaaacctgcacgttgtgcacatgtaccctagaacttaaggtgtaattaaaaaaaaaaaagtaataataacaacaaaaaaagaaagtaaaaaaaaaaaaagaatcttcaggtaaaagaaaggaaaacctggctgggtgcagtgacacatgtctgtaatcccagtactttgggaggcagaggcaggtgactcacttgagttcaggagtttgagaccagcttggtcaagatagtgaaaccctgtctttactaaaaatacaaaaattagccacacgtggtggtgcacacctgtaatcccagctacttgggaggctgaggtgggagaatcacttgaatctgggaggtggaggttgcagtgagccgagatctcgccattgtactccagcctgagcaacagagtgagactccatctcaaaaaacaaaacaaaacgaaacaaaacagaaaggaaaaccctatcatttccaattcttatgtaattcaaacagatgaattcttccctacttttttgttaatattgttcctaaaaatgtttgcaatgactcttgcaaatatttgcatataccccaaacatactactgtaaattaatttttagaaccagttaatacatttctctctgtttaaatatatacttatatgtgtatcatataatatatatgtatgccatatgccatattatagtctcttattgtagtacatcccctaggtttgaaataataaatctgcatgttcatatctcaaatattattgccctttttatgtattattttatactaattcatgcaaagtgcctactttatttggcaataacaaagttattaacataataaaaataaagacacagatctgtatgtttctattgctaactccaaccatttgtttccttgaaggaaatttgtaatttagtgtccatcagcatatgaaattttagttttgacagtctggtatggttatatcagggtgacagtggtacaagattcagagctggtttttgctactatatcttttttaagccatctgaaccacttggtcaatctatcactaaccttgtcaattccccctgcttcttatatctattcattcttctcatttctactgtcactttttgagacaggcccttgtcatttcactgtaggattcctgtgacagacttctaactagtcctctgtctctgacttgccctgctcattcatccttacagcacaaaaaagttaatctgtacaaaatgctgttgttatgctatttgcgtagggtttgctttaaacagtacttatgtctatataccataaaagcctcaccgtgtttgaggaggaaattgaagttctcaggagaggagcgatggttgagaagacttgagaaatgagatgcactttctatagcgtctttagaaccagaatttacacaggaacatatatcctaaggaaaagcaacaagagcaaggtttcaacactcatggctttttcaagcaatggtgagcaaactgagattgaggtcccagcatttgtgagagataaaatagttgagtggcttcaatttatgttttactggaaaaaagctggtatgccaaattggaatttcattttataagcctcaggggttaggataagggcgagatgcattagttagcactctttcagtttctagtgatagaaacacacctcaaatctagcttatgcggtgcatgtgacataaatgtttcagggtattactgccattaggttatcctgaggcaaaatgactacatgagaacattagacatcaaactgtctttctccttttctctactcctcttttctctgtgacccagtagagttatgcccttagtgcctgcacttctagtgctcttgtctactaattgttctagcaatagttctggggttgcctctgattggaccaggcaggatgctgtactctggtggttgtttgcagaaacctgactctgggattggggtcagggacatctcaaccacatggactattaggggagcaactctggctccctgaaagaagaaaggtctattatcagaagagtggtgtggcctgttgaagtaaacaaaagtaatttcattttaggtttctcagctgaatgctgtgaatgaaatagcttttgtgactgacctaaggaaatttagccatttagtaatacagtcatacattacttaaggacaggagtacattctgagaaatgcatccttaagcaattttgtcattgtgcaaacatcatacagtgtacttacaaaaacctcaatggaattgcctactacacacctaggctatatggtatggcctagtgctaccaggctacagatctgtacagcatgttactgtgctgaatattgtaggaaattgtagcacaaatgtaagtatttgtgtatctaaacatatctaaacatagacaaggtgcaatacaaatacggtattatagtctatgggaccacctttatatatgaggtccctcattgaccaaaacatctttatgtggcacataactgtagttagattcttctgatacatttctctagcctccagtggtcagagataagtagattttatgtccccaactccacaatgttgagattgccaccaatgagtgtgtacagtgaaagcaacacccatcctaaattttgctaaagtatgaatatttttgtcaagtcatcacaaaattttcatgcagtctcttctcatagctcagggatggctaaactttctgctcacaggctagtgttttatattgaaaatttgctctgaaccaaatgcagcaacattcttaaggcaggattaagggaacttctagttgggtcaggtgtcaaagtcattgttgaagtagaaggatgtacagtggggtgctagacctcaaccctacactaatgttattacatgcggatctcccaaatcattttaaccaacgacttacattgaacaccactgatttcgccaataaaatatgatactttgcatcccttagactcactggtgcacattttaataatgatatttgaagtaattagtttattatcctaggatttattccttttcaggaatgtgtccatttcactgagccacactctatgctgccaattgcatgatctcatggttccttgagttttggggttacaggcaaaaaggcaaagaagtgagcaaggggataacagatcaaaagtgagttgtgcagctgataattcagcaaagaacaaagagacaatggcatgggaccgtgtcctgtttagagcctacagctactgtctcttgctggccttgctgacccagtgatgaccgaggaggagtcaggccagggcagagtacatggccagggtaaagaatactaggttttgttgtttgtttaaacctgagctctccgatcgcgctgctttggtcagatacttccagtggtgtcacaaagggaaatgtgatcttttgtcttgcctttcctcctctgcctgccagggaaaaatatatttacatatgttagtttttattttcctagcaacgaaagagtagaactattttacaaaccaaacacaatgtaaacacttttgttcaaggggaaccagataatcataggtcatgacttctttagtaaaaacagaactgtatattatgtacaactcattagtcatgagttccataagtatgtgcaagtgctatgcatcttttattccctaaagaactcagtcttacccagagcacccttggtaaaaggaaatggcatgtgtgaagcagttccagagaatcagaactaatgccattgtgaggcctccgagaagaccagccttgaggcagtaagttaaaattagcagggactttggcaacaggtgtttgtttagatgcgtgtttatgaaaatccttgctgatcttcttgcttctaaaggaaatgttcaatgactagaatatgggtcaagctttaaccctcctgtttgtcatcgtgataagtgactctgataaagggctgtcttggcgacaggcaacacaataaaactgacacttgaccagccatatcaagtaaacttgttaatgcagcctagatggacagtagcatagtttttccttctatagatgctttgagggcctaaaccaatatgtgtaactgctaacaaacagtagaattgtgtgttgccagtagctgtgactattattggagaaaaggtgataaacctctcatgagatttgggcatgtactttaagacggtattccataagtctttacattttatattacaattaaaaagaaatgaaatagatcactgggctctatttgatgtataaattaacactgatcaccataaatttacactgtacaactgtaatcctgaatgtaaagctttgttctttcccctcttgctgtaatttgaggagcctgttcctcatactctactttcattaggagggctgtctctctctctgtttggtctctctctgtctgtctctatctttctgttgcttgccttctctctgaagaggaaggctgcctgatgtagtcatttatctagccaccttgctgtgtcatattttcaattgatattgagaacttatgttttatgagcatgaacggtaagcagtcattagagctatcattgtattctaaagaagatgctaagtcttaggtagtctgctttattgcttgccctaccaagtatttagcattcccttcacaaatacgtgaaaataatgctgggtggcggcttacgatgtggcagctccttgcactgcataccctacaatgtcttgtccccctccctcagcattgagagctgctgagtgttcacgttccaaatgggtacttctgagtttcactgtttatacttctatacttgccttcatgcctctgaaaacagaaatcagtttctgggtacttctagtcactttatgtgcagactttcctaattctaaggcttattatcttattcttcataaaataaataggaacattgtgaatgaatctagacaatgcatggtgctgagtagactttaacaatgattcctaacggtttttagaaagtgtccattttgtcacctgcagtcaccccatatacatatgagatttatggacaaagactcccattttatatgcgtatgtatatgtgtataaaatgtgtatatatatttatgtgtacataatatatgtatgtatatatgtgtgtgtgtgtatgtatgtataaaatgggagccttcgttcataaatctttcactctgctttcctaacaagatgagtatttaaagtagcatgatcttggtttgaaatgaatatcttcagcctcttacagggccccaagtccaaaatctgttcctttaaaattttaaggaagagcaatgtctttggtgagagacagacattttcctctgatccagggtggaccactcccatttctaattgagaggttgctgtctgagaattgaagatatcaaagggaatttgtaataagacttcactttcccctgagcacagatcaaagtggcccctgggcattttttaactgataagggtctacactactcttgatactggtggtcaaagttatagaaagtgtgtaatagtaactgcgtgatcatcacttcactagttcatagctatggacttggtgaatttttaatctctttcttccatggatactttaacattgtagataacataataattttgtatgctttcattgcaaatttacaagaggatctcagggacaaatcattgagaaagttgagtgtgtcatactagattcctttagagtcatatttatgccctaatgtcatagctaggagtgtgacctgggctcaaacactggcttatcagctgtgggtaagtacttaacctttctttactgccattctctcacctgtaaaatagagataatagtagtttgtatgcagtgtgggcttttgaagattaaattgtgtgtgtgtgcatgtggaaggttagactgaaacataataagggctcagtcaaattagctactttggttattgctgtagtggtaacatttacacatttactatcttatgattcttcttatttttagaaactgtgtggtggtgatttttaaaaaggaaaatggcaaggactggggttttgttttctgttttctttctcacagttaatttcagcaatgatcaatacaatttttctctttacccttatatcatttttattgatttggctactgacaagttttgaagcggtagtctctaatcactatctccacttttttttctttaactctaattcactggttaaactcattttgaccagattctgctcataagattctatagaagatgcccttactctatgttttaatatccaactatttgcagaatccaaacaactttagttcatgaccatttgacttctttctggccactattagtaaactcttccttcttttgttctccttctgactctctgagtcctccttgttagtgctggaaggattctttttctccattcacacctcactctctatccttgatattttttacatgcccaactgtagtcatctttcatttctgttttacacattctacctgagtatcgtcatccattcttttattttgaactatcataaagtgcatattcccaagtcagcaattcctgttctttttttttttttagcctgagacgcatttccaactgttagtctctatctgaatatcatttatgcagtacatagtcaacttatccaaaacctaaatcattaccttccttcctaaaaattatttgataataatacttcttttatacctctgtcttggttaatggcatcatcatatattgagcctcccaaacttggttcatcttttatccatcactctccaaatgccttcacacgtaaaatgtcattgattcttatagaacaactttttatacgttatggctatatttcaaattggccttttcctctcttttttattggcccttagccagtaaaggcctaagcctttgtagcttaggcctacatcaaattttaattcaagaactgttgtgccttcctaactagtatattcctgccacgagacccttgccattcaagttcataatccatcctgtttgcttcaggggatagtcctccatgtttttgatcagttcactcccatgattatgaacatcaatgggcttttcatgataaataggacagaattcaaatctgcaataagtcataggtcaatctgaggtcttgtttacctgtccagcttcatcacctactcttccttgctcttcatgtaaacagtctattgtaaaaaattatggaggaataattgacatgaaataaaatgcatataattaaagtacaccatgttgatatattcttatgtatgtatatagcatgaaatcattaccataatcaagataaaaaatacccatcacccccaaatttatttatgcccctttgttttactgacctcacatctctccatccccacccccagataatgactgataatgcttctaccactatagattgattcccattctaggattttatataaatagaagcactctttattttgcatggcttctttcactctacatgatttttttttttttttttttgagacagagtcttgctctctcacccaggctggagttcaatggtgcgatctcggctcactgcaagctccgcctcccaggttcaagcaattctcctgcctcagcctcctaagtagctgggactacaggcgcctgccaccacgcctggctaatttttgtatttttagtagagacggggtttcaccatattggccagactggtctcgaactcctgaccttgtgatccgcccacctcggcctcccaaagtgctaggattataggcatactctacatgattttgagagctattcttcttacatgcattaaaaattcattgctttttctcgatgagttgtattccattttatggatgtaccacattttgtctatcctttcacctgttaatagacacttgggttgtttctagtttggagatgtttttacaaaattagctactgtaaatatttatgtgaaattctttctatggatgttgctttcctttctctaaattaaagacctagaagtggaagtgtagatcatttataaggtatatgttttgctttttaggaaactaccagactgtttttcaaaacagttgtttcattttacatttccaccagtagttcatgtgaattccaaatatcctacctccccgccaacatttgatatgctcagtctccttaattttagccatttaataggtattaataggtaccttattgtagtttaatttccatttccttaataactaacgatgatgaacatcttttatgtgttatttgctatatgactttcctggtaaattgtttgtacaaataatttgcccattttaaattggacattttgttttattattctagaattttgaattttttaaatatactggatacaatctttatcaaatatgtgtttgaaagtattatctctgtactttctttctctgagtagtgtttatgaagaacagaatcatttaatttgatgaagtaaattttatcaatctttatagagtgtgtttttgttgtactattgaagaaatctttgccgagcccaaagtcacaaaggtttatactaggttttcatctgtatgttttacaattttaaaatttacatagataggcatgtcatttctcaaatcactgttaagatatgagaaatataaggtgaggtgacataaggagttaatgaatgagttttctttgcaagtttcagttttatttgtaaagaccatatttataataggcagtcatgataatctgtgtggtaaatagaatactggtccgcaaaagatgtctacgacctaatccccaaaatctgtgcatatgttaccctttatggcaaaagagacttgcagatatgatcagggttgttaaacatgagggggaaagattatccaggtgggcccagtttaatcacacgtgtctgtaaatgcagaaactctttcccaactgaggtcagaaagcaatgcaatcacagaaaaagggttagagagatgtggcctttctggctttgaaaagggtagaaggttcacaagccaatgaatacaggtggcttttggaagcaggaaaaaataaggaaatggattcttccatagaatctccagaaaggaatgcaacggtaccagcacctaggttttagtctaggggtgattactgaacttctgatctatagaactataggataataaacttatgttctttaagccactaggtgtgtaataatttgctgtagcagcaacaggaaactaatgtataatatacgtatccccctttaaattcattgttccttccattaaacaagcaatgttttctttcatttgcattgtttcttgtcaatgagtaatagaaagcttttcaatgaatatttattgtatgaaaattgaataaaaaagataaaaacttaaacaatagattccatggatatactaccacctagggataatgtccacctacaaatatatacttgcatttggtttttgattttttaacaaaacaaaaataacagtatcttgactatacaatattgtaactggccattagtcttcagtatgttggcagcatctttctatgtcaatatatatatttctacaaagtaattttacaagttgttgtttttttcattttatatgtttatacaaatgtcctcaataagacctctagtcttggacattgacagtgtttccagtatgttcttgttctcaatatattatggtattataaaaatatctaaactcattgcttttactatctaggagtctatgcttttctgtttctgcctccctttctttcttcacagacttagtttttctttttacctaattaaaaatatttacttattaaaatactcttgaaaataaagataagtataaataataaaataatagttacctcatgctgttgttaatatcttgctgccaaacattttgggattttttgctttagtacttttatttacattaaaagttttagcatgattgtttaacaagctatcatcaatattcttaaaaatcatctttttgaaaggctacatattattcaccatgtgaacatttattacttgtttaacgtatctccctctaatggacacattttttccatttttgagattatatattcctgatatagttttatacatacactcttacacactgtctctgattagtttttatgatgacgtttttagggatggatgttctaatccaaagggatgtgtaatttgaaggacatattaccaaattgtcttcaaggaactttaattcagatcacaactagtagagtgtaaagggcatgtgctactgcctgtccaaataccatttctctcattttctttgcatatagaatgcatattatatttatatttcaacaagtcaaggaaagggatgctttctctttcttgggagtaaattctgattggtataagccaaccattattaatccctttctctttgtgagtgaatgtcttagagatgggaccataactgagttctcaccaaagcctcctaaaaattgtttctttgctcttaaaaagagatgcagtaaactcctcttttcctcaactaaatcatattgatttttctgatagtttctgtagggcttctgaattttaattcttcattctcttaagtctttagattgagctctggcttcttaaatcccatcatcatgaagtcacacagtatgcttcatgcttgaaagtattttattggatcatttgatagttcattaaagaaccacattttaaatagttcagctgagaacaaaaacaccgtgaggtgcttcaaagccgttctgtatgtttagcacagctactcaggcctctggttagccataaaatcattagctatgactgggtcattagtacttataacatctcctttgatacgtatgctcatcagtccaagaagttcagttagttttactttatacgctcatataagagtcagtatttgtgagctgttctaggatttccctctcctcctaagaaagtacaattccaggtaaacttaattatcgcagtaagcacactgaacagggtgtttccctatctgcagtgaccggcactgtggattgatgtgttactgaatttttctcctggaatacatctgccacccactctcccacatgtacagtcagtctgcattgctgtgccctgatctgtggattcaggaatcaatttatagaacaagatgaaacttttttttttaattcttcaaaagtatttagatcatttccaatttttatactatttaaacattataaggcaatagatttggggaatattacttaccattttataaatggagtaaaaagtgccaataccagacctctcttggcaaaagttacatgtgcaaagaaaacaaaatacacctttatatttattaatgaaagggcaaggaaccacaggcaggttttgtcataaaattttcaaaaagaaacctctcgaagaaatttggtaaagcctcaagcagttgtactgtcaaaaactagttaatcataaatataataatttaaattgccattttttataaaatgccttcatatacaatgtttgttgtgctttcattaacttggcaatttagtacctgctttctccaaaagcagtgatcagtcttttctcaaaatagattgaactgctgtatgaattcatgccaaagtccacaatgttagtttgaagaagctaaaattttatttttaagtcagctttgaaataaaatatattgctcagttttctcccctcaaggaatttcactttctctgagcctactactctggaccacaggcctcttttgcacataaattagccaccccaacagtaatagcagcaaccaccactcatctctagggacaactttttgaccatttattttgttccaagcatagttttaaatccttcataaatattttctctgaaagtccttataacagctgtgtgaggttgttttcaattttttttttctattttacaaattaaaaaaaaatccagagcttagagttgaattagtttgcccgcctaaggtatgtattggagctagcatttgaatccaggtctgcattgctgcaaatgcccaacacttgtggtagactaagatgacaaccccaggatgtcaagtgcctttaagttcaagcctatcaaaacctacctattctgtatgtaccctgtgtattagtctgttctcacatggctagtaaaaacatatctgagactaggcagtttataaaggaaagagatttaatagactcatgattccacatggctggggaggcctcacaatcatggcggaagacaaaggagaagcaaaagcctgtcttaacatggcagtaggcaagagggcttgtgcaggggaactcccctttataaaatcattagatctagtgagacttattcactgtcatgagaacagtatgggaaagacccgcccccgtgatttaattacttcccatagggtccctcccacgacatgtgggagctatgggagttacaattggagataagatttcggtggggacacagacgaactgtattattcctcttgtggccccacccaaatcttatgtgctcacatttcaaaaccagtcatgccttcccaacagtccctcaaagttttaactcatttcacattaactctaaagtacatagtacaaagtctcttctgagaaaaggcaagtcccttctgcctatgagcctgtgaaacaaaagcaagttagttacttcctagatacaatgggggtataggcattgggtaaacagccattccaaatgggagaaattggccaaaatgaagggggtataggcccctgcaagtctgaaatccagtggggcagtcaaatcttaaagctccaaaatgatgtcctttgattccatgtctcacatccaggtcatgctgatgcaagaggtgggctccctggccttctgcagctctacctctgtggctttacatagtacagcaccccccaccccgaccccccggctgttttcccagcctggcatttagtttctgtggcttttccaggtgcacagtgtgagcatttggtggatctaccatcctggggtctggaggacagtggccctcttctcacagctccactagtcagtgccccagtgggtactctgtgtgtgggctcacaccccacatttcccttctgcactgccctagcagaggttgttcataggggcttcacccctgcagcacacctctgcctggacatttaggcatttccatacctcctctgaaatctaggtggaggttcccaaacctcaattcttgatttctgtgcactcacaggctcaacatcacatggaagctgtcaaagcttggggcttccagcctctgaagccactgcctgagctgtaccttggccccatttagccatggttggagcagctgggacacaggactcaaagtccctaggctgcacaaagtagggggttactgagaccagcccaagaaaccattatttccttctacactctgggcctgtgataggagaggctgccacagaagtccctgacatgctctggagacattttccccattttcttggtgattaacatttgacttctagttacttatgcaactttctgcagctaccttgaatttctcttcagaaaatttctcctattgcatcctcaggctgtaaacttttcaaacttgtatgctctgcttcctattgaatgctttgcttcttcaaaatttctttctccagatactctaaatcatctatcttaagttcaaagttcaacagatctctagggtggggagaagaaattcccccagtctctttgctgaagcataacaagagtcacctttgcaccagttcccaacaagttcctcatctccatctgaggcacctcaacctggagttcattgtccatatgactatcagcattttcatcaaaattattcaacaactctctagaaagttccaaactttcccatattattttgtcttcttctgagccctccaaactgttccaacctctgcctgttacccagttccaaagttgcttcatatttttgggtgtttttacagcagtacccctttctaccagtaccaatttactgtattagtctgttctcatgcttctaacaaagacatacttgagactgggtaatttataaaggaaagaggtttaatggattcacagttccacatggctggggaggcctcacagtcatggcagaaggtaaaggagaagcaaaggcatgtcttccatggtggcaggcaagagggagtgtgaaggagaactcccctttataaaaccatcagatctcatgacacttattcactatcatgagaacagcatgggaaagacccacccacatgattcaattacctcccactgggtccctcccacaacacatgggaattatgggagctaaaattcaagatgagatttgggtggggacgaaaccaaactatatcaccttggtaccctttctagccataaaaagtaaacaataaggacttttatgttaatattcctgcatttatatgtagctcttataatattaaagtgagattaccttgattattttttccagagagtaattttctgcattcctcaacataggagtgaaaaaaaaactgttgaagtgagatttgttttggcatgtgaatcatataaatacaaaatttacttgctttaagggtctttgatctggcatttaatgtaaattaagtcatgcttgtaaacaagttttttctaaatctttatgagtctacttgccagagtagtaagctcttggtcatctttttctgccatttttttgcaagaaaaaatatatttcagtaaaaacataataaatattatggatcatcttctagaaaggataaatattttatatccctttcaatataagtgtgtatatttagagggaactgtgcatctcaattatggaaacttatttgtttttttcatcagcatacagataaattaatgcattagtattgtctgaaactgtaacaaattcttgacatgatccccatcctgccctcactggggataaccactattctccattataactaaacacttatttattatataagacatattatatcttgaaacttattctgataaaaacagtattcaatgaaagatattaaaatgtaacattttagtgactattcttgttaataaacttgaatagtctcaatgttgtagaagataggcattgtattgcctgtttattcattttgtttaataccattgttcactttagctggaaatattatcactttgagggatctctctttccttccttatgatatttgaacagagaaggcagctggaagcagaggcaccttttttctctgagactctgtgaagtgtacatctgtacctgtgccatctatgcttgttctttgtatttccaaaagccaatgtgaaaatgggtcattctgttcttagtaaaggagtaatattcttcctgccaaaattaatggatatcacatcattcacatcattgatcagtatccctttcatatttatattagaacagaacattgagacgtttattggatccattccctttgcctcatttcttcttatgcagtttatcctaaaatgaagatcagggacaacactgcttggtgttctgttctaacttctgtgtttgtaccttcagcatatgttttgattacagtagaagtcgcataaaatctgagttttctgcccaacttctacacatttcaggaaagaggttgttactgcaaccaacaaaaaagaaaaccaataaaaaacaaagatttaaagtagactacatcactaaagcatattgtgtttgatgctgaaatattttaaaaacatataaaatttaaaaactcatctctgataatctatttttgttttacagttctgaatactcattgtacctttcttaaggaagctgatacttgatatgaagaaactgaggcaccgaatttaggtttttgtgaactgtttataaattaaatcatttgcatcattagaacacaatacaaaattgaagaaaagattaataaaaaggcccctttcagtaaacttaaagaagacataaacagatgatcaagatatctcaatttgtttgctataaatgaagaaacagaaatagtttttcagagctgctattttattatttatgtttggtaggacattttttaaagagaaagagaaacaagactatggaatatataaccatcactcctcattcatttactctcacaaatatttactgaacactttactgtaagtaaaattgagtaaaagcacaattctttgcctttctacttgtactttttaaattgaatcatctgactcataacagtgaaattatagcccataggatttttcaacacagggaagcattatgttatgactaaacaagtacacatttaaaaagtttgattagtgggtgcacacacacgtacacacacgtaacaatatatagcatgtatatgtgtgtgtcaaacagtattatatatttttttacataagaacactgtttaatcttttgaaaggtggttacaaaccaacagaaagacatttctcttatattaactagtatgttaattaataaattaagattatttaatttctcctatcaagacttaaagtctagtaataattattacctatattaagtcctttcaatttgtgtaatatatttactgtattacatctcttcatattttagtattatattactctgaatactatcttctccaatcattggacattttcttttctaaaagtgactcaaaaagaaggcaacttttatattcttttaccttacatttttatatctcttggatcatataaagatttattttaaaaggaaaaggcaatttaaaatttttgccttataggcttataaatctctctttcccatctatatatatctatacatatagacatagatatatatagacatatctatatagatatgggcctttggggcaatttattaaaaaattctatcctctcccctgattgtactgcctttaattatattaactaggtttgcatgagatttctctgaaagttaattgaacccatgtaaaacctaggcatttggtaatcatactctttttttattattattatactttaaggtctagggtacaagtgcacaacgtgcaagttttttacatatgtatacatgtgctatgttggtgtgctgcacccattaactcatcatttacattaggtatatctcctaatgctatccctcccccctccccctaccccatgacaggccccagttagtgctgttccccatcctgtgtccaagtgttctcattgttcaattcccacctatgagtgagaacatgcggtgtttggttttctgtccttgagatagtttgctcagaatgatgatttccagcttcatccatgtccctacaaaggacatgaactcatccttttttatggctgcatagtattccatggtgtatatgtgccacattttcttaatccagtctatcattgatggacatttgggttggttccaagtcttcactattgtgaataatgccacaataaacatacctgtgcatgtgtctgtatagcagcatgatttataatcttttgggtatatacccagtaatgggattgctgggtcaaatggtatttctagttctagatccttgaggaattgccacactgtcttccacaatggttgaactagtttatagtcccaccaacagtgtaaaagtgttcctatttctctttgcctaggtggatataaaattgagttccaattctaatgtgtccagacaattttaaccatttagttttaaaatgtaataaaagataaataaacaataacttgctcagttttctttcaattacatcaatggttagaaaagccaaattcagtcagctcaagatgagttatttacaaatcagcctacttggaaacagattagcaatttaaatagctaagttaataagatccaattatagctaatttgcccatcctttctttcccttgccctcccacaggcttcagagtgtgactgctttgcatgaattcctgggagcaatggggaggcttgtggggcaggcgagtttgcaagaaaaacaaacacagtcatttttattattacacttgttgcagctgtactggactctgcagcctagcagtatgtgggggcaccagcatagcccaagtctctcacagttctaaacttttcggttaaagattatagacatatgtatactttatatatatatatgtatgtatgtatgtatgtataagtatatatatatatgtgtgtgtatgtatataaaaagtatatatttctttttatcagtaaagcttacaagcaacctctactagcataccagatgggataaggaaaggaaaggattgatacagaaaaaacatctgagattaaacacacacacacacgcacacacatacacacacaagagtatgtattatataatgtatgtgggtatattcatgtgtctacacatatgcaaaatgctattctgattccttgatttccttcctctcttatctggctcactttttctaatactccttcatttcacacttctcccactttgttttcatacagcctattctctgaaatttttcaaagctttccccctcttgtcgtttaattctgtaatccttttccatctttcaaatactaaatcctcctgctctgtgccttaaaatttttttgaaagcctacctttgttcatttttatgtcaacatctatgcctctacaatgttaactcattgatgtttataaacatctttgttttattatttaagaaatgtcagtgttatcagtaataatatattttaaatttatgagattttagaggacttttccttattgcaggacagattaactttacattgattttctcgttacctgtgctaaaatacatctgaattttatttattttgccaagcactgtgtttttcaagaaagatatttgtatattcatattacatttttgtaattgaaaagctacaggatgtgaaggcaaatagttgaggaatttggggatagacattactaagaaaattaacaaatatggcatctagagcttagaagcagcttctgctagtagtgtactatatgggataaggaaaagataggattgatatagaaaaatcgtctaagatttatgtttagggatgtgatagaacaaagcatccttaagaattgttaaatagttaaaatatctttcaaataataaaaaatagaaatagggggtgcaattggttaaaaaaatgggaaagatggtttgttagttaagaaactatattctgcacttgtacataccagatcacttctggtatgtacaagaaaaaagaaataatgtttcaagtttgatgattatttttacctttaatataacatttgtttcagacagattatattcccctgatccaggaaatgatgaacacatatacctatcaggttagccctcagaatgtttagtggacataatatttcatatacccagattactcatattttaacatcactgaatggcctttagaaaaggatttgtaatgaattagaatgcataacgtgaattttagaacaacacacctgctgaacgtcggcctctcccactgctaagttgcacagtcaaaacaagccctttcacgttggagaatacatttttaaaaaataaagaaaggggaaaaataacaaaatgaatatttaataagttcacataaggatatacaggaaataatatgtctttgtttaatggacacttaggctcattttttatacttaaattatcagttttagataaagcagatcttaagattatcagttatgttataatagccgtgattattagacagtagtcataaaaatgagaaatttacaactcagccacttcaagagtgcttttcctggccaggcgtggtggctcatgcctgtaatcccagcactttgggaggcggaagtgggtggatcagaaggtcacgagatcaagaccatcctggccaacatggtgaaaccctgtctctactaaaaatacaaaaattagccgagcatggtggcacatgcctgtaatctcagctgcttgggaggcttaggcaggagaatcgcttgaacttgggaggcagaggttgcagtgagccaggatggcgccactgctccagcctggcaacagagtgagattccgtctcaaaaaaaaaaaagtgcttttcctacttaaattactcaagtatgtttcagataattcattactactatgcatgcattgtataactagtccatgctaagtataagatgcctgggaactatgtgtatagaagatctagagtacagggaaattccttttgcttagattggctaatccaaggccaattatttgataaggttattgtacctaagtcactaatacatacctgtctatctctattctttgttgctaaagttaaggctttgaggtagccattgtttcttctagtactcaactcacaaatagtgtgtattgctggtctgagacatgcagtaggagatcggatgcatgatacatgtggttctgttcttctcccaatatacccccagctctagaggaatggtgatatcacaacagcacgaagaacacctcccaatttcctggcagcaaagcctagatgagaagcaatgaatggaaaggaaaaaaaaaaaatgaacaaacaaaatcagaaagagtgaatgtcctaaaggagtggaagtctattcttcctttcatggcccttccttccaatatgttgttaattggtcaaagggtacaaagttcccgttaggttgaataagttctgggtatctattgtgcatcatgatgactgtagttaataatagtgtattgtatacttgaaatttgctaagagcagatttaagtgttcttaccacaatagacgtaagtgtgtgaggtgatggatatgttaattagcttgatgtgcgaaaaagtcacattgtacactgtaaataaaaaacattaagaaaacaacaccttagcattgtggggattcagaacatcatgccccagaatatggccccttgacaacagagaaaagtacagagcaagttactctgaccttctcctgcctttctcccctgaaacaagttcataaaggaattctctgacctaccttgcctaaaagtgagtataacaccttcattcctgagagatcctgccctgtacctgggatggaaggaatattatactgagacacaggaaataatttgaacaaacaggccttgctgaagtttcttactgtttattaccattagatcccaccccttattgtccaatcatgtttctctacaactatccagttatttcatcagacttagcataaatgtacagtttgggggtttttgggtctttatttttgaaggttcctgtgttatgtaaaactttttaaaaatgaatttgccatgcttttctcttattgatctgtcttttgttacaggactttcagccaggaccctggcaatgagtaaggaacatatatttttctcttctacagtattcatattcatattttgccaatattctcttaaccaaattagtgaattgcagggctgtctatttccatagtagctcagttgattgttcctagtaactctttatgaatattaccttgttcttcaatgctcctttccttttatcatcagtaagctataatatttactagctagtatcctcaatatgcatctcatctgtgaataatcgtagccatgtgaagcaagcctataaagggatgacaaatctgggatatccatgacactactcccctctcctgcttttaagagacactcatcatcaatcattgctttctttttcctactgaactatgcaggcatcacagttgttcttgaccttgtgttcagacagccaccactgatcaatcagtgttagcacaaaataaaacttgctggatatcatttttctctatggtcccattctcatcttaaaacaaaaccgaaacctgaccccatgttgcatgttagctatcactccttgttctctcctttccttagctaagctctttgagtgtctacactagctggcccacttccacacttcactttcactattcaacacattgtggtctagtgtgtgtctcctgctccactgaagctgtgctgagaagctcaggttgtatggagcttgtagccactgtgtttctgcctcaaattttttcttccctggggctccctcctacttcctcttctgtttctcttcttgcctgtcttctgacaactcatgaagtgcctacggcttagcaattgttttccctgggatgtcctttgtcaatcactattactctcaggggtttaattatcactctttttttttttttttttaagacagatttttgcttttgttgcccaggctgaagtgcaatagcacgatctcagctcactgcaacctccgcctcccgggttcaagcgattctcctgcctaagcctcccaagtagctaggattacaggtgcctgccactacgcctggctaatttttggtatttttagtagagacagggtttcaccatgttggccacgttcatctctaactcctgacctcaggtgatctgcccgcctcagcctcccaaagtgctgggtgggattacaggcgtgagccaccgcgcccagccaattatcactcatattttgaagactctcaagtctatatcccctgccttagccctttctctgatgtttatttagtcttgtatatcaaaatatctagtgaccatgtcttctcagtaatccacaggaaacgcgtatgtatcatttacacatcctgtagtctccttcctacagtgatatcatcgtcagccagtcatgcctagtttgctggacacaggcattatccatcgcttttgatacatctctttcacctcaactgaatcaactgtcaagttccaaattaaatagttctttatttttttcttcttctctatttcttgtcaccactaccctgactcaaggcttataatcttttaactaatctcctactttctcattctactggtcttatatccattctttgcacttcagttaaagagaactaaatatattttaaataaacatccaaccatgccattcacttaatcaaaatgtgtggaggcctccctaataactatgcaataaaggcaagtctccttagcataaaataaatagccttccatgatccaaaccttcttaactctatctttgggtctaacactataatgatactggaagatatgttgctctttgcataaaccgtggtgttcctgactttatatcttcacccttagtgttacttaggatgccatttcattttttctttgttggtcttttatacataatttagaatgttctgtatatacttcatccgctctataaaaccttcacagaggtttcatctagctttaaatcctattctctgaatgccagtaacaatgttatttttcatgcagtgggttgcatcatattcacatttaacttaagttgctaattttagaatctaactctgaatgaggagtgaaatgcaacttgatccattgtgttcaatgttcaagaacagaagcatgatggctattaagtagggccacttgaggtggggggaggggggagggatagcattaggagatatacctaatgctaaatgacgagttaatgggtgcagcacaccagcatggcacatgtatgcatatgtaacaaacctgcccatgtaccctaaaacttaaagtataataataataaaataaattttaaaaaaaaggaaatggactatgggatcacaaatctcttagtggcaatataacgaaatgtaatattttagcaaaataaatacacattgtttggtctttggacttgcatcattcttttaggtcattctaaaagtttgtttatatacatgtatacacgtgtatatatacgtgtatatacgtgtatacacgtatatatgtgtatatatacaagtatataagtgtatatacatatatacgcatatacgtgtatatacgtatatatacgtatatgtgtatatatatacatatatatgtatatatgtgtgtgtctatatatacacatatatgtatatatatgtgtatatatatatatatacacatatatgtatatatatgtgtatatatatatatatagttttcaagatgatgctcttcagacttgttcaaagcaaccagaaataagcaatttattcctgtttctctgagattgcttttagaaatgatatataagtactagaattttttttatagtttgatactgataattgtgggctgttcttttttagataatttgaacgtaagtgctaaaattgtgtttggttttggttactttatatgttttaacttttattaattgcttattatttctactattgtttaacaattaaacatgtctgggatgtctgtctattgtgacggaaagtgctttgcatcctgtttatttcttagtgaaattcttgaattttcttttacttgcttgtcatatgttcttttaaaagtcaataatcatattcatacacttacaatccttctggatttctggactcgtaggaaaaaaataaaataaatatttaccgttcattttatttaaaaaaaaaaaaagtagggccgcagtaattgacagcatttgaaaagataaggaagcacataccccagttcttctctatacttttcaaagttgtaaatttgataaagaaagatttagataaaatccagcaaacatttattggtacctactgtgtgccagcctttaagtttattacttttaagcctaacgaaaacaaaatcaaccttggtttagtttagagaagtgaggtttagtattaaaatagaattaacatgcagaccagcagggattctttaagacagggatccccaacccccaggtcacagactaggaccagtccattgcctgttaggaaccaggcaacagcagcaggaggtgagtggtaggagaccgagcgaagctttatctgtatttacagccgctccccattgctttcattaatgtcttagctctgcttcctgttagatcagtggcagcattagattctcataggactgagaactctactgtgaactgtgcatgtgagagatctaggttgcgtgctccttataagaatctaatgccaggccaggtgcagtggttcacacctgtaatcccagcactttgggatgctgaggcaggcatttaagaccagcctggccaacatggtgaaaccccatctctacaaaaacaaacaaacaaacaaacaaaacaaaaacataaaaacaaaaaaacaatctaatgcctaatgacctgtcactgtctcccatcacccccatatgggactgtctagtgcaggaaaacatggtcagggctcccactgattctacattatggtgagttataattttttcattatatattacaatgtaataacagtagaaataaaattcacaatacatgtaatgcacttgaatcatcccaaaaccatcctcacacccccactgatccatggaaatattgttttccacgaaacccatccctggtgccaaaaaggttggggaccactgctttaagatgttccattgcctccatattcacttaatagtcttgtaactgtgaacagaaaagttggctatcccgtcatttccacaaaactttgcttttgattcttcctttattcttactcagtggttcttactatgtagaatgcaaaatcatcaggacaatgatggtgtacaagatgttatatattggatttccatggatgatttaaagtatttacagtcttttctctatatgccaaatgtgcttacttagactctgttatcacttaagatgggatgccagttaagaagtaactccatgatagctatcaacactagctttacagatgacttcacaattacataggacactcctggaaagcatgaacatactcttatgtatttctgtatcctctaagcctaagttagtgtctggaatgaattaagtgcccaataaatcttcgttaaactgaactaaactggaattcaacactgctagtacccaagatggagaggatctactgttctcttttttgattgttaaccactcatttattcttgtgctggagagtctcacctcttaagaggaacccactaggttctcttgtgtgtgtggatacagagatttcagaggcctggcatgagaagcagcagctttttaaaagtcattttcaggaagaaagcaaaaataaatgaaaagttgaagttgatatgtatataggggtgatgttactgggtttttaaaaaaataacaaagactgatggggtatgaatataatgctaaatatttagtatgctaaatgacaaattttattattttgatgtgtttatacttcagtgtaacaagacgtggccagcagtaaccattccactctgatcttcactaatctgcctttaaatagagtgctggtgatttcccctttatcattttttattacgtctatttgattcttctttcttttcttctttattagtcttgctagcggtctatccattttgttgatcttttcaaaaaaccagctccaggattcattgagtttttgaagggtttttctgtgtctctatctccttcagttctgctctgatcttagtcatttcttgccttctgttagcttttgaatgtgtttgctcttgcttctctagttcttttaattgtgatgttagggtgtcaattttagatctttcctgctttctcttgtggacatttagtgctataaatttccctctacacactgctttaaatgtgtcccagagattctggtatgttgtgtctttgttctcactggtttcaaagaacatctttattcctgccttcattttgttatgtacccagtagtcattcaggagcaggttgttcagtttccatgtagttgagcgattttgagtgagtttgttaatcctgagttctagtttgattgcactgtggtctgagagacagcttttgataatttctgttcttttacatttgctgaggagtgctttatttccaactatgtggtcaattttggaataagtgctattcctcaaggatctagaactagaaataccatttgacccagcaatcccattaccgggtatatacccaaaggcttataaatcatgctgctataaagacacatgcacacatatgtttactgcagcactattcacaatagcaaagacttggaaccaactcaaatgtccatcaatgatagactggattaaaaaaatgtggcacatatacaccatggaatactatgcagccatgaaagggatgagttcatgtcctttgtagggacacagatgaagctggaaaccatcattctgagcaaagtatcacaaggacagaaaaccaaaccacatgttctcactcataggtgggaattgaacaatgagaacacttggatacaggatggggaacatcacacactggggtctgtcgtggggtggggggaggggggagggatagcattaggagatagacctaatgtaaatgacgagttaatgggtgcagcacaccaacatggcacatgtatacatatgtaacaaacctgcatgttgttcacatgtaccctagaacttaaagtatattaaaaaaaacagagtgctgaacccatctttttaaacatctttaaaaaaatagttatgttgcctgtggagttttagaacttaatgtaatgaaagtactatctttctatgaaccttacagtttgtttttgttgtcatttttaccattatttgataaaggtaagtagacaaatagataacacattcatattggactattcattaagaggtctaagaagaaaggtactcttaaattcacaagtggggactacaaagcaatatgaaaatgatcaggatttccgttttaatgaaataatggaatcacatttaaaacattattttatttttttccaattaaaaaaattaaaaatagaaaactcaaaagcaagatttttattttctgaaatatatatgtattgatctgttccttcattgtattgccatggttgcaaaccaatgaaggccatataggaatagtattaacaatatttcctctctggtaatgtttgtttgcctaatgttctgtttttatatgtaatattttatgcgggattttgttctttaaaaaaaaatcaataaagtgccattgattaacaacaaccagactacatgttttagtaaactgaaccactttggctattactggtaggatagacactttttaatataaaatgctgagccagaggaaagcaaatagatttctctttcttttagccaaaatgtagagaaaagagaggcaaatgattcacaatataaaaagtttaaaaaaatcacacaatgaattcgctacttacaaatgtacaggagtaacatattgtctggttctcagggacttgttaaagggtgaagattagtgttctgttatgtagagttaattgtgttgcattaatgccttaaaataacttggatgattatgtaaaaagcagtttttaaatgtcggttagaaaatatctcagtaaaagatcattttgccctcttcttactaattataacacttaaaagatattatttaaaataattaatggtatacaagtagggggaagaaagctaactattgtgttttaagtggctgtttatttagagcccttggacatcaattatatctcacagttataaatgtactttctaagtagcattcagaacaaaataatgtgagaatttttttgacaaaagttaaatcacatttgggatactgaaatgaaaattgatgaccagattgttgatggacgatttcattctcactaagcgagcatcctcccactaaacgaaagaaaggtctttgcattattaaaagcccattctgcaacactgttgggaatttggttgggtcatgaatgctggcaggttgtcagggaaacaggaataatgcactgaatgcatggtcttcttataaaatgggcttaatattgctacttttgattttctaattgctgatctagaatttctaatagtaacattaaaggagaggaacatattttctagtttaattacatatacctctctgttggcttagtagtaataaaaatattttctgtaggtgtagaatatccttacagtccaaaaggagagtacatgttcacaattaaagtttgaaatttgtgctttgataacagcatgttttattcattcatttttataataatattactgagcctgtatcatatagtgatgaacttttcagctgttttgagggtttgtgttagccacattcacatttgtataacctgtgtttcttttttatttttctttattttcattttagatttagggggtacatgcgcaggtttgttacaagggtgcaccatgtaatgctggggcttcgacttctattgaattcatcactgggtaaacatagtacccaataggtattaacagtttttcaactcttgcccttctccctccctccctcttatggagtcctccatgtctattgtttccatgtgcacccattgtttagcttccacttataagtgagaacatgtggtatttgattttctgcttcagtgataattcacttaggataatgacctctgggtccatccatgttgctacaaaagacatgatttcattatttttatggctttgtaatattctatggtgtatatgaatcacatttttaaaattcagtctaccattaatgggcacataggttgattccatgtctttgctgttgtgaatagccctgcaatacactcacaaatgcagatgtctttttgatagaattacttcttttcctttgagtagatacccagtagtgagattgctaggtctaatggtagttctgtttttagttctttgagaagtatccatagtggtttccaaaggagttgaactaatttacattccctccaacagtgtaaaagtgccccatttttttcacatcctcaccaacacctgttatgttttgactttttaataatagacattctgactgctgtgagactttatctcattgtggttttaatttatatttctctgaagattagtgatgttgagcattttttcatgatttttggccacttgtctgtcttttgatagtttgttacccttttttctaaccacttgtttagaaggaggcttgggagagtccatttccaacttactttctctgagacaaactgactttcggatagcatgactggacctcatatagtaactacaagtacaagaaaaaatgtctaatatgcttcgattgcaaatatgtataattattttagtatacagaaatgcaagaaaatacagaaattgagcatccccttcaagagatgctaaggaatcctaaaatgggagaaggctataaaatgcttgttcataaattagtatttgagttttccaacataaaaccaataatctggccataaatagttgaatgcttaaattgtgctctaacatcattgcccataagctaataaaccttaactgtaaattagagcacattttatggatatgacaaatttatccagaagaatacctttttcctcagcctgcttaagcaagccttcaatgtctctttaattaaacttctaaaataaaagtattatcctcatctgatcctggaattcaggaccctgcattagtttcccccgaaatcattcccagctaatctcctgtagtttccaactgcttgctttcttcagataaacttatttcccagccactccacttgcttgctatgagtttctgtgcaagttctattatgtccctttattttatctatgacttggtctaaataaaagtgatgggcacacaaaagtgcttagtaacttctagccattgtttttatcatcattcccaactatgtgattaattcactctacttctgctcaaaatgtctcacatccctcttgccaccgttcaaaccctgccgtgtttcaaagtaatattaaaacatttttcttttacattgtttgtgtgcaagaaattaaagacactgtcactgtaccttagtactgcttatgagttgggaataaatgtgtggagttccccggtgatggcagaaagggcaggtcaagtgtcccaagaacctcaccaggcaggagtatttgataataatattcaagggaaaatgacaactgttttgaaaagcatgccattgtgataacataaactcagtttagaatcatttggtattaaaagaataagtaatggatattgtttcttccttaagattcacaccatgtgggtactgtataattaggaattctctgttatgcctcaacccacatgttatatccatattaccattgatttcatagccgcaaaacccacattgtgtctggcaggcaggacttttctccacgccagattttcaggtaaaaaatcttagagtatggttgtcgaggacatgaacttgccttttacctaatttactgtttacaaacttgtgtggcatttgagttatgtattttggtttgaaacacaaatattttcctttgttagattcagctaacagtatttttaacttgttttcatcccctaaccaccttgctgaaatttcagggagactgggttcttctggttgccatttccattgtaatttccttatggtctagtcaaaatatttttatactgtgtttatttaaaagtgaaaaagttcctttccatccagcctaaggggatagtatctttagaaccaagaatctttcatctcctctttcactctaaatataacggatacttatcttttattgagggaactaaacaaagagttcatcagctaatctctctcgtgtgtctattttaagttcctttacaaacaaaatattttacagtcccaacagccataaaagaaattcctgaccttgcccatttttgagagactgggaagtcaaactataccctataggaatcagtcctcaaaatcatttcttttctacttcagaagtgtgtatgtgtttttttaaaaactgctaatgaaagcattacaaagattagcttttgaagtggcaagcagctttcatttattttccttctggtattccctcagcctccagctaaaatttagaaccttaaaaatgttgctctttggtactaaattcagttgatattctatcaaagtgtatttggtttatcaaagcttcgttcttatcttgcaactcagtattcccgagagaacactagtcaggttagaactgacaagcctgtgtctagtcctttcaaactagaatgcactccctcacctactgcaggtctgcttacctgtgctggttaattctttctcccattgtcaggcagagaggcgagtgctcacaatgtggtaaaagaggaagtgatcacttccaagaaggaaaaccgatcagagagtcacacagaaattaatggcaggaagaaatacaacatgaaataagtagattcataaaatttagaagatttggaaatgttttttgccatactgtgttactacctaaagaaggaagctgtatctttggttcttttaatgacatctgacatggaaagacttggacactaattagataccagtgataattttatatcaataatctttctcttcttgaatgtcataaattagcaccagtgaaacttattttcatatttcccatatgtcatttttttctgtcagagtcttcagttattggttcctgaaaaacatgtgctatttgtagatttttaataagttgtctcattttaaaaaaattctaacaaattaaattcggtcatggaatcaaattggattaagtcagtattgtcttcccaatacatcaaagagcctcttgagacagatttggaaatgacataatctttcttggaggctttgttgacccttgggtgccatgttataataacatttgtccgaagactacagttacggaattccaaaggccagtcgctaatatttatctgaaggctacaatagctatggatccttgaaattctataattttctgagattatgatagaacaggtaaattccatagaatgatgggagcaacagtcaacttcaaagggttgaaagcggaaaggtagtataagaaatggaagtaccaggtgaaagcctatgttcaacaagtttgacgctgaaggaaaggcccatgattgggcaaaatttagaagttagcgacagcaagattgaatggataaacattaaagtagagctgctttgttaaagtaagggtcatatgaattccgtaagttgtctggtgagggctgagccttgggctagtgtatcccctgaagggacacaggcttgctggaatcgaggatagtaaaaatgagagatcccttctcagtataatattcaaatcaactaacatgaccacaaaattcacactaatttagaggaggctaaaatatggtgcgtgatttagtgatatggtctgcaattcaactgatgtgaaaagtttttttttttttgagtctcactctgtcacccaggctggatgctcactgcaacctctgcctccagggttcaagtgattctcctgcctcagcctcctgcgtatctgggattacagacacccaccaccaggcccggataatttctgtatttttagtagagacagggtttcaccatgttggtcaggctggtcttgaactcctgaccttgtcatccacctgcctcagcctcccaaagtgctgggattacaggcgtgagccactatgtccggcctatgtgaaaagttttattttcacttgattgttgattattgtgggctccagcatccacctggaactggacatttaaactgcatattattagaaaaaaatatgagacctaggaaagactgtatctaagttttggcacatataattacacaatcacctactccgaatttagcttatagtttctatatcataactggctcaaacaagaatagattcaaaaccaatttttgtaatatataactttaatgaaatatacccaagaagtttcattttaatatgtgtttacatcagaacttggcacctttgttagtactgtttccactgttatcaaaagcaatttcacagaacagttcaatattttataaattgctgtaccagaacgagggtgtttaaccagcagtgtcttctctccctcaggaatctctgataactctgacaattttaaatcaaagttctctttcagacaagttttcatggtcatgtttaattatcaggagccttttaattctcatatgtatgatgtttttctcatataaaaaggacattcttacataggatctttttaacatctgttttaaaaaaagttttatagtatttacctaattggcacatgcttattttacaaatacacacaaggttgctaaatattaatgttaccaataaaatttttaaaaataagaagaagaaataccaactctgagaaataacattatatataggtcaatacatattgaaggccaggatcacagttttattatatgagttaatatatgatagggcatgtagccctcagcaatcctcttttcaaatatcatggcttatttcaagtgtttttagaattacaaaataaacaatttctgtttgattactgcaaatgcgttatatatatttatatatatgtctatgtatttatgttgtatatatttataactttgaattttgtaattcagttattattttacatcttcatgtagactacagaaatttcttaattctacattattttgttttgagttgctatcattaattgacatgtattgtttttgcttatattcaatcgtttacttatttattcagtgaatatctattgactgcctttcaaaaattgggcatttaattttaacaataggcaattcatgtcttgtttagggaaatgaatgatttttatatattaattataaaatttgccctttgctggtattatgttagtctaaaaatatatttttattgtttatcttaggctttatttttacctaaacttcctacaaaaagataatttcatctttttcttttaattatctttacttagatttctctctattgactggttgcggtgactattggttccaaaataactgtaataattaatagtggacatctttactttaacaagaatgcttcttattcacaaagcatgcttctagcttttgttttaacatacacctacatgcacctccattcccaccctcaccaccctcaacacttaacacagaacaagtgtgtgctgataatctggattcagtaatcaatggctgttatttattacaagtggtttgtttctttttcttatccagacctagctagagttgacctattaaaacatgtcatttatttacagatttcctgaaggggagtgagccttaaattttcaaaatgagcttcacttagacatattttattattttcatacgttgtgcaattgtatttgctaatattttatttaggaattttataaatatttatgtaagattttgttatagttttcttaattctttattcccaggttttatcttgtgtctttcttctgttttcctgaggtttcattttgcagttctttttaaaattcccaagttgaatacattatatagttattttcattcttatttgtgtattaagtatgtctgaagctataaattttcttctgaatactgctttagtcatagcttataggtttttagattgtagtattctatttcctctttgtcataattacctcagatatgactattttgaagacattttaatttttgttgtttttattagttcctggtttgttattatttattattattagcaaccatttactaagtatttatcaaccatcaagttatgtgctaagcctttgcttgatgatattatggaatgaacaccagataactatgatataggtgttttcaggtaagaactctgggacttcctatatatgcatgtggctcttcttgcattcaaattcttaaagctgtgttaccacgaacaagttacttaacatctttgatctcagtcttcccatatataaaaagggaatgaaagtggtacttatttcagtgacatgaaaagtagtaagtcattaccacaggaagtattagtcataatgataatagttaaacctctgtcctagttcatagagttcaatgagtggcagaggtgaacagagcctcattccggttttcagggtcttacactctatgttgtacaactattgaaggactcattcccagtttgctatttttgtacatttttatttatttgtatagttcagaaattgggagagtaatttgtaattgtgctttaataagaccacattttaggaagtcatgtgaaaatacttatgattgagccataattgttatgagagcatcctctactttatggttattgcaatatctattgagctttctttagcctttggttcataaggggaagcatcactcctgtaaacattatcaactgaatggagcatgcttttaatgatcattatccgcacatcatctcatacaattgtgaggacattgctgccttataactgtagtaacagaagcagtaaaggagacttctgccttttaaaactgtgttggagaggcagaaattctgaaaacgtaaggccaaattgagtttgttcaaactaaatgcaaatacttacatttagttaatttaatgctattgatatttttatttgttattattcagttttttagcactgatttcctgctttgcattacaaacattattttaaatatattagtctcatgctagctaaaataaagtcagattttattacaatcagaggtcgaaaatccctgtatttgtggcttgagtttgtttattttactactgttttgctgtagttacactgaataacataaaataacatttttgttgctattaataaagtagaaatgttggcttttagatatgtggatagagcaaataaaaagggaaaaaaacagtttatgaatttgttcactttcataatattgtaaattggaatgaatacaaaatcactgaattgtaatgctgttaaaaattatttgatgaaactaagttcaattttaacctaatcaatagctactcattgataagattttcctgatgaaatttgttttctgaaaattggttctgaaatcttagttgcttaaatcatttgcaagaagaaacaaggtgtccatgcctttccttagggggacaaactgatatagtgtttcttgctacttctaaactctaaatataatggaataaatgaaattatttctttgttttcaccatctgaatgtctgagaatcccacaatgacattgaagagaatgattttgattacctcggacttaccacggaaagaaaagtctgacttcaaattgtgtcttaataatagtggaccaatgtttttgttaaatgaaactccacctgcccctcaaactattcttgtgcttcggcttatgtgcttgatagcacagtcacttctcacctaattgttgccatagtgtttgaagccagaacataaagaagcatcatgttcagaaaaacttaaaagtatggcccttgtcagtggtacttatacccctccagactgacaaatggttcctgaagctctagagcacatggcaacataaccatattaatgggtggtccagccagtagctgccaagggcttccaaatattattgcattatttagaagatcatttccttattctactccttacagaatttggcaaatataaattggcttcaatattcactttactcgtgggggaaaaaacccacaaactgcaagagtatatttactacctgcccatgcctgcaaattttgtggtgcaaatacagaccttaaacttattctaagacctgaaatcatgtatgaagctgaaactggcagttttgcccacagaaatcttgacaccaaatgaatgcatggtatagagctagttaacaggaataaatagtatgctcaatttcctatatttctaaaattttaagaaacttggagaatcagaataaagtttaaaagtgaaccgaaacacctagagtgtcccagtgaaagctagaaaatgatttttgtatttacgttcatgtaaattaggtttttcctttgtaacaggaatttttcatattaggatgaatgttaggacaaatggaaaaagcctgtgaatgaagttaatttcaaataaaataacttgcattgacatatttaatatgtgtaataatttgcttattttgatggagaactaaacaatattttaatagaaaatatctgtttttctcttattcctaataaatgttaggcagatttctcaggctgggggcaggttcacacatgtaatcccagcaatttgggaggccgaggtgggcggatcatttgaggtcaggagtttgagaccagcatggccaacatggcaaaaccttgtctctactaaaaatacaaaattagctaggcatggtggcgggtgcctttaatcctagactactcaggagtctaggaggcagaggttgcagtgagctgagatcgcaccattgcactccagactgtatgacagagtgaaactctgtctcaagaaaacataataataaaaataaataaatattagacaaatttcttaaggatatttatttacaggagtgctaaaacgttctcagattgtccaccatctaagtcctaccctatatgacagtggctaatctaaaagttttaccttttatagatatcaaagctgccttaaaaaggtaaaacaaatcaaactttgcatataaactcacaataaacaaggtgtcctatagcattttggcagacaatattcattttgagaatatttaaaataatacttcttaaaacagaacttgccaaaacacctgtcagaccaaacaaccagatggtagctaagatcatatgtttttagaatcatggcttttaaagattatggagtttgaagaggattttagcagattgtcttacattcctagaatgctcaactctcaaatctattttgaacatatctcatgtacagcacactgtggcaggcactgaggactaagaaggaatgaagtgttcttcacttgaatacactatgcatttgggatgttgcacaacaatggatcatacacattattaaacactgacttccctggtgaacggaaagtaagacaaaccatagtgtattgcaaaaggtaggaactatgtattagttatctgttcattatcatgtagacaagtattccagacctaaaacattgacttaggcgagtgagcagggtatgatggaaagagacagattggcagtcaagagaagctgctttagatcctttttcagctactgtaaactttagaaaattacttaatagtattttacattgcaaaggaagaggctaataatctctaggacttctccactcaccattattatgtagtaggattttataagatggtccaagtattttttaatggttaccattaataataaaattagttttaggaccaaaacaaaggtaattttccaccctaggcaaagttctaagccttctgcaaagacgggagtaaaatcctccatatataaaaactgtggaatgttttccacagactttgggttggtgttattctgaactagactctcatcgctctcccatctcagaaaatgtccagtttacttcaggatgatcagggactaccctatgaagtagttctcccctcagtaactactactactgagatatggacatttctttgcatatagaactgtggagggaccagtcccaaagactggaagtttcttctgaggactatagccattcatctcatggttgtgtctgatgcatagactgttgtgattcaatgtacactgttgagccccaggcccctgtagagccctttcagtgctctttcagcattccctctgtgttaaacaaggccattcgcctagacagagtttaaatggtatttttgaccttctgctttgcaggtcaattgctttggcagactactaacctttcttctgagtgcagatcagttatcagtgttttctgcaacatcctcaaattatcattgaaagatgttgagcttggaattttcttacttgcaatagagaaataaaatcagaaaacttctttttaatagtagagttaaagtttaggagacatagtcactataaggaaaataagtaagtcttttactttttagcacagtttgactcccacaggcacccaaaactgcgttttctgatattttggaagagtagaagctttgcctttgtgcttggaattattcagctgagataattttgtgagctcatttgaaacctatctcttccttaacaaagttctctttttcatggcattattcacctttatatagagttatttctttatacgtcaaaactatctggctaaaatatatatcaatatattctaatatatatatagaatgcatcaaaaccatgcatatatatatgaaactactggtctgcaagatttatatattctaatgtatgatgttgatgcatttttttcttcactgatctgttataatctcttttatgtcattggagctgaataaatactggttgaatggattagggaatgaatgaaagaatgcatgtcctcttgccatggaaaaatggaaaggtgttatgaaaattatatagtgcgatagaaagagataagaactggtctgttttacacttccaattaatattaaacacattcttagaggaaatattcacaaatgtggttgtaaatgcagtttgtcttctcttgtttagaaaacaatttgtgtctgcccttgtatgaaagatcagtgaaatcctcaaaattaagcacttaatgctcatcaaatagcaaacaaggtctgtagcctagtaacctttgtctgcattgaaagattagaaatgaaactaaatggtgattcatggagacggtgattatgtgtttcagtttattctaatgtataaatgacacttaaaccatgttctataatttgaaattgatacattatggctttaaaaggttactaacagtaatccgtatcaatctctggccctttcagtaaatatccaatgtttaacttaatagcttaataatcttttcatacattactagaggggcatgtttgagtttaaattgaaataattatgaaattcacaaacttgatttaagaattgggtctgtctagaaattaaaacttgtaagtcttttgtgagcctctggcttagccacgaagtacagaataaattaactaattagcaggcattctaataataactcccaagttcaaaagagggaagagaacaatgtattacacattatctttttttttccataggttttcaggaatttgaattcaatagtagctttaatgaaattggccattgtgggtttatatctgttggagtgaagttattatcttaaaaactactcagtctttttacatatatatgcagtatgctactatataaataatacctttctttttgaagtgatttaaaagaaaaatgatcctacctagtttaagtcaatccattttctgagtccttgggggaaatgatacaatttcacataccgtattcctggaacactagtgttccactaaaaaaggattccataattaaacaaattctgtaaatactaaataccattaccaattggagaatcacagtgcacattagttcctttaacattcaccgataaataaacttatttaactttgcttaacccagagtttcccaaactcttttgaaccacttgacccttcttgattctgtataagcctttttaacatttcttagtatagcaggtttcagtggaacagaatttgaattaagcaataaagagttgatcttacacacttgtttttgtatattgtttgttatagtttggtctgcaagtgtgacacaatgagagaagattctgctacctgagtatgagaatgcagacattgagttctagggtcttctccatctgatgagtgggctctacatctgatctctgacatgcttgctgaaaagctgccaaggagtacagtaggagttctatggtgtacatcatgatgaacaccatagaactggagaatgaaaatcacaaagaaatataacttttctaatctatgccagaatgcaatttctaaatccaggaaagtatattggaatgagaaaatggtctacaatttgactgaggacttgagtttttggtttttggtaagaggatatcttaagctatcaaaaatgccttcgctgttttgtagaaagctcattcagcatgtcagaccagagttcatgtgcccaatcttaggtttggggcaaaaggtcactatctgtactgcttccatttccttatgatatacttttttgttaaccctttacaatccaattactttactgtcctggaagactctcacataagtataatttgtgaggtggaaggtctttgggtttgccatatgacacagtttcaatgaactttgactgcattgtccaatctggagcctctcagatcttggccctttcctaaaaacaggttgtatttgccacaaataactatttaggtaatctgcaaatctcatgtattagtcttttgttgaaagtcagtacaagttgtatggttttcgtatgtctataaaatgcaaggacagtaaaatatagagtagaataaagtgagggaaatttactttctctctctctctctatatatatatagttaaatagcaaactgcatgatcttaatgaggtaagaatgttgtcatggaccctacactaacacacaaaggaaagcaacataggagatagatagggcttcctccccggctattaggctgtgccttttcagagcctgtgctgtaaattcaggcaatgcatttgtcatccacctccaaagactcagtgagtagtatcagctctggcacccaggatattttggatagtgacagataccttctttaagcagagggcaggagcagtgtgtgcaataccaggctaattcttggcactggatttaacagtgatgaagagagagtgaagacctttcatcaatccatctcttggcatccagcaatattcattttattgctgtataaataatcaaagcagtggcttgcctaggaaggtgtgttatttctcattttggcacacctgaaaaaatctcacccagctctcagggtcccaggcctatgaatcaaatactaactaggtccagctggactgaacattgtgcttcatatgtatttgaacactctcagatgtgaacatggatatcagttatcaattatattattttagtctttggcatgttttatatttctgtgggattaaacatcagactttccaacatgcttgccttgatggcttctggtgcctcttctgctcctcccatcctgctgagcccttgcacactgcccctcattggatgctttcctctggttgctcctgaagagggatatatcccaagatatgcaaataatattaagctacactctaaatgcaaggatcaagctattttggggcttttacaaagaattatacagaaaaggagaagagatctggatcagagttacagcactgaagtaatcattatatgggtggatagaagaacctattaatattagggtggctgagatggtttcatgaatataataaataagaagaaaggcaaggagagccctggagatcacatgctttgtgtgtgcacaattaagcaggattttatatcgctgatattaaaagaataagaaagatttaactatttcaggaagaattttctttaatgactactgttgaaatagtatcagtaaacattccttcctgactgatcaatcttttcttccaatagaggagaatatgccagcatctacacaagactgacagttactttgaaaatgtgcaagagactaaaatgccttccaggatttaaattcttggggatatttctgtgatgtttatcaattgattgaaagcaattttcattttgaaataaataattattggaaatttcacctgtcaacagaaaagtaaacaaagtaaaaaaagcaatattttcgggagatgcacagaaaaattgcttactgctgtcacagtaattttcttaagtgcatggctcagtcgtattaggtctttttgggtctctattgatcattaaaggctggaacatttaataaattaaacatggcttatgatatgagtttatcaaatgttcttaaagagagtacgtagaatcagtttgaaaacatactttctgtagtgcttattgtttagactctagatgtattatttataagatcacataagttttaaagctcagtttattatagtcaacattgatttctatgttgtcatatccttggcaatttttgcatcaattctctgtatttattttctcaaatgtggaaattccaatatttaaaattacaaggaaggaattttacacgtaggtttttttgagtcatatgttttttcacacatggcttagccttgtttctagcatatactaagtgataaaaataaatactaaatgattatgaaaagtaggactttatgcattctggactgaaaacaatgtatggaaacattcccaaatatatactctaagatgcaatgaagggtcctaaaagcttctgtgaccctgcctgtgtatatcatccagatctcttccagatgtttagagctcccccgggtttatgaagagaacctgaaggcaaagtcaacaaatgtagctactttgtctgtccatcaaagtacccatttatcactcggtccacgatgaattacagcagtcccctgttatgtgcagttttactttctgtgatttcagttacctgtagtcaaccacagtctgtaaatagtaaatggaacgttttaaaaataaacacttgatatgttttaaattgtgcctcattctaagtagcatgataaaatctcacaccattccactccatcccacctggaacatgaatcctccctttgtccagcatgtctacactgaagactcactacctgcccattagccacatagtcgctgctcaaggatcaactgtcatggcattggagtgcaggtgcaagtactcttgcacccaaataaaggtccatttgacttataatggccccagagtgcaagagtagtgataccagcagtttggacgtgccaaagacaagtcagaaagtgtttcctttaagtaaaaaggtcaaagttcttgacttaataagttaaaaaaaacatatgccgagttttctaagatctatggtaagaacaaacctatccatgaaattgtgaatagggataaagaaatttgcgtgtagtatatatggggtttgtattatttgagatttaaggcatccactgtgggtcttaaaacacatccctcttgcatatgggggagctactatcaatatagtggcaaataatgagccaattgggaactgaatagtgaaatgtttaccttgaccccatgaagtttatagttttatagggcactcacatgcattgaggcagtcattattaggatagtgagtctttggtagtattttactaatgaagtatacaataagggcatttcacttagtctgactggtcaaagcgttggaggtggtatctacagaagaagtaaaatatataatcttgccttcagtgagatgaaagagtagaacctgtgtcacatccttcagttgtataatacacaggttcattacctgcattgctcctcccaagtcttaatatattcactacattactgagaaagctgggtcagaagctcccttcagcctggcttggggctcagtggttttccttgtataactctattgtacaaaaagattggcaaatgaagttcatttggtgttatatatcccgacttaccccaatccatgtggtaactaagctacagtacggtcagtttgtgcacttgcccgcagcacaaaaaagaaaagctaaatttatttatttattgtgatcacctttattccttagtttaggtagggactgtttgtttacttcaatccaacaatgtaattcagttgaaagcattttatttttttctattttccaaaaacttgagtttttcaaatgacacaaactctaaaaattagaaccaggactgagtagaatcaatcgtacctattgaatcaatgagtgatttgggaatttggcagatgattaagatcttcaaatgcttattctttattccttttgtttttcaaagggaaagaaaaatacatgtgattcaaaactagcttgaatatcaaggatacacctttgaagtaatcttttaacaggttcaatttatagcatataacagttgtgaatagaaatccattttattttataaactatttaaattattttaagtgaattcctgtggctaaagccttgtgttttgtacttgcatttgaacagacaatattttaatgatagtcatggtgaactttatagacattttttgtgttcttaaacttccccttagagcctctctgcatgcattaggattaattagataatgtctcccaggtgcttagagctttttggagaaagggaacgaagcattgtgttaaaatgattattactgacttcaaagacagttacatgagagttcagaaagaacaattttttaataatagtgactcataaatgccattgagatatagcattttatgatgttaccagtggccatttatttttgtttttttaaattatactttaagttttagggtacatgtacacaacgtgcaggtttgttacatatgtataaatgtgccatgttggtgtgctgcacccattaactcgtcatttacattaggtatatctcctaatgctatccctccccgctcccccgaccccacaacaggccccggggtgtgatgttccccttccttttaacaagccaattaccttctttcttattccattaaattatcatagggaaggatgtagagtttgcagtgccaagttacaagatgagatgcaatgaatggagtcaaaataatttcattgaattggtgaagttcatcaaaggggcatagaatgatgttatccttggtctctctagaagcattgggttagtggtacccaataaaaggccaaaagcagataaaagtttatctaagaattttgcttcttatcggtttcaagaatagagggtagatggaagtggtgccactaaaggaggaaactcaaagtagtcaaaagtgccatgtgacaattaatcactagtacctcctacagactgcctgggaggggccaagaagcagactcctggactaggtggtaggttatagtccatttctctatagggtttattgaaaatgcagcaatatcaacaatacttttaataatggttattttggtataacactttaaattttacagaattttcacacacgtattatttgaccctcagaacaacactgtgaagtaggtgttactctgaccatgttatagatgaagaatctgaggctcaaataatttactgatgttttcagagatacgaaatttataaaagacgtaggaaggattggaaccaagcttttcttataccagtgagtgctcatttgtatacacaactatgggatggtagctcccccttgggtaagctagaacaagtagtaatgtgggtgtgtggaactctgtagttgatcttacgacatgttttatgtttattatccatttattttcactaacctcttcctgatgatattaaccaaacctcgaatttacaagaaagtcttcttttccaagtgtgtttcaactgcctttcattgtacctactcaatactactctgttgttgtataaaggaccacctgatagaaaagctacagaaatgaataaaatgaaaaaatgagtaaaacacttttgtccaaaagtacaacaatataagcttcacaacaaaagctataccaaaagaataaggtgtttgtatgaggaactatgggggatggcagaatatggcaaataccctcagttatcttaccaaaacaagtacttaaaggtattcaaagagtggtagaggtcattttcagttagcatctggatgaagaaagtcaggggacaaaaagtcttgtattagagggcatatgtgagacagatgtttatctgcagggtttaactcttttggttaatctctactccagtggtctgaatgtaggaaatagaaaaggataagcaagtgaagactcagaaattccaatggaggccaactgaaaagagagggagagtacgggatggagagaaggtgagggggcataaaatggaatgggtagagatgtggatgagggaggaagaagttaaatggctaaggtgtggtaagaagcaattataattaacttttaaattttattttattattatattttaacttatattttaatttcaggggtcaatgtgcaggattgttacataggcaaacttgcatcatgggagtttgttgcacagattatttcatcacccaggtattcagcctaatacccgttagttatttttcctgatcctctcttaaaatttaacatctggggtgggggcctacaatgtgtgcgacaatacaataagcaagtgaaaatgccaaactagaggagaaagctcacagctccagaggtgaggtggaaaacggttgaaaggaaaaaattgaatacattgttaatcacacatctcttctttgtctgtgacatcagcatttgctaagcattaaacaccacctgtcttaaacctcggcaacaggctgtttgctatacctccataggcataggtagaatcactacattattaagttcccaaagtccttgtcaaagacaatttatgattctggcagcccccaaggagaggcagttttcttatcttgtttaagcagtgctctctgcttaatcctttctgtgtttctaatgcacaagaagagctagtttcctaaggagtggatttggtccactcaatttttagataatttttccttctggaaacagtctcctttctgtggtaatgtttgaaatgggtgcaggaatgagaattttagattgtttctaaaaggcttgaggaggaaaaacatatatatccaagaatcattaagttttgaatctggattagtctgacagttacaaggttctaggactggtgagttcattgtgttacaattgttacccatacaaatttcaaggtccctgagactggtgagaacaacagtaagactgatgattaaaaatttaaaactattggaagatggtacagtctatgagtataaggaagggaagaaagtagttaataaattgattgcatgaatagaaacaatgaatatttctatctggtaaagcattttatatgtattatctatgtcatcttcacaacagtacttcaaagaaaagtcatagtgagagtcattggaatttggataaaatcaaattaggtgtaggtggggagataagtttcagtcccaggtcttctgatgcaaaggcttgtttttctttcattttacattacctctttagtaagttaccaagagaacaaaggtgggagatcaagtaatgagtttctgctgtgtcattgcactggcacactgatagagaaagcctgacagtgtaaaataggacagagtaggtgaaataagtggttggaaatggtaggatatatgcctaaggctataacagcagacatcaggacagcattgagaattggaccaagggcctaagcaaacacatttcattttacaagttttactcaggcagtacctattaaatattggtgagtgtattgcaagagtattcctggaatcttcttggactaataatattaaacatgtcaataatgttattcgaacaaatgatcaagctagggaaatagcacttccatggtattggccagcttcctctcttccccctcactctagccatagagtcagaatgggagatttatctcttagcatgactctgatttcctgatcagagatcagcaaaggaaggagtgggccccttagccattgtgggcaactcctagaaaaacacacacatacacccctaggcattcctttcaggttgccggagacaggatggaagatgtggggaaggagtccttgctacattcaggtccctagtttgagggatttggctttgttactgcccttcctctggcttggttagattaatcaacacttcccaaaggttctatcacttatgattaaaagtaccctgacttatataatgaccaaagaatttctggatggaatatttcaatataattcaaaggtaaatgatctttgttaatttcctattggatatgtgtttcagccagaatgaataatttacatatttgattaaattcaggtaaaatgtatttcaaatactatatcacctagattgtcttatatattgctcatattttaaatatctgcctcctgaacagaattttggggttttcatcatagggaagttagataaacaacttatattctaaattccacagattttggtaatcctttccccgtaaaataaataccactgcatttagttgctttcttatgaaattacaaaaggcagcataaaacgaatgcataattttaaatataatagctctatgagagtattgaataagtaatattttcttttcagatactagtaccctgggatcttttaaataagaaaaacaataatacttttatcatagactgaaaaactgttactcttaaagattgaaattaaaaatggtaaggtgatttgagagttagatggaagctatttagttccttgttttttctaattacacactgcttttttaaactcagcaagacagtttacctttagatgaactccattcttttgtcctcagagactagacatttatgaaaactaggaacaagggtccccttagttaagtcatggcagctctgggtggaattcctgattattgggtaattgtgcaactctagaataacacagaacagttcatcactgtgaccttcaagcccaggagaaaattatagcacaatgtggaacattttctcccatttagattgactttaaaaaatcactctcctagttgccagttgcagaaattaacaaaaatgtgcattatttgtatgtattttaggaaataaatgccagaaaatgggatattcaaaaaggtaaggcaataggaataggttcaagcaccttaaactacatgaccagatgtggtgagatttaactaaaatggttgaatttgtctttcatttggtattaatttgttttctagccaataccttttctcctatctccagagagcagaataactgtctaagtatagcatttgctatgttctgattttgcatgcctgctctcttaattccaggtgagctgatcgattgcccacatttctgcaagtaccaggacaaatcctatgcctaaacacaatcttgcagtagatttggctgagcaatgcagggtaataaaagtaatgaggccattgaaatccctttagctttgtgctgatgcctggaaactgtcatttattttgtagtgcctttaattgagagaggttttttttttttaattccacacagtaattggtactacatttttttctcatataaaaaataataaagctatatatcttgcttcctgactcttatcaagcattggtagtttttgatgtacaaaatattttatttttatttattttggtattcttgtcacaaaaaaaacttaaagatattctttgatatagccaaaaagaaaaaaaaagataaaggccagttcttgtgacatttatatgcatgaaaaattgcaaacctacctccttcaactcagaaatattccactctttgcagtgcataacacagactctctaaatataggtgaataataaatgtgcatcattaataattaataggattgtaacaaaatacagtatcagcataatcttctaagacattaatggctacacgttgccactttaaataatagcatgaaaggcaatggtgctctctgatatggatttgctatggtaaatgagtttgtgttactgtatatattttgttctacatactgagttatcaataatcatcttcatgcctctcaaacggtcgcacaagcaggaaaggaataattgctactcttcatggagccagcttattgatgaggtggacacaagtaatatttttagcctgctggctgtccatctgtaaggagtttcctggagctgtcacttctcctttctctggaaactgttatggctttgtctgcccaagggaaataatgagatccatctatcaagaaaaaaataaacaataaactctataccttccaattaatttgttttcacctatgtttacccaggtgcattcagttaaccatccatcatgttctatgcatgtaaagaagtgcatttttcaaaaggttgaatccattaacccatttgctaagtaaatatataggcaccctttatagctaaatcagggacttgtaaaaatcaatctttttggagagctcataaactctagctctgtcttccctagcatgcccagtgttgataaatctgcaagcttaatgtgaaccaaacaggttgttctcattcatccctccaactacatgtatgtttctttttaaatttgtctttgattttaatgccaccctaacattttcagaaattggttgaatgcacaacttaaatccgcagcttcaatttgattaagaatttgttaacaacaatttagtgggaaatggtagtgtatatcagcaatcaaatggcatctttttctccttctccattaaaaagtatatatttttcgaaatagaagacactaaaaaaatgactcaggcagtaatttgttcataggattttgctgacatttataaactatttgagctttactgctgccttgttgctggcaagaagcgtcagcagtggaagtgttcctggagttaaatgccctcctctttttttttttttaatccatctgtactatcaaaatagacagccactgttaaataaacacttgtcaaatgctttaaaaccatgaagaattgtggcagagtatgctcaaagtccccaatttaaaaacaaccagtgttccaggacttcatttgtaaagagagttgtttgaaatatagaacctaaaatcctcaaaatggtggtaaaatgcccagtttaatgcactaggagtatagagtatcagagatttaagattatggagtgacttacccagttcttgcttaactcaaccatttgttacagatataaggaaaaagaaaattaggtatttgctcacaagacaactgcaaagaaaacagcagttgtaatcgtgattgtttaaacaggaacacaatgagattagataatagttatatttctacctagaaagctagtacttagagagaaaacaggtttccttagagaaatatgaaggaaataattgtgtttaggaactctgaagaaaacttctagaaatgtttagtgactgtagaaattgaaagcattgtttattatgtgacatttaagttttgttttttttttttttttcggttttaggcatataactcagttataatttctatagagaatgagaaaaagcttatagaaaaagcaagagggagtcatgaggaaagaaagaaaggctaaaaatatacaataattagaaaaattatatgaagaaagaatgcccatcagaagcgtgagagtgaaagtatattgtgagattatttagcaatgagtctagcaaatttagccatctattagttcagagacattggacaagttcctgacactcttaagcttcttagagttccgtatgcctctgtttcttcattgcaaaacacatccaatattagtaggcacctcataggcttgttgtaaggatttctgggcacattgcttgccctcaataaatgttacttataatagtcaacatctaattcatggttaaatgggtggtcagaaaacaacaactggagagccacactcagtcacctgttttttgtatgacccttgagctaagaatggtttttatattttaaatgaatggaagaaagagaaaaataatattttgtgacacattaaaatgatatgaaagtctattttagtattcataaataagttatgtcagaacatagcctgctcactcatttgcatattgtctctggctgctttcttgctaccgtggcgaagtttgctgtctgtcctgcaaaatctaaaatatgtgctttctgttcctttacaggaaaagtttggcaccccctggtttaacaggacacatttgagggtgaatgagggtactattaataataagttaggacaacaggcataagctgagaatatattgggcaagccagtaggtttgatcaccctccatatattatgcacaagaagaaataaacatattagaatggaaagtggtaaaaaaaaaactgacaaagaaaagggagcattttgtgcaaatgactgcaactaggaaaatttgttaaagtgtaagtcttacgttttatctccttgtgttaaatccactatcaataccaagcacaagtagaataatatccagacccattctctacaagcttctatgtaatcccatccttacttatgtcttgggcaccttctcggacagctttctcctttgttcggttatgctatagtcacactcacttttctgttccaataagataccaagctggtcactatcttaggacctttgcaaggctccctacctgtaatgctcttaacagactttaaagtctgacccttcaccttatctaacccttacacctgtcaccatcctcccttccattatcccatcttattatctctttagaactgtcgctctcagaagcgtagaacctaagctccacaatagcagggatttttgtgtgcatagtgcctactacagttcctggcacagagtggatattcagcacatgtgaatgcatccgcctgactctgttgtattattgccactccttttgtgtcgagtgcttcagaggttccatccactgctcttcacatcctgagcttccatttggtctttggctctaggttggcagttcagcattcatacaaattttagtcttgatctctgctctaaatggactctctgggtacagaatgtgacatctctttgtttttttcctcccattttcacattttgctcctattatctttgcttatttgtgtctagagctaagcagcccttttctgtcatggtgttcattattttatattcttcatataatggagaagcagagtaccttgtgaaacaaatagtttccttgtagcttatgctgcattgttttcaatttttttgtctatgagtgtttccaaagttcgagtatgaactacttgtgggcagaggccatatcttttaaactgtatttctttgtacttagtacaacatcagagcaggcaaggatgtgctctcgagaaatatccctgaatgaggagtatggttaactccactgctgtgtgggctaatggaccaagcatcagaagagacaatcacaatcacatttggctttcagagacaccttgatcctgttatgcctagggcctatgccagtcacaggtgtattttattggcattttcgtaggtgcttgatttgcactctcagagcacgtgtaaaccagcctgaatcaaattagcctctatgcagttgttaacaattgattgcagagcctgagaaaagaggaaaagtttcttgtatataccacgtcctccacccagctaggattgaagctgcatagaaaagagaggagaagcataaaaaagcacaggttggggcagtgaagtctcatccagccttagcagatacaagcagaaagcctgtgttccattttgtacacatttagaagttcagcttaacttcacagtttccagaaacagaactggaacaccgttcgccaaaatgtaagttatgtctgccatgtttaacatatttgctataaatccattgccttgaatagtagagaatatttattgcatgaaaggataactttttccttgtttgcttactcatctagtaaagtttagcagactaggtacaacttaaatttcatcgtcagtgtttaattataaaactttaaggtacagctttaaaaaatataaaacaatagaaaaattggaaaatatgcaacacaatgttctttctgtgatattgtcaaatgctttggcataaaaatattcagccactaaaaataaaatgtcatccagcaatggaaaaatactacaatacgagaaaaaatgatggataaaaaaagagcattgctataatgattaatgataatatggctttttattttaagtacatgcagtttaggagaaagctttcagcatgtataacatgttgaaaataagtgttcatgtgatttgatcaaagggctccaatctctgagagacagtaaataatacagtatttaggaaattgctttaaatatttatttctctgattggctaagattgctcacaaattgcagcatgttttggatattgtaaaagcaagtctgaataacacatgcatcttgaagataaataggagtacaccaccatatatgtgctggagttggggaaaatattctcagtaataatgacattctcaaaggtgtttttaatgattgactcctaaacagtttacaatgttattatataatcttttttattaacccttacagctattttatgggaaaggtgggaagcaaggtatcttttcaaaactttctcaaaaagtcttcaatttttctctttctctatatttttatcaaaaattagacaatgcatgtgattctgtagggggattccatttgagatgtaatttaaatgatggaaactttcttacactatgagtgtcttatgaaaaggcaagaagtcttggtattcaaagagagtaaatgcagaactgttcaaatattccttccctctctacccttttgatcctgtcatgttttaacaatttttaaaggtgatttaaacattgggggatgcactacccctaagcactgtctgtttttagagtactcatactgcttagcaacctttgacaataagccataccaaagaagagatctagtatgaaaatctcagaagtgagtccacaaatacacatcaaaaatagtaatctccagagcttttaaaaaatactttttcacgtaagaaaacttagaaatgatatctgtaattaatccttgccctttaaaaaatgttcttcattgatttatcattcttaagatgagcaaagtagagctagagataagagaatggagaaaataacaaagaaaaagaatgtgtgttttaacacaaacgtggtgcagaaactgagatatctttagcaatgggaacatttttctaccaaccaaataaaaccaatgttatacttttaaaaccgtttctttcaatctgttgctcaagtaggcttgttcattacaatgatacgtaaatataaataaaaacttaagtataaacgtgaaatttgctaacctatttttttcaattaagtttatggcctacattgttttgtatatttaatatagtgtttaagattaagaacataatgttttagcataccttcttaatgatggaaataccatttattgttatataaacccccagtataggacattttgttgatattataaatattgtgacaatgagtagcttcatgtctgcgcatttgcttatgtctcaaaaatattttatatttccctagaatagagttccaggaatagctgatttcagtttttgttgttgttattgttgttgttattttgagacaggatctcactctgttgcccaggctggaatgcagtggcacgagcatggctcacttcagccttgacctcccaggctcaggtgatcctcccaccttagcttcctgggtagctgggatgacaggcatgcagcagcacgcctgactaatctttgtattttttgtagagacagggtattgccatgttgtccaggctgggctcaaacgatacacctgcctcagcctctcaaagtgttgggatacaggcgtgagccaccatatctggccagattattggtagtgaatcctctctatgacttttgactgataattccaatttctattccaaaataatttttatcattggcagtgtgtgatagtacatacttagtgggtttctctatggtaggcactcttgtgaatgaacttttatgtaaattagcacatttaattctcagaacaatttttaagatatttggtattatcaggctgggcgcggtggctcacgcctgtaatcccagcaatttggtaggccaaggagggtggatcacgaggtcaggagttcaagaccagcctggccatctctactaaaattactaaaattacaaaaattcgcccggcatgctgatgggttcctgtaatcccagctacttgggaggctgagacagagaattgcttgaacctgggaggcggaggttgcagtgagccgagatcatgccactgcactccagcctgggcaacacagtgagactccatctcaaaaaaaaaattatatatatatatctatctggtattattctcattatggaaaaaaattaaagacttgaatttcaagaaattgaactccagagatgagatgtaactggcccaaggacacacaattaataagtagtaatcaaagtactatgttttatgtcttccttaatattagacaaaataaagatcattttgtgaagttaacaggggaataatagctctatgttgtttaaatctcatttaattaaatgatttaatttagtcattgatcactgatgagactactagttctttcaatctttctttctttcaccttctcttttttctactggattaggtacttacctcatgaatttgttgtggggagtagaattaatatatgtaaaggattagcccagtggcaagcatggtcatttagctattcaatgaatgatagcttttaatactcttatttttagctagttactgagagggttcagacaaaaatccagaactatatatttggtttagtaattttttctgttatataaatctttttctcattataaaggaaatcaatcctaatttagtatatttatttgaatatataattgctcctagaagtagcacaaactgacataattaaatgtgatttcaggaatggaattgagcagtattataaactgtttaaatctttcatccctggcaataaaaatatattttagcacacaatgcaaatatatgtgtagttatttatactgtactaacatattttatacttataaaacatataattttttttttttttgagacggagtctcactctgtcgcccaggctggagtgcagtggtactatctcagttcaatgcatgctctgcctcccgggttcacaccattctcctgcctcagcctcccgagtagctgggactacaggtgcctgccaccatgcccggctaattttttatatttcttagtatagactgggtttcaccatgttagccaggatgttctcgatttcctgaccttgtcatccgcccacctcagcctcccaaagttaaaacatataatgttaacttacattatttacatatgattacagattattcacatatagagtaatattttaaatacttttcttatttgcaaatattacaaaaatatttgtgcttttgctaaaaaaatgtgaaattttgttttgggaataaccatattaaatgtgattagatagtcacaatttttaccttgtattctggctggcaagtcactcctaacctcccagtttctgtttcatttgctttacttatattactttcattctgtgggttttttttttccagaaacattttaggccatttttgagggtgagattagttaaaactagaaaacaaaatctccagatctatttctctaggcaacggtaaactgaaagatgtccagatatgctagactttaagaaatccactcttttctcaaggtatctgtatgtggtaacatttgacatctgggccaagtgaacaatgccaatttagatatgaataatatataattatagtgtcgtttttgttttaactattagccactaacagcttgcaacagtttccagtgttagcagcctaggaagaaaaatactcttttatcttgttttctgtttattgcattctctgctacctctctttcaggttttataagagggtatttatggctgttgcacctgtgactttggttgttcctgctgggttatctgcctggtttcaaccaattagttgtctatctctgggcttgaatctggaggtttatctatatcttcaatgtgtagtaggccctggtactgagttagctgttctctttcaatgaacagaagagtggaccatgaaaatcccacagattgacttttatgtgttcatattttctgtcgtcccacaagcactttttctcacaatgtaacacaaagtacagcctcttgtttccacaaaggtaaagattttcacagtatttcatttagctttctaatctaacgcacctgctttctcttttcttcatctatcagaaaattacacacacacacacacacacacacacaacactcaacaaactgaaaaggtccagtgattccacttgatttattaaaatatgcactcactagctgcctttccatatgtgacatgcacgcactgcagttcccgcttacccaggcctatgaaatgctaaccctgtgctacagtctgaatgtgtcccccaaaattcatatgttgaaacttattgatagtattagatggtggtgccttcaggaagttattcactcatgggacagagccctcatgaataggattagtacccttataaaagagatgtgagggagctattcgcctctctgccatgtgagaacacagtgttcctcccattttgccctatttctgccatgtgaggatgcaacaagaaagccctcaccagacaccaaaagttggtgccttgatcttgcacttcccagcctccagaacggtaagaaataaatttctattgtttatagattaccctgtctcaggtatttttaaaggagcacaaatggataagacaaactgtctcttccattgtatgtgcagtatttctctgtttcactgggatgttatttatacacagttgcatatttcttctttttaaattctcacacttataatattttaaataccaaacatgtaattaaaactgcttctgttgtctctattaacatgataaatatgtgtatccataatatatacacacgtagctatagatacataatctacagttatatacataactgcatttctcaagtgcatgaatgtctagatggggagattaaagagaaggaagtggggaacaacataagtcaagctagagatggcttaattttgtgccatttgcacctctgcacaatctcaactttttgaccactatctccaggtctcaggagagacctggctatctaaaatatatccaggagagacctggagagacccagatatataaaatatttacctcattgagaattatgtataagggttaacttcttagtctgttaacttcttagtctctccctttttagaatttttctttttccaaattatagatatattttgagcctactgataattacattcatatttctgtttcctgagccatgttatcaagcattgcacccattttgttctcctctgccatttgttgtgtctcttctccttttctggttgtggctcctgactgcactggcaggaatatgcacagctttagctaattaattgcttctgcagagcagtaaagtatacttacctagagtgcacttccagaaggcactatagagttattggaaaagagttatggatcttgattcatagctcatatatgcatatgcacattagaattagaatttagtctttaaaaatagcatgctaatgacctctcagcaataaataggtcctgagaccattataaatttgagaactagaaaaggcagggattaattgtaaaaataaaattataacatatgattcagccatatgtgtttttatgtaaaaagcttgttatttagaataggcttccttttgcttctgtaaccactctaataaacaggaatgcatataatccttttagtgcagagcatattctaaggatactatctcaaaacacattgatgcaatttgaaagtatatttcaatttgctgcgtttgtgtgtgtgtgtgtgtgtgtgtgtgtgtgtgtgtgttaaaagcagcaaatactcaaactcccagcttgagactatcttaaatgcagtatgtttttattcgtcaatctaacgcagctttcttaggccagaagagaatatcctctctttggctgacatgtgaaatgtgacagaggtatcttgtaatgggcattttccaagagcatcacatggtaggtttctccctagattttaaacctgttttcgtgtctgctactcagttccttttaggctcttccaagttcttctctctggagtctgaagcaggctacagaacaggtgggacattagtgtgacagctgggcacccttcctagaacagacccagcatggataacattatgtttgaatcacatatctctctcgtactcaaccctctctaagaaaaacactggtgtgggaagcatgatatctcatcactttgtggagacagttctcctacgtctgtctatatttatttcttttgttcctgcccttccttttcactccacagtatttcctttttttgaccacattccattatgagaaaccctgattctcatagcacctcacttggacggactcatatgacagcagaataaatgccagaaatagaagtctgaggaccagatatctaattaccacattacaataagaatctctcaaatgaaacagaacacaaaaacactttgtactgaaatgtatttgttgagcatttctcacaatgaagctctcaagttattgttttttgaatagcaaggccttaggttgtattcaatttctctgtgtggtatagtggtaaaacatcagtatgataatatactacccctggtttcaaatcttcattctgctactgactagatatgttttgtcttgaacgtacaaattccccagttataatccaagaatgatgacttcacagggcaaatgtgtggattaaattaaatccatccatttagcaaatatgtattgggcacctattttatggcaggcatgtgcatgtaagtgttagaggtagaaatgagaaacaaagcaaaatctagtgagggaaatgggcatataaggagagaatgacagtagtgtatacccagcactgttctaaaagcatcacatctactaactcatgtaatccataatataactttatgaaatcagtactactctgtttatttatggaagaactgaggtatgtagagttttaataacttaagtttatgtagttagtaagtggaagatctaggataaaaacctaagcagtctggttccactacccaacctcttaaccacactattaataataatgtactagaaacaaataaatgagaaagtaaaagaagtttgttttagtagctcttgagttagagaagatgatataatgtataatacactcactcattattcatttcaataaatgtttgttcctattttttggtgtcattgagatcacatgtaatattttacattttgatgaaagacataaaataatctaggcaactctatttcagccaatgattatatgacttttttttttgagacaaggtcttactctgtcacccaggctgaagtgtagtggcacaatcatggctcactgcagcctccaatttctggcctcaagtgagccttccaactcagcctcttgagtagctgggactacgggcatggttcatttgtacatttcattaacgtactccagacatgtgcatgttccatctttgcttgtattttgaggagctataggagagcctagccgtggctagcagagcaagtagttgggttggtggacatgggcagtgttgaataatctttttcagcctaagaaaaatgttctactgccctctgagcttctgaatttattttgaaggataatttaattataaaaacggggaagggaaccagcaaccaccgtaactacaccatatgtcttttgaagagcgatatgcctggaaatccagcgataagaaaagaagtcctttcccaagaaggggccttctgagagatgaggagtggatggtagactctcgagcacaggtcatctgtttgcatcagcctcagaatatcttagagtagaatccttagctgattggtcaggttttgctcttgcaggtactcctcaaaacattttagctcctgtcagacaaagatcacaattttttttgtttcctttttaaagtctattccgtacagggatcactacattttgaaaacctctttggttatctgttcattccaggaattctgagtaaccattctgtgaacagttgcccaacatatcatgtttctgtattttacttcatatggcatttcatctttatcactcaggttctattaaactttattacctctttttttaacattttctcttagaaattgttcacagtcaactcaattctatggagcagtcacctagcaagagttctgcatgtgagcatatcttcattagaattgtcagttaaaaatccctgatttcaggagaatgctgagtgagaggctgggctattggctgccttagttaggacgttcatccacttggggcagccggccagtgagtctggctagagtcattactctaatcaagagtacgcaaaatgaacctggagaccagtcattcaggaaagcagcctcattctgtttttataattgggtgtgaattttcaattgtgtagtccagaggagcacagggggaagacaggctggagcacagaagcagctcctggtgtctaattagacaggtgacctacagcaagtttcagattgggtttgttgcttccccagtcccagctttcctgtggagatatggctcaagtgtagatgaatgaatgagggccatgcatagaagtgatgttgctaattttactctttgagtcctgctagcaggtgccacctgcctcaaccaaggacatctcttgatggctactggagctcagcagccagcctggaggcatccttccccttctggaatttatgccaaattccagatggtctcttataaaggctgacctcagtttctatgccagggtaagctgtgacaagtcgtgattgtgcctgtcatttgtgacgttttatacttacactgaactttgtcaattctatggtacaaattgtcaccgagctctggtttaggaagcaggagagctatgaatgacttattttaaccttattaattagtctctacatacattgtaccttcggccacaccactgtcagcacctatctttcctttgcagttaaaagtttacatcttgtttgtatcttctcatctatagcagtcactgctatattcgctgcttttcttcagttaggccacttgtgagcttttgttctatttatcttatagacattttagaaaactaatgaatctgtttttgtccagagcatgacttccagactgtcgcctctattctggctatgcttaacctctgaccaagaggcacaggctgtgtgtataattctttacataatgcactgacttccaacctacctgaatcttgaacttgcttttactcctgctttatattcctcaaacccagttaaattcttccttctgcatctggttatacttggatagaaacattaccagccagtgtgaattgagtattcctcccacacctcatcctaaactggcactggcaataccaaaaacccttggcatttagctcatggctttctgtcctgagaggcagtcttggagtggattagacttggacaacattctggagccatattcctggggtttgatttccagctttgtccatttctccagtttattctgactatcacacctaagttcaaacgcctttgaatgacttctattgcccattagaagtttcatgcaatttctatcaaactaccaacatcatctttcacatgactagaaaaacgattccaaaattcatatggaaccaaaaagaaggctgaataaccaaagcaatcctaagcaaaaaggaccaagtcggaggcatcacattaccccacttcaaactatatcataaaactacactaaccaaacaccatggcactgttacaaaaacagcatggtactggcacataaacaggttggaagtgaatgcattgtataaagaattatacacactgcctttgcctcatggttaggggctgagcacagccagaatagaggttataggctggaagtcatgctctggacaaagacacatttattcattttctaaaacgtgtaaaagatcaatggaacaaaagctcacaactggcctagcggaagaaaggcaacaatggaacaaaagagagaacccagtaataaagccataatctacaggcctctgatctttgagaaagtcaacaaaaataagccatggggaaaggacttcctattcaataaattttaataaatggtgctgggaaaactggctagccatatgcaagagaataaaagtgaactcatgcttttcaccatatacaaaaattaattcaaaatggattaaagatttaaatgtaagacctcaaactataagaatcctagaagaaaacccaggaaacatcattctagacatcagactttggaaataatttattattactaagtcctcaaaagcaattgcaacaaaaacaaaaattgacaagtgggacctaattaaactaaagagcttctccacagcataagaaactatcaacagagtaaacagacagcctacagaatgggagaaaatattcacaaactatgcactcaacaaagatctaatatccagaatctgtaaggaacttaaacaatttaacaagtcaaaacaaaataacccctttaaaaatgggcaaaacacatgcacagacatttatcaaaagaagatatactagcggccaacaaatatatgaaaaaatgctcaacattactaaccattagagaaatattgatcaaaaccacaatgaaatactatctcacaccagtcaggattgttattattaaaaagtcaaaaagcagtcaatgttggttatgctgcagaggaaagaaaacacatatacattattggtgggaatgtaaattagttcagccacgttgaaagcagtttggagatttctcaaagaacttaaaacacaagtaccattccaagtagcaataccattattggatatatatccgaaagaaaataaatttttctaccaaaatgacacatgcactcctatgttcactgcagcacaatttacaatagcaaaaacatggaatcaacctaggtgcccatcaacagtgggttagataaagaaagtgtggcacatatatgccataaaatactatgcagccattaaaaaataatacaattatgtcctttgcagccacatggatgtagctggaagccattatccaaaacaaattaacataggaacagaaaacaaaatatggcatcttctcccttataagtgggagctagacactgggtgctcatggacataaagatggggactatagagttgagagagtaggaaatggggaaagactgaaaaactaactactgggtactattcccactacctgcataagagattatttgtatcccaaacctcagcatcacacaacatacctgtgtaacaaacctgcacgtgtaccccctgaatctaaaagagaagttgaaattattttaaaaaataacattaaaaaataaaaagaaaagaaatttcattttcccctgtcattctcaagcctccgcattaagccattattttccttccaagcgacacaaaccatttctttcctccatctgccccttatgccagacctctaggccactcactttgctctctacaacatttctattcgtaagctcctgcctgaatggcagactcactctataaaaatgctgcaagttccttgatttccaagaaatatttcaaaatccacttctttatgaaatattattttattcacccaagttttatttctttcttctttgacctgtgtacccctgttgttaactcacaataatataccttgcattttgttattcattcatttttttcattgatccttgctttcatggaatatatgtccttgatttatcttgatacccagttgaattcaaggttccttaaatgactgagactatgtctctatcatttttggaccatttatactgactatgtttggtcattttccttaggaaatagactctgaaatggagatttgcttgcaggtagatgatttagtcctgttggaaacccatggagggaagcagggttgtgaagaagtagaacaaagatgaactttctacaaaagttcagtgatgaacattgcagccaattccacaaggaactctgaagcttggatgggcggagttgtaacctcaaagaaaacaattccccgggagattcccaaggactcagccctttgctgtcagcagcccacacttccagcagcttgaggaatgaatgtttcagtcttgaagggaggccggcacagcgtgccatctcattcactacacaagcatagagccttatacgtggccaaagttcagtaaatatttgctaaagtatatttaaagtgattcgtgaatgtcttataacttctgataaagtatatttaaatatctaaattattgtataatttattaatgcacctaattagtgctaggaacaatttgctgagctatgactgtttcttggagtgactctatgtgagagttctacaaagagtcatagatttccctccccagctgagagccatgattgagactctgttaggctttaacctttccacaataggtatttggacacttatattttaaagttaaagtcattaatattacctacaacactttctacccttctaagttattttcaggttcctaacaaaatgttgactaaaaagacaaatccctctgaacctcatggccataggagccctgacactctgtgaagcatataacatacgattaaataaccctctagcaccatgggtcctccctgctcccccacccccaccgggcaggggaggattcagattttatggggctgaaaagctaaacaattgggggttcttagttttaaaatgtaatctaaaaccatttcccttttgaatattttatgaaacattgtatttggggtctctacgaactccaggtttgaggatatggctaggcagacataggattcagcatttaattgtactcacagtttcatggctatgatttattacagtgaaatgatgcaaggcaaaatcagaaaaggtaaaaggttcatggggcaaagaccagaggagaccaggcacaaactttcaagaatcatctcccagtggagtcacacaggacatgcctaattcctcaagattgtgacagggatgaaatgttgcccaccaggaaagctcaatagtgactcagcgttcagggttttttaaatttagagctggtcacccgacaccttctgcctggcatgtaccagaatttcaaactctcaggaggagagcaggtgttcagcatatattattttgttcgtaaaattattttgttcgtaaaaacaggcacagtgagccaatcttatcattttgggaatggtgggacctctcccaaaatccacgttctcagataaacaccaaaggccaaccttgcaatcaggctttttcaaggacagcactttcagacttgctaggttaactcctttctgtgtatatctgcacctttgcacccattactaggggtcctcccaggcagggccttggaagggctgtgcaagtgagggatccagatggtgagcctttatcagctccagggtaagtgcttctctggttccaaccatactgacacactttcaataccttaatgcacttgctttgcatgtgctagtcttttgtcttgagctattcttgctctttattctcttcttcaccaaaatcttaatccttgtttagctttcagagttacaccctcttggaagtccatggaactggtgtttctgttttatgttgctttctgctacgaacccatacggaatacgcatattccttatcatagcactttacatagtgcatggtaattactttagcattttcccccatttccccatgaaatctgagttccttgagaacaaaatctatttagtcttcacgttttattcatgagcctagcattatgcttgacatataacatacttacgttaatattagaataatgaaggatgaacgtacttactagttttgacaagtgttaccacagcactgcagttagtcctgtgatagatatttatttaaatatcttgggttaaattgaggcatgtgttaactatcagtgttaatagtatagtggtatcagagaaaaacttctgttattgtcgttaagtctataaacctattggaaaacttctcctaccagaacataattagttaaaacatgagtaaaaaacagtcaaagaggagttatgtgtcccagatagacttgccattgaaaagttgggtagattttcatgcaactatatatgctataaaaagacaactgcttcttatttggtaacattgattaatattatttttcaagtctgtgcatataagcatgatatcttaattgacattaactagagttaaattaattgtattgttttcagaaatctctgaaatctgttactgaagtaggcattattaactttgttgtcattattttaaaatgcatttcaagatctgcaatcacccaagccatcctactgtgaattctaaggctcaatgatatgtcatacattgcttctataaaactttaggaagtatgttactttatttatttatttatttatttagagacggagtcttgatgtgttggccagcctggaatgcagtggcgtaatctcagcacactgcaacctctgcctcccgggttcaagctcttctcctgcctcagcctcccaagtagctgggattacaggcacccaccaccatgtccggctaatttttgtatttttagtacagaccaagtttccccatgttggccaggctggtctggaactcctgacctcaagtgatctgcctgtctcagcctctcaaactgctgtgattacaggcatgagccactgcgcccagcatgtatggcactttaaaactgccactcttggcatatggaatacatgcacacacttttgtattctatattcattcatatatgcaaaagataaaagtggaaagaggaacaatctgtttattgtatatcacacaggcaggctctctgtgagattaacattttagctgcctaatgaagttgcaggtgactggtctctctgtaagtcccagcattggctatcagcaaaaattagaaaggaaaacatatttcttgaatctagtgctcatagttttggttagaaatagtctactctgaaagaatttacaactgaggagatgagaagagaatgaggattcagcagcaacagcaataaagtttcccaggagaatgagtattaaaaaagttgaggcaggatgtccactgtctgagctggaaatagtcttgcaattaaggagggtgaaaagaagcttggcttgagagaaacggaagagggagttgaggtgattgacgttccccaaggaccctcttcatttgtgtttgtttcaaggctttttctggtgacatagataattactggattgaaggtctctattttgctaggctgtttatgaggagattactaaacaaaagataagagaaagtcaagagctgatgaaggaaagtaatctagcctgtcttgctctctgctttagatggaacacgtgagggtgaaaaacagatcattgattccagttgatgtttataatatagaaatagcagagttatcctcctttacagaaatttcttaaatccattagtaccttacttaggtggacttgttcttgtttatgagattgttcacatgagtttgcggtcaagaaaggtgagccttctgcttttaggcttaatatttgcaaatccctgtgaaatttaagagcataaatctgtagtgcagagatctggagtcacgcccaggctctcctgtctgccagttctgtgagctcatataggttttacaatccctcatgcctggttttctccattgtaaatgggcaattataaacactgtctcagtttgtaacctgaggtatatgtatttaatgaagtaaatttaatgaagtagatgctgaataggcactttataactattttttagatgaatgtatataaagcacttactgcataatgcactttgtaaattcgaaataacagtagttaccatctgccatgttaaatgaaatatacttgagacatcttgaactttttcttgataaaccaaggccatcattctgagcatcagttactgttttgtgctgtagcacaatcaggagcctcctgtattgctggaatacattaggacaatttgtatgtaagcatgcacgtgaaccactcccacacatacccagtggcttttaaagtctttaaatctttttccattattattctaattttcatacatgtattttatttttgtcagtgtttttacatccgttttctcactcttctaataatttgctctgtatgagctgctgttagctctgaaaccatttgagagacttgatagaaatgtgaattagctcagaaggagcaacttcactggaagaaggtaaggtttcatgcacagtcctggcgacatctacttgattctccctgtggccttttaaaattactgatccctgggtttaaaaaattttatcaatgcagcagccaagtaaagtacaatttaaaagtttagtttttctcactggcaatgtgaattgccatatgccaaatttttaaattcttttttttttttggagacagagtctgcaaacatggcttactgcagacttgatctcctgggctcaaggaatcctctagcctcagcctgcctcccttgtgggaccatagatgctcaccaccacacccagctattttttttttattttttgtggagttgaaggcttcactttgttgccaaagccagtctcaaactcctgggttcaagtgatcctactgctttggcctcccaaagtgctgggattacaggcgtgaatgacagtgcctgacccaaatttttaaattcttaattcatttatatgcattatgaaaaactaaaagtttagggaattatttaaaataccttagcattgaggctgatttttcttttattttgcattctactccacatgacaatgaattgtatttttgcctcagtcctcataatttcattttcatttaggatatgtattgtgggaataaagtatagttcatttattgtcaggtttgtagcatggaactttctaaaatgggtctaagtacagattttgaaggtgtgaattaataaaatttttctagagaagcatttcatttccatatgtaatgtagtgtttctgcatgaatggactattctttgtatttttagattttacagttgttgcttttcatcaagatttggcctagctgaaaataatccctcaaagatttactgtgcagtagtggaagttaaatctatttttaaatcaacaagtgcttattaaaatgccaactttgtactaggcactgctgttaacattttacaaatattaacccattgactcttataaccctttgagatggatgctattattgagctcattttacagataaggaaattgcaatatagagaggttaagtaatatgaccaaagtcacacagctaataaagggcagaacagaatttgaatgcaggcagtgtaataccacagtctatgaacttaatcaaacctgagaattgtctgcatcaaatagcaaattgaagaactctttatctctacattttgtaatcctagtttaaagaagttctcttgattatatttaattactataacattaaatattttcaccagttttgaaaatagggtttttatgttacctaagacatattaagtgaacaagccaaaaatggctatgtcgtttttgtgtgtgtgtgtgtgtgtgtgtgtgtgtgtgtgtgtgtgttgcaattatatagcaagtaaaatggagattttgtttatttttaaatagtagattattggtttaaatcttatatttccaatatagttatttcattatttcttaagttattgaaaatgctggattatttttcttcttcctcttactatttgttcttatttccttattacctgtatgtgtctttactagtcattatcagtgggggcaaagaaaatagccaggcacagtggattatgcctgtaatcccagcactttgggagggcgaggcaggtggatcacttgaggtcaggagtttgagaccagcctggccaacatggtgaaaccccgtctctactaaaaatacaaaaattaggcgtgatggcacatgcctgtaatcccagctactcgggaggctgaggcatgagaattgcttgaacctgggaggcagaggttgtagtgacccgagatcatgccactacactccagcctgggcgacagaacgagactctgtctccaaaaaataaaaaagagaaaaaacagtcaaacttcaaattagtaaatttagacaaactatagcagaattggtgaaagattattcagtgtggggttgaaatcactaataaaaatatatttttttagatctattctgtcctccatatgaaaatataaatcatggtctcatttgtttctcctgggtatctgtgtgtttgtgtgagtttgagagagaaacaaggatacattataactttaaaagtatttatagcctttgataataaggtgatcaattgaagaaattaacagtattctagtatttcatttagctgaagcaagatatgctttaccgacttttagctatcctccttttttcctctttctgcttaggaattccactaagttggcatgtaaacagatcacaggctgtgtcagtttaaaacttcttgttctgggcatgccatttattttgctaagcctgtagcactagggagtattagcaaaagcataatttaccttatagtgacagtctcccgaaacacaggaaacctgcctttcttgtgtcactgagcgaacaaaggtaaagttaaaggtagtgggcagaaaggaaagaaagggtggggttggggggtggcatttggatggaaaaaaaaaaaagggaaaaaactttgtcctcagagagaaatggtgggtgggaggaagtagattgtagacctagatgggaaaggaagcttgggcatcaaaagattaaggatgtgtgaaatatagattaacgcccatgggagtctgactgataaaaaagctgggacaacaggtctcgctcagcagccctgagaatcaggcttccagggtggtttcctacactgggcgtcttgtctgagtttacctaggctaatatattttcccatctctccttgggactctacttctgtaaggggaagatacagtacaatttgccagaggtatttgctcagttattcaagatcttagacaaaaggctgtcttgttcctagaagctagaatgttagaattgagttagcctcttgcagtttcttctggatctatcagtctcaatatacgtgagttacagttttcattgttttcttacttaaatcattttgattgtcagagatatttttaaagatttgaatgtcacaggtctcacagtttcattttactaattcttgcttgtgtgtcttaaatattttttatcaattttccattttatatataatatacatatagactgttgctaatgttgtttgtaataatcccttgagtttatattagaccaaaaaacattgtaccaactacatttcccaattaaaaggaaaaggaaaaggaagaaaataaactgaggataattagcactttaactttatggccctccctgattgaatctagctctgcacacaaacacacacgactactagcaaaaacactccccccctccaagatctttatagaaggccttttatatcctcttccttctttcctgtatttctataaatgggaaaaatatgtttgaaacaaacatcctggtgttacaaatttctaacactttatctaataccatgtcatattaccagaaacttcagagaaatcaggagtccttgtagactaaattattgatgataaactaactcgcctgcataggtataaatcccaccatagtaataaaaattgatttcagggcagttagtttcaaacatttatttattcattggcatatgaaggtatagataacataaaaataaagttcctagtcttaaaaaagagtcgtttaatcctatattaaaagatttatattgcatattgactttcctctatgcagtttttacttggaacttttaaagatttttgtctgccacaggaattcttgatgactgaggagttttagttcttattttagttaatcctaattttagttattcatatgcataaatttcaaatcaatctattaatgtttgtcaaactgcagaaaatataaaacatggtatttctgtttagtaatgagaccaattttatttgtgtgtgattgttgaaatcaaataagacattttgaaataaggttatattactagtttaccagaatttttatgtttcattcacttaggttttacataaaatttgcattcatttttacataacatattctgtttctcctctttactagaattgaatggtattatctttagaatgtctaaataaagttcttatgtataatgcttggtaattactcataaatgctgttttctctaccagatacattttgcaaaagaatgttaagaggagaaaaacacttgcttattactttcagtaaaggatattaaagtttagttgaattttctagcagagtcatgaaatagagtaaatattaaaatatactatagtgcttattgaaaatattgggaatcaaaattctgacttttcaaggccaatttgcaatacaccatagacttattagtgccagaatttactttaggcaatccagttaaaacatgtcttattacaagatggagaaaaagaggccaaaagtattaagtttgtgagttggatcacatacaattacatattatgttaaatattcttagcaacaatcattaaattaaaagtctatcctcttcagtgtcttgctgagctttattaagattgcaggtattcaatagaacaaaggagtaaattcaatccacccctgcccttaaggtagagagagaaataaagccaatacagatagtgaataatgtgatgggaagggtattttaggaactgaaagaaacaggtaaataacccaagcctagaaacttggcgcatgggtggcatgatggaaaccatagcatggtggtgggcaacaggaagggaagggagacctgagctgagttttggactataaattattggcaaggactgcatctgatgttagtagtctttccactgtattcttatgctaaacatcaatgaaaatcaaagtgttatatgagttatttactacgtccttttttatccaattgcttaatgctataggctcttaatgtaagcttaatattaattaggcttaatattaatgcaattttctttaattctgaagtcattcaagtgtagacaggcatgtgagaaatttatgcaaaagatatgagaattggttcctaatatgtacttcaatactatttaaattgatgaacccatggtcttttgattgttttgttttccctatggactccatttattattcattcattgagaaatagaaatgtagacttaaaatttttaaaaaaacatttagaacaatagaataatttatatgcctgcttcaaatgtttgtttatgacacatggccaatataaaaaaaaaagatctttaatagagttctgagtttaaaggatcagtgtcacaaatttttagaaactaaatgtcaaatgaattctttctataagtcatcctttttattagattttctgtatgatatttgtatccaaataggattttacaaaatagaaatcaatccatttgcattgggaattgagaaatttacacacacagaaaatcaaacgcaccaaatatacaatttatacagtccatattaacaagcagtgtagtaggtatttaggcaagtgatattacctaggattaatatttagcatctattattttaataggtgatcattatgcctttcatacgtaacaactattatatctaaaagacagctcttttcaatatttaaaaatctagaaaacatagactgctttttattttgatttcttgtaaattcacatcctcatatgcctttttatgagactttatacgtataccaaaggaactatatgtttgtatacaaaatatttatacttttgaataattttaaattataattcaaataaaattcagatttttttattactagctgtgaaactttggacttaacatcactgaagattagtatactcatctgtaaaatgggatatttacaggattaatttataggcccatttcaagaataaaactaaatccatgcataacatctaatagagtgcctgatacacaataatgcctaattaatgttagctgacctttgtcattgttattattgtcatcattacttttttaaacataaaaaagtatcagtaagtattatatggcaattgtttttcttttgttgcaggataataatggctgttttagttttctctgtgttctaaatttttctaattttttataatataaaatttatatttagcaatggctgtttcatcaatatatactcttttactacttctttataaaaattttagttgatccacctatacataaatttcaaatcaacctattaatgttttcaaagtctttgactccttcctgttctatgtgaaattcagattagaaccagttctcaattatctgtagcaattggtcttggtctgtacagttaaagtacatgcaaaaaagacacaaatgctttctcacatgtgtctttcagtctaagaggaactgcaacaatactaggtccctgcaattttcatttgtgtactggccttttttaaagacactatggttacagagagcatgattttttcatggaattgcaaattccagcatggatagatcccaggatgaaaagcaggaaactaaagaggggacagattaaaaatgactcacaatatataacaagggttttgatcttgattgtaagagaaacaggtaccaataaagctataacagaaggtagagacttgctagctaggtagcatagttatatctagggtgaaggggaggtagtgattttagattatcccagatttctagcttgagtaacttggtgagcatttccccatacaagagagggaaaataaggaacagattggagtggattatggaaatgaattccctaagtttaggacattatatctcttgtatctcaggccagaacagtttattctcatgtattgccatctaccacataacgatttttcggtcaatgatggactgcagatataatggtggtcccctaagattataatactgtaattttattgtactttttctgtgtttagatatggcttgccattgtgtgacaattgccatacaggtttgtagcttaggagcaataggctacagaacatggcctagacgtatagtagattataccatctaggttcatgtaagtacaccttgtatgttcatgtatgttcacatgagaatgaaatcacctaaccatgtatttctcagattgtatctctgttgtttatcaacacaggaattgaaatttttttgtgtagcactaatcttatatttctgtagagcctgatacttttccaaagtgctttcccatgtgctacctcactttatccaggaaagtccgggaaaaaagggaaaacacgctccatctacttgtagaaaacaagtcttagagatcaaatgcatatgaattggcatgtctagaactgaagtcaagatcattgtgctttaatcactcaagaatctttttgggtaaagatgaaagcttatttgaagagaacatagcaggatttatgaagatcttttcccgtcctcatagaaaaagaaaaaaaaaatctctatgcttaaaaatttgctaatcttgctgagaaacccaaagagcattttctgctgaaaagtagtgcacagcaggtaaatgctgtaatgatatttactcaaagagcttaaaatttgttaaaaggagattcataccaggatcttagaagtcaacttctgcatgcattttataagtgaataacaaatgctgtaaatagtgtattttgtagggagaaagtgacatagtgtcatccttaatgatgtgaaagcaaactcaggaaaaggttttgtctttttaaaatagattttgattacatctcagcaaattattttatgctcatcagttggaattcacatttatgtggcaatggagatattttaatgcaactactgaattgaaataccataaatttttcagtggtttatttctgaaagaatgttgagaactataattttggcttaaaaaatgaaataaccctgaatttggcattaaaaaatacactgaatggccagtcaagaaccactgtagcaaataatataacagtatatatacttgcagagtatctatgtatttcagaactgggttgaggggcagaaaagttggaggataggtaggcagtggccctttgtgtttgtcaaagttagacttcggctcaaatcccaaatctggagatgcctgtcttggtggtcttggtgagtggaacacttttcttggcccctgtttcttcatgtgtacactggggatagtaatactttatgtggttttaagaggactaaatgcaataaatatttgttcatgcagaaatatgtaccaagggacaattatgtgcctgacactattttagatgcttctgatacataagtgaataagcaagtattcctgccctcctggagatcttatatgtgaagagctctgcaatgtgtctggcatcaatgggtaataaattgtagttgtgaatgagattatgacggcttggtaaatctatatttacttaaatggaggaaaacagtaattttagaaatctcttctacctcccatatcttctacttaatttttttcttagatgtaagtacaaaacaaaaggcataatattttccctactaggtaatgggctttcatactaaacagtatcagtatccttgctttttaaaggtaaaataactttcagatccctcagttttcatataaaagaaggatttgcattattataggtcactagtgttatattgatcaaatcactacttcagatttaaagaaattttcattctccaaaggctcaacatagtttcaataattcattatcataggtatcttcacatctgctccaagtgttgccttacccctctccagctcccaactcatataaaccttttataatgaaatgattatgaggatgattgagcttttgtgtttgaaatatgactggttagtaaactttggagtttgacaaactatataaatttcagtaaaggttcagttgacattttctgaatctatattcatggactggctctctgatttttttgagaaaccagtaatatcaggtatgattgtaagttgctggtgaaagcccaatgacgtaaaattgtattgtaagcagtattccttttggtattgatatttgtctcctctttttgttttgcctcatgtgaatattgtaggcatttttcttgcttgttgtttgtagacagtaactattaccaagtgtgtaacacagtttaaactcaaaataaatttaagaagtctagttaaaacacaattgctgggcatcactatagatctcatggacattaaaaggataataaagtaatactgtgaacaattctctactcagaaatttgataattatgatgaaatgagccaaatgcatgaaagacacaatctgacaaaactcacacaagaagaaatagacaatgaaaaatagtcttatattaatcaataattaataacctttcaaaacagaaagcaccaggccatgatgggtggtttctacaaaacatttaaggaagaaattacactaactctctatgatgtcttccagaaggtagaagcagagagaatacttctcaagtcattctttcagaacagcattatcttaaaaccaaaaccagaccaagacatatgagaaaagaaaccataggctaatatctcccttgaacatagatacaaaaatcctctacaaaatattagcaaattgaatccaataatatattttaaaaatgtagatggcacaactaaataggatttatctcagttatgcaatgctggttcaacatgtaaaaatcaattaatgtaaacctttatatcaacagattaaatgaagaaatatcatttgatcatataaatagatacatgaaaagtatttgacaaaatctaacacacatccataataaaactctcagcaaagtaggaattgaggggaacttcctcaacttgataaaagacatttacaaaaatcctacagctaacaacatacttaatgttgagaaacgagaagctttttcactaatatcagaaaaaaggcaaggatgtcctctctcaccatctcttttcaatacagtactggaagtcctagcttattcagtaagagaagaaaagggaaaaaaaatgtatatacattggaaaggaagaaatgaaacttcacagatgacataattgtctgtgtagaaaatctaaaagaattgacaaaaaacttcctggaactaattaatgattatagcaagttggtatgaccatataatggtagatatacatgtgtgtagagggtgtatctgtggctattgggaactctggtttttgttcagttttgctgttaatctaaaactgccttaaaaatagtctattaaaaaggagaaaattcaattgcgtatgtaatagtagggaaaaagtaccacataaacatgttgtatactgaatttgccttgaatgtcttaaattagcatgccttattagcagcggtagacatggatagttggcatacttcctttgggggaaaatgtgttagctatactctgataacatacacagctgacaatgccagttaacattccgaaaattttattatagtggaatatactcaattgttgtatcacagtggaatccaaaaatgtgtagcttaaggatttactacaactattagagagtgttaatactacgttgcattcgcatttttgcttttaggatttctttcagaataagcagtgcacgttagagtctcacaaccttaacagtagttgtaacaaagcagctgagtaacataaagttgccaaagatctgtatggcacaaaaatgtttgcagtagacagtcttcaaatgcccttgctacaaaaaatggtaatttaaaacattagctcacttgatgccaggagtttcagaccagcctgggtaacacagtaagattccatctctacaaaataataataataaaattagccagatgtggtggtgtatgcctgtatcccagctactcgggaggctgagacaaaaggataatttgagcccagaagtttgggctcaatcatgccactgcactccagcccaaccaacagagtgagaccatgtctcaaaaataaaataaaaaataaaccactggcaaggagctcaatgtggagaaatacaaaattgacatttatcttagaggtgtctttatcagtcacttgttaaccacttgccagcttacttactgaaaagtttttcattgttcctaaaagaattatttagtttttacctgctgaagacagtaatctctagtactgttgctttctgtggcaagtaatggaacctggtcaaaacttaaatccagaaaatactcactggatttaatgatttaagcagagtctatagaaagaaaaccatatttgatgtactgattgattacacaagatgttgagttgatttgcatatggtacattatttatcaacattgttttgttttacaaaagcatctagtaggatttgtgtgctaaaataaattctgaactctcatgtattatacacttaggtttacaaattcatatataagtgcctgaatacattatttgtctattttatatgttggcatagaaaactatattttcacatgacttatcttagcacaatagtgggaagtgttgtagatattacctacagttcctttttgcaaatactttatccttttaaataatatcctctgcttcctccagaaatgttgtgcaaaacatggccaacatggttgaagttaactaatatataaaattttcattggatctaagataaagtcaatcaccattgacaacttgaggggagagacactcttgcttacagagtatattccgtatataacaagctatataacaagttagatggtgtggttttcttgttttgctggatagttctattaagcaggcatttattgagcatttaatttgaacaagccataattctaccaggcacattagtgtgagtaccgtgattcggcctgaaagtcatggtctttcttctaaagttgtttagcatctagttgctaagttgacatctgagaattcctgctggcagctattgttctcttctttcttttggtttgttcagcatttctataatctgtctcttaccactgctttgattttgtaaaccttgctattttaacctagaaccctatgatctgccatattgaaacaccaatacttcaccagtagagcatacattttcactttactatgtctgtgtttatgtgactttctctttgtataattcatttctgcttccttctctatacaaccaaatcaaagcacaagactattgcaggcaaactctgcaaagagttccctgaacccgggtgcctacctctctcccttagaaagaagggattgttcatttgtctggattttattcatacacaattagcatattccatgaaaataagcaaaacatattatctagtgactgactgtcaggcactagcgttatcttggctaattctcaatatcaccttgtgcagtaaatactcttatcctcattttatggatgaagattctgaaatatacagtttatgtaagttgcccagtgttagtactaagtggcagaccaatcattcaaactcaaggattcacttccagagtcatctctcttagccagtttgctatagtacatgtacatactccattatgaatagttgcatatgtacacaccagtatccttgttttcccccaaaccttaatattaattttcttaagttcagcaatcatgtttatgtgtttcatattcaatactaactagcatttaatatatgctttgtaaatacttgcagaatgtttgtcgaatggataagttaaaaggatgtcatgttttagaagagtgttttagtaatcctgttttgaggcatttatgaaaatgttacttttgccttcagctcttctgtacataacctattttagattctttaactgaagtcaaagttttggtcaattgacagaaaaagaagtcagattatctccaatatgaatgaaaactgctaaagaatattaaattctagctgcaaaaagttgacatgtgggttggcggtggggagtaaactttctgactgcagtcattttggtataataggataatggtcataggaacttataacacctcttatctaaattagtaatgaagctttaccatattctgggtagtgagaaaattgtccatctagaggcataagtcagatgagatgataataggtgtcgtgtttaacagcaaggcttgcaagtcagcagacatcttctaaaacctaacctttgttgtatattcagaaagacacttaacttctctgagccaggaactgccacttattaactaaacaaattactttacttttcttcacctcagtgaaaccaagataaagatacagcccatgtcaggttttaatgaagattaagtcataggacactcataaagtgctgagcatattgcctgcacatgtcagtacatgctgaacttttataatcgttcagtgcatttaactatgaaacattttaaaatacaatatcaatcccatggagttatttgaagaaccaaatgagataacagtatgctatgctgggcccataggaagctatatataaatcatagctgtgaaccattctattatcagataaacatttttaagtttttccaattgcacacccctttaaatctgtcataacaacttaataatgtattacattttaagtacatttttgaattggacattagtatagcacattactatgattatttacatagtccatgtaaccaaaactcaaagtaaaaaggctaaaaaattgaatgtgaaataaacattaaattgattttaagtgagacctaagtaaagcattgtaagatctaaggaagctttatgtcccataaaccagtgaagctatataccaccagaccaaagaactaacctatggctataaattaagaaaatcattacagcaggcacatgaaaacactatgtcagaactggaaagagtaacatatgatggcaagaatcttcttttaattatagatcctagtcaatacacatatttatatgtttatatcaaaaatatgaatgtttcagtaaaagagatgagatttgagaaaaatacaaattattaataggactacctttgttgcataataagaaaactgaatttcatacagacagagtctctaaacattgattttccatcaaagaccagggaatctgaaaataatacatacatttttgtacacattggctgaatgtgtggaataaaatattatcaaattctaaattactgactgcaagccagttaccttctctcttactgaggagcacctggtcaaagcattattttttttttccccccagctccatagtcttccacactttgcctcatttcagtaatgtatttaatgtcaggttgctaccatctacaaacaacatacacatcgtgttgtttaccttcggtagtcctctttatcatgtgcattgaagtccaccttttctacctggtctatgaaatcttctgcacattcatcctctgactctttcccgcatcatatgcagatcttcacttattcttacctgggactttcggcttcagtcaacaatctcacctgcaaactcagggcgtcttacttcttttcacctaacactattctcatctttgccttttagttttgccaacacttatgtactttgctaaccttaagtttcattaccttttgctttttacatagtttaatgttctccatgttagtatgccatatgccctttcacctcaagtaagttataggcttcctaaagataaaaataattgctttctattttgttttcctatcatacacagcaccaagtgcatccaatgcactgtcaatcaatgcctgagaaaatatttcggcgtttttttgtcaggggttgaagtggcatttaaaaacttaaaattctaattgcccatattttattatttatgtctcacccagagtgtgagaaattgagaacacatttctgtgcttggttttatctctaaatctaatgagaaccagcagagatcatcagaggtttagaaaatatataaggaacaattttctataaaagtattttagtgattcttatgatttcccatcttttataacctccttcctgttgatttttaaaaggatgtaaaggaaatattaaaaactttttttctgtaattctttcctttgtggggcactagatgttagatttttgtatttcactctagactctaccacttcataactattttattcaaactcacattaatcaacttcagagtgacctcaagtaagcttaattaacctcttttggtttcagttttttttcttgatggggtaagatgatatctaaatttctttctagctctcatatgtttagcctatttatgtaaaattctttccacatgtagagttcatttcagtcctacaagtctacatattcttggcttaccagagtaaattatcaagaactagatagaactgaaaaacatcacctgaatagggctgatctcagtagatataaaactattaaccatttccaaatcatcaacctctattgtcttcagcactttggcttgattaaagattttctcccccactgatttttctctctatttaatccacttaaatttgcatcattttgttttcttttatcatcactgcttgaggcttcctgccagtatgaattttaaagtcttacagtccctaattctcatctgcttaaatgttataaatgttgtacatatcttagctgcatgatttcctctgggcatttttgaagcttacttaaaactatggaaccccctcctcaaatatcctgaaattcaagtttgatttggtgtatatatctatggggaagacaaccatggctaaacatgagagtagaaaaatacacctgcattccaggtcaagagaaatgtgactcctctgcagttacggagaatcagtttattgttgtaatcatgctgccaagataattggggtaaacctaatagtgtaagtgtagaagctccaaagccgcactacctagtttcacatccaggatctactactttctagcggtgtgacattgagcaagatgctcactctctaacccataggattgttacatgcattaaataaagtgacatatgaaaagcaaatgaaacagcacctagtacataaccttcaacaaatgttaattgttgttattattattaacatgttcaaagacagtttggagtaatcctgtaaatagcaggggaatctcacattcttatttcactaagatttagaaatatgtatagtttggtaaacctgtttaacctatgtttaaataaacaaattttcatatgaagtctatggtcctagcaacatttacgacaggaaaattgattgtattatttcccttgtctataagcacactaaagaatagggacttacaaaactatctaagggagcccgctatagcagttaagatgagaacacctgcagcctgatttccaccacactacctagggcatctcatggagcacatcaagaggaaagccagagaaactaaaggttgttgttagcatcatccattttcttcagatttttcttgtctaaaaggaaggaaccaaaatacagaaatcaatgtttatgtgcttttaagggcctgattttaactggcaggcaaggcatttgatatatgcaactggatttttgtctttctcacacttcactgtggcgtctgaacagagctatagatgatctcagtccgctgtaaacaaaacaaaacaaaaataatgcaagtctgccatgtaacacccattaacaatgcagctttaagatacagatatcttctcctcttgtgaatatttacaatactttttatctctcctaatgcactgtgacctataacactctactggagaattagagatttgttctctagttgttgcatgaacttatgattcatttcctcatatagaaaaaatgattatttgagtatcagagccttatcttatatctccttgaaacctcccatatttcttactctaattctgaaatattttgaagttaatatttaatgtaaaatatgacctagtaactatttctcagttgtttcttactcctcagaaattgtgtctttgcatttgttcctagggagattgagaaataaagatctacaggaatccacatgttaggtgcttttctttgttctttattaagactaagaatgaggtaagaagagtaaagaagatcagagatcagtaatttgttagaatttcagctttaattggtcaggaacacctagagcttgtttccactcacatagttaaatgccttatgtttttcgttgctctgtccttcagtttttcaggtgcggatccaaagtttgctgatgtcaccaaagcagtatatatcaacattttttacatagtgaggcagttaagggcgcaatttctaacaacagacctagatcaaattctaatactttcttacactcttcactaaaggaactgactcatttctctattatctgataattatttcataacttataaaattatgaccaatatctttattatgtgaaagtttaagattcacttttcattatatatagctagaatcattgagttgtagacttctctccacttacaatccatgtaactacgaacagagtacttaacttttttaaatgttattttatttctctgtaaaattgagacattaaaaaatatgtaataacatggttgtaaaaatgtggtgaagaatttagaaattcttcttcaaaagtagtctctgatgattagcatagttgaaaaactgctgacctatatgatgttcatgtcaacccaacagttccatgaaaaactgagtcataagagagtaaatgaaacttcttagctagatgattttaggctttttaatctgtttggataatattcccactgactattcaattaatttaatctaatttcataaatactggatgttttccttgtttcaagcatatacttgtgaaaaagacctacacaggttacagttgaccccaagtcctaaataaaatcttgtgatgcattctgaatctgaataaggcttgctgttgtcacttaaaattttgtgcattacgtacatgtatttatttttaactaaatgttagtacaattattataaaaacctatatatacaacctttcaaaagtgtctgtgtagagaattatttaagcagaatatggattttgctcctttatgcagcctaattttaacatgatgtgtacttaagttatactcaaatgtatattttctattctgcataattttgatgaaaataccaggtttagaattttcctaataatgtattccacttaccttagtaagtatacagcctcctatgagatcaactctatcaataaacactaaatatctccctaaggactcttttttatgttatcactttataatataatacgaagtgatcatgtttttctgtaagctgatttgcattcaacatcaagcttacctattcccctgagtacttttaaaagtactgttataacagctgggctaatagttgaagaatcaaatcaaagtttcaatctttgtatctatgcatgcatgtgatagtgtacatgtgtatatccctgggcccagagatctctttgttgtaatgtcttatttatctaggaaaattaggcacattgtttctctataaacaagaagcaaagactagaaaacaaaactgtaggaaaattttagaacaaggaaagcattggtctaatgaagtgaataatagtttttcacatgaataaataattgcagcatctacttgctgctctgtttgattgcaagaactgaggtgaactattataactacaagattttcattgtattgcatgcaatgtgatggtctccaaaatgtcatacaggatgatccaacattatcaactcagtgtaattgttaaagaatagccatttcattcttttctttgttgagatctatcttgccatcccatggcctacttgaaaaaaattatctctcaaatatctccaggatacatacatggacatcccaatactctgatgttttaatgatcaggtccaggaatggctttaccaacccctgttatgggattctcactctttacacttaggctttcctaattgtttttagttacagctcaacagctttgaccatgttatttctgaaaatccttcttatcgttttctgaaaaattcttattcatcttttaaggctttctccatgttcatcttccccaggaattcttcactgaactccaggtggggctatagataccttttttctttacactgggcttgtgttattaaaggagatcgagaccatcttggctaacacggtgaaaccccatctctactaaaaatacaaaaaaaaaattagccgggcgtggtggcggatgcctgtagtcccagctactctggaggctgaggcaggggaatggcgtgaacctgggaggcggagcttgcagtgagccaagatcgcgccactgcactccagcctgggcgacagagcaagactccgtctccaaaaaaaaaaaaaaaaaaaattatctgttatgtgttttcttcattcgactcttcactccaacacctagggttctttctcatatttacacttcaaaatgtttattgaactgagaatgatttaagaacgtagatgaagtccttgacaacacacctgaataagaaagcacattttgttttgctgctggtacttgattatacttgaaatgatagaagccttcaaaatcaaggaaaacacaggaattttcagtagaattagtttttatttttcttctgaaatttggtggctcacacctgtaatcccagcactttgggaggctgaggcgggcagatcacgaggtcgagaccatcatggctaacacggtaaaatcccgtctctactaaacatacaaaaattagccgggcatggtggcgggcgcctgtagtcccagctactcgagaggctgaatgaagcgggagaatcgcttgaacctggggttggaggttgcattgagccgacatcgcgccactgcactctggcctggcaacagagcaagacttcgtcttaaaaaaaaaaaaaaaaaaagtaattaacttagaggcaagctgaaatcaatataaatttcatcttagatggcacaaaaaagatatttccaaattagataggcatagtacataaaagagtagcctgtcattttgctatttgctagagtttgggtttattcgcaaatgacctgatttctcagttatttgttagctacatgcaattggcaagtatagctccttaaaccagaattgtggaaagtcgtgctataatagatgaggtcagcagcctggctaaacttcaaaacaaatgagaagttcataattctaaacctgggaatgttgacgcataaattggctgttatgaatttatgaaagcatcatgatattatattttctatatgggaagtgtatgcaggaaaactgtagagtgaaaagggcttactgtagagtggaaagggcttactgtagaaggaaccaactagtctgattggcaaaagctgggaagagttttctgcagagccaacatttacgctgaaacctgatatcttggatattatttagcagtatctccatctggctaagagatggactatactcattatttttcccaagttagtcacctggaggtgatgaatgattttttttggttgatgagctactggggaagaggagaccaaggagattctggagcctgttaggtatgtaaggctagtaaaaggagggatgcaatattttggcaaagtaagaagattatgcatccttaaaaagataactaaatggtctttattgttcctactctggttaattattttctgacaattaatatgtatcatccttattagactttaattataatgcaaattaagaattgcaaagcatgattttccacatgacttaatatgtaacacctgtaagctctttgaggacagggatcatgcattatttgaatgtctcacacgaggaatgcctcaacagatttaacttcaagcaaaatgtatacaaaatgaagtatgactttgtgacttctattagggcataatactgagtaattaaataatacactgtttctagttaatatcaacaatatacatttcattggtttcacaactgcttaggaggaatgggttttgagatggttttgtaacaaatagtagtccaattaattctttagtacagttaaaaaggttttgtcaatagaaaaatgagtgggccgggcatggcaactcacacctgtaatcccagcactttgggaggacaaggcgggtggatcatgaggtcaggaatttgagaccagcctggccaatatggtgaaacctcatctctactaaaatatacaaaaatgagccaggagtggtggcacgtgtctgtagtcccagctacacgggaggctgaggcaggagaattgtttgaatccaggaagtggaggttgcagtgagccgagatcacgccactgcactccagcctgggcaacagagtgagactctgtttcaagaaaaataataataataataataattaaataacaaagtgtgttttcccccttgagcattatatttaaaaaataaggccagattcttatagataaaagataaaataagagataaagttaggttatcctattttcctgttctgtcataaagacaaactgaaatacatttaaatttcactttttagatacaggatggtccaaatgatatagtcctagtttaattattgaaaagctagaggcataaatatgctatgttgaagaaaatatacataatacatataatggataatatttgtattcttttatggttataggaataagataattggttgattatctaatatatggcatgccctttagagatgttatcccatttaattcctgtaataatatgaagaagagatattatctgcctttttaatatgatgattagaagtatcaggaatttaagtaacataaattcacaattacacagcttctagatgttaaaaatgtaatttgaatttaggttgcctgacctgaaagtacagacattgctttaatcacaaaattgctgtctatctagatggtaagaaacctaaataacatttgtgacactggatatgacatgttgcttaattatatataccaatgtaaagacattgttccgcctttgcactttttatttttgaaaacattaaaagtcaaattcttcttgctcaataaatggctgtattaaagaaatgccattgaaaagccagctggaagagaatgaggttaaagctgtggttctcaggaggaggtgggggaatgttgcattccaggagacttttgactattgactgttacaatgtatgtagcggtgggatgggtagggagaggtgctcctggcatccagtgaatagagcccagacatgctgctaaacatcttacaatgcacaggatagaccacagcaacaaagaattatccaacccaaaatatcaatagtgctgaggctgaaagagagggttaaagcctttgtatggagcctacacaaaaagaagtaggggactctttttgtctgtttattttggtttggatttctgttggatttaaagatcggttgctaccagcattacttccttgtaggatactggttgtcttctaacaaagacatcttcatttttaaagaccttcattcttgtgattggaattttaaatcctgtgcaagttaaggaaatgttctcttacatgttaaaattgaacacagtttattctttactgcagaaatttcttcctcattcagtacctgacaaagccacttattgtttcttataagatttcctgatccttgagacacaaagcgatgcttgagtgcatcttttgaattagcagattttggggagtgtatgcaagacgagtaatgaagttagaaagtaatttaaatctaaaaagaactcaatggagtttatttagaaagaaaatggtttagaagatactattcttttaaaaaaattggttttatcatgtctgaagagtatacacagatatgatttttctttcagacacatgtgtaattcctatcatggtaatatgttgaatttaacatttatttaatgcttagtgtttacaaggagccaagagacacatttgtcaacatctgcaaatggcaagatattccacagcaaatagaattgtttgtgtgaatgttaatgtaaacctgtaaaggacacaactctttttgagatgcgattgtatcaatattaatgtaagaggttttctatcatacatttacctcatgtgctctacctaaaaacaaacatctcttgctgcaatatggatattgatgtcacaacctgacaatttaaattagatagttctgctttgttacgagaaactatcaaactcggatgcaggcttctaatagatgtggggcccctagaattgttgtccatttcttgtcctatagaaccttccctctattatctggcatattaatagcaatttctccttgctgctcagtatcacaaacttgcccagaggcaaggaagcaaaaagaggctgtcttcttggaatttgagggtggggacaaaatatatgaagacaattttatgtctgagtgaattatcttgccacaggtgctatatttactggtacagtagaattgctcaaattttatattagctggtggatatattttccattgtcacaaggcctattctggatgccatacaattgttcaatacccaacaatgcatggtaaagccatatgtatgtatttcaaaaagcaatagtacactgtacaaaagtgtgagaggactggtctattaagatcagtttaaagttggcattttaggccctctaagatggacattaaagtatgcagaactgatccagccatctggagggctgaaaaaaaaatgattattatccctgaaagttgttaatctctgaaaatctgccaaacacctgaagaaaactgctaggagattctaccctcaaacacagacccaaataggctgtattggtcaccattccatttttgaaagctagccggctaaaggaaagatatcatttaggaataatggctccaagagtaaattctccaggaaatcagacatctaattagctagatcatttgctgggcacagaatgtcaggagtatcagtttcttttttatttttttaggagtatcatttctattaatttattgttataaatttattcttgacaaagcagggttttttttgtttgtttgtttttgctgtttttttctatccactccattgggactaagaaccaacctatgtttcagttacttgtgatacacctaaagtatgtatgagatgagagcgcttggaatgtgacataaactaaggtgtaattcagtatttcaggacaataacttcctgagggatgccacgctgggctcatgaaccaagagtacatgactgacttaggtgagtcaagcagatgcggatgtgagccctcaagcacagaaacctgctcagtgaggcagggagaggaatgaaggaaaatgatgtggccacagagcctagatataaccagcaggcagtttaggcacaggctttgtagggcaaaacttcctgggatcccaattccaaaagctgtctgtaccaagatactggagcaggcagggagaatatccaaatgatggcccaacactcacgcaggtggcaagacctctaccaagagacaattttggtaccagatcgaacttcaaggaactggcatgggccaggtaaagtcacctgagaggagggtagtggtggaatacagaatgtaacagtctcttagtacataggaaatggagctgctgaagcacaggaaaaggacaacatgatgtggtgcggggaccactgccccttcactggtatggaccatctgggtcaccttagcatcagcttccttgatctgatggccgtaaaaatgcctgggcctaaactaggtgctcactattgggtttgccattctgacttcattccaggcttcagctcccatcagaaatgaaggggcaggagtttggacacaaaggctttcagcaagtgttaacttatcttggaaaacgaatagtctcatctaaaaggtgaatttatgtgaggtacaaaggaagatagagtctggaggtggggtgacattctgagtaagtcgttcgatgccccaagagagaaggttgcgataacagtacaaggcattttcttatgtttgttggtgggcttatgtttctgttttagattcatctgtattgatctatagtgatgctcaaatgaagtatgtggctctgtgcacaggacaattccctgaagtgtgtcctcttttgtgaatgtattgtgcttcttcgaagagccctttatgacttttccacatcacattgattttttcctttttaaaaattttgtaatgcagctagaaaaatgtaattgagtgtttaaacaatccttgcttcatagtctctaaatgtttcaaatatgtaattcttgtttttttaaaacacttgtaaggggggcaatctgttgcttttttcttctaggaggcctaacagtgtttggctagacatgtgatcaaaacatcttgttttttgatcgatcgattatctgcttgaatcaaaaatctgtcattgactggaaacacgtattaattgtgtgacattgtactcagaaaacagtagactgaaaatcgatgactaagagttctaatcctaattccatataagtttttttgtgacctgaacaaatgatgatttttaggttacttatctgtaaaataaaaatgtggtaaagggtttacagttagaattaattatatatgaaagcaaactttcagatatttagacagactgaaatgagaggaaactagatcttgctactggtcccattttgagtaatgttgttaaaaataatctacaaagcaatttgataccctgaaaaatagagcgtgaatcgaaaagaactttccttaatattatcaacgtggggatttacttggaagcatttccccatgttcacattaaattttctagaaaaccaatgaaaaagtgaactatatagcagtcctgtgcaatttgaaaaactacatctgcatcttctagagtctgttactataatacttcacagcattttacaatcagtatctttagtgctataacctaatgagaactatctggtgagtgtgattagaggtaaagaatgtctgaccttgtaatcatggaattatttttctaataatgccttcaaatgtatttgaatggaagttattattactaaatgaaataatcttagaatcacagaaatcattataccactttttaagcaagcattcactgactaggaagcattaaaaggtttttttgtaatttgtaaagtgatgaatattagtataataaagaaagtagaagtagcctaagctgatgtctccttttttagttatatgatagtcatttaaaaattctgaacctggggccgggtgcggtggctcatgcctgtaatcccagcactttgagaggccgaggtgggcggatcatgagatcaggagatcgagaccatcctggctaacacggtgaaaccccgtctctactaaaaatacaaaaaattagctaggcatggtggcaggagcctatagtcccagtactcaggaggctgaggcgggacaatggtgtgaacctgggaggtggagcttgcagtgagcttgagattgcgccactgcactccagcctgagcgacagagcgagactccatctcaaaaaataaataaataacataaaaacagaagaaaaaattctgaacctggttctttacctgtttaccccttcgctcccctatttctccagacatagcaatatgaaacggtgaagaaatgcttctcatccaaatttataaccttttttgtcttgctaagtttcagattcagtatcttcatggaaaaactttgaattaagcttgaactctgatatggccatgtcatgtggctttatgtttttacagaagaggtatgtttgtgttgctgaggtggtagttgatgatgatgatgatattttggtggtgtaaaacttgaaacgcttatctgaatttttttctcatcaagaatggtatatttttatgttatagcaagtgaagaatatctttttcaatgattatgggttaggggattatggactttttaattttcatcttttgcacttatatgtattctccaaattcccttattttatatatgtacacatgaatgcaatatacacacacacatattgctctaatgctaggaaaaggaaaatttattttggtgttttaaaagcatctaaaataaagggaaggaaacataatgttggagattcatgaatgcatatagtgctcatactaatgatcattctgagaaattaattttgttctaaatgagattacttctttttatctctactcagttctatagttactgcacagcattaatctataatagccacgggaggtcactggcattttttctatgcagcaggatatcccactggtccaatgctatgacacaggtagctagtgtgtaggtttagacaatacttcctcctcaaaacccatctggatgggctgatttatgtggaggctgagacatctctggcagtggaaaagacaagacttctgtcaatgttggactttgaataggtacaacatatctaattggatgcggttgtgaggtactgtgaaaaaagcaagattataggcagggctgaactcgtcataaagaatgaagtctgtcatagtcagcaggatgatatagccgtgtgtggcaacaggtaaagtgaaccaggcaggtataaatatttgaacaggaaaaatctcatgtttcctgggtatgggtccaagtataaaacttctaaatcacagcacagcagcaagtgtttgcctttcagaggagcttttgtggacaggatgggctgacagcaatctttgactgacctaatctttggagatctgcacgtcagtgggttcaggggctgaaatgatcccctggggccagtggtagagtccgggtgtagttataagaggagagcgccagcctcagtttttgtattaatggtggtggcagccctgcaggaacaagggcctgtgcatcagtggttctctggcattgtgtctgggagagaatgatcaacaagactgtagttgagactacagtgtgaccaaataaattgggcagagagagacacatgtaagagacttccatctctgatctctggagaagcacagagacttttgtattccaatatagattgatttttataaaaagatggatttaaggggctcatagccagtcatctccagtgttgtaaatggcaaccaaatatttagtagaaatataaatccaattacatcaagcattatttaacttacacagtcacagaattcatcagtgtttcattattctgacattttttaaggccaagtcatcaggttgtaagagggaattcataaggacagaaaaacataatcgtgctacttcctttgctattacatataagtaacaatgatagcaaacatttataccctttagatttgttatctcactgaattatctctgtaaccttatgaggaaggtgcttttttaaatcactattttatacatgggaaaattaaggcagatggaatttgagtaattttcccaggatcctacagtttacaaatggtagaaaagggatttgaactcaagtagcatgtgattacccactatgttatgcccaatactgggagaaatatgctatgctagaacatgctatataaccaataaatggaatatttatttgaactttatggtactttttgactgtgtttaaatgatttatttaaatcaagattccatctgagtttccctactacatagtgcttgtgaagagttacagtgacactagttaacatgactgagtagttggtggcttctattagcagtaaattgatgacgtgacaacctggaatgagaagaagggtagaaaacacagaaaatgtttgttctttaagagtttatgatttttttgttattactgttagggaaaacactattattgtagtatgttttaattaaagatgaaataagatagaggtttgtatctatgatatcatattgagattaattcacttaatggtagcagtgcagcaatcgataaatgctttgactttgtactaagatgaaagtcttacttggataaaaacttacagagctgattttgttaccttaggaaaggcggaatgatttaagcttggcaaatgcatctaaaataagtgttcattattctatttaggtaaagctggagggatttatctggtgatgtgctttatgactgtccttggctctgtctacctcaacaatttaataaataacagaatgaggacattggttgcagagtgatcatatttatgctctatccattcacttacacagaaattcatatttacagagtacctcctatgtgtgccaggcactatcttaggacatgaaatgcagcagtgaacaaaacacaaaaaatgtattgccttcatagatttttacattaaaatgtggaaagagagtcactcacacacaaaaaggacaaacaaaacatataccatattagagataggcactgtataccatattggtgataggcactattaataaaacgaatgaagtgggtagaaagtgccaagggttcacaatttttaatagggtagtcaggtaaggcctcgggagttgttgacatgtgactaagacttcacagatgagggagtacattatttagatatatgggggaagagcagagggaacaagtgcaaaggcctgaggcaagaaacatcaagtgtgactggagctaagtaagccagatgtgatgtcagagaggaacagagtgaggccgtacccgcagagctttgcaaatcatgaaaagatgttggctttacttgtgagttagtcaatgaagtattcagaacaaaggtgttacatgactttacttgttttttagatggtgtgattctagttgatagggtagaaaaccaattgtaggaaaaataaatgatggaagtaaggagagctactacagtaatgcatccaaaaggtgatgataacagtaattattgaggtggtagctcaatttctggatatttgttcattattgaggtaaaatttacattattcatactgtgtaccaggcactgttttttatgatatattatggtttaaaaaagacttaacatgaggtctacaatcttagcaaatatttcagtgtacagtacagtgttgttaactataggcacaacgttgcatgcagatctctaggacgtattcatcttacataactgaaattttacactcattgaacagcaatctcttatttccccacctctctttcagcctccagcaaccaccattctaccctctgcttctaggagttttactattttagattcctcatataagtatctgcccttttctgcctggcttatttcaccctgcgtaaggtgttcagagttcattcatgttgtcacatggataggatttccttcttttttaagtctacataatattccattgtatgtatatcacatgtttttcctactcatccatcaatggacctttaagctgttttcacatcttggctattataagtaatgttgcaatggacatgtgaggtcaaatatctctttgagatccctattttaattcttttggataaatgcctagaaatgggatatttggattgtttggtacttataatttttcaaggaacccccacactgtttgccatagaagatgcactgttttacattcccatccacagtgtacaagagttccaatatctccacctctttatcaatacttgttattatttgtttcttggtaatagacatcctaataggtacaaggtaatatatgaataggttttaatttacctttcctgatgattagtgatattgagcatcttttcatatacacggtgttcatgtgtatatcgtctctgaagaaacatctattgaaatcctttgcccatattttacttgggtgaaatatggcaagaggtgtggctatttatttgtagtgattccttatatattttagatgttaaacttttattggatatatagtttgtaaaaattttctctcattcaagacatttccatacagtagatttctttcactttgttgattatttcctctgttctgcagaagcttcttagtttgatatagtcttacttgtctcttttagtgtttaatgtctgtgtttttggtgtcatatccaataactcattgcctagaccaaatatcaaggagcttcctccctatgttttcttctaagggttttacagtttcaggtattccatttaagctattaattcattttaagttgatttttgtctatcatataagatagggtttaatttcaatcttttgcatgtggatactagttttcctaccaccatttgtttaagaggctattctttcctgattagatacactggcaatcttgtcaaagatcagttgaccacatatggatgagtttatttctggactctctgttttgtaatattggtttatatgtctatctttatgccagtaccatactattttgattattttaacattgtcatgtattttggaatcagtaagtactgtattttgaagtctgaggcctcaaaatttatttttctttctcaggattgattttggcttttcatggcctgttgtgggtttctagtgaattttaggattatatttcctatttctgtaaattatgccattggaattttgatagggattgcattgattctgcatattgatttgggtggttggacattttaacaatattaagtcttccagtctttggacttttgatgtctatttgctgtgttttttaaaatttctctcatcaatgcagtgtttttttgtaaacaagtctttcacctccttagtttattcttacatattttattctttgtggtgcacctgtaaatgacactgtttgcctaattaccttttcagatagttttttgctagtatacagaaatgaaactgatttttgctggttgattttgtatcctgcaactttactaaatgaatttatttgttctaacagtgctttttctggagtctctaatgttgtctaagatcatttgtctatgtgtctatagactttagtgttgtctatgtataagattatgtgtatatatgaatacatatatacgatcatgtaagatggagtcggaatattttagttctttctgtttttgatgtcatcagtttctttttctggcacagttgctctggagagaacttctagtaatattctgaaagaagtggtgagagtggcattcttgcctcattcctgattgtagagacaagctttctgttcttgttaagtctgatattagttgtggacttttcatatatcactcttgttatattcaggtaatttcctttacttctcattttcgagggtttttatcataagaaggtgttgaattttgccaaattctttttgtgcatatgttgagatgatcctgtgatttttatcctttattctgttgatttgctgtatcacgttaactgatttgggcatgttgaacatccttgcatcacaggaataaatgccgcataatcatcatctatgatccctttaatgggctgtgggattccatttgctagtattttttgaaaatttttgcatctatatccatcatagatattggtgtgtagttttcttgtggtttctttgcctggctttgatatcaggataattaccagcctcaagaattgagtttgtaaatgttccctcattttcttttttttttttttccaacagcacattgaaacaatattttactattatcgagtgcagtttatcccagggatgtaaagataatttgacacaggcacatcaataaatgtgatgcatcacattaacagaaaggacaaaaaccctctgatcatttcaaaagacacataaaaagtatttgacaaaattcagcatatactcataataaggaaaaattgtgtacttgattaaatggtttctgctgcttttttctcttttctttttaaaaataatttcaacttttattttagtttcagggagtgcatgtacggattttttgcatgggtatattttatgatgctgaggtttgaggtacagatgaccctgtgtgatgagcataataaccagtaggtagtttttcaccccacatctccttcttccctcctttagtagtccctagtgtctgttgtttgcatatttatatccaagtgtactcaacatttagctcccacgtatcagtaagaacatgtaatttttggttttctgttcttgcattaatttgcttaggataatggcctccatctgcatccgtgttgctgcaaaagacatgatttcattctttttcatggctgcataatattccatggtgtttatgtaccacattttctttatccaacccaccatgagtgggcacctagattgagtccgtgtctttgctattgtgaatagcgctgagatggacatgcaagtgtatgtgtatttttggtacaatcatttattttcctttgggtatatatccagttccctcattttctatttcatattttaaatatttggtagaatttagtagtgaagtcatcttatcctgggcttttattttttgagaggtgtttgattactgattctatttctttatgatgtagttttgatatgtgtgtttctagcaatttgttcatttattctggattatgtaatttgttagggtataatttttcatactagtctcttatgtgatctaacatatgaaatactctggagaaagatgcatgtctgagaagagtgtgtattctgctcctgtttggtagaatgctctttaaatgtcaggtccattttttctttaatgttattcagattatctgttttcttatcgatctgtctggatgttgtgtccattattgaaaatgaggtgtgaagtctcctgctattattgtattgtggtctatttctcctttcagttctgtcaatgtttgctttatatatcgaggtgctctgatgttgagtgcatatatatgtttatcatggccctatcttcttgacgcattgacccttttatcattataaaagctttttctttgtctctgaaatagtttttgacttaatggtcatttgtctgatgtacccctactctcttttggttatgatttataatatatgggatatcattttctatcccttcactttcagccaatgtgtgtccttaaatctaaagtttcttttttttaatctgttcagtcactctatgtcttttgattagagagtttaatccatttaaagtaattattgataggaaaggatttgctattgacattttgttagttgtttcttattattcttacagtacttttgtatgtcttcctctcttgttttccattgggttttgttggggttttttttggtattgttatgcctcaattagttttttgttcttgttgttttgtgtaaattttacagatttgtatgtgtgtgtgtgtggttaccttgctacttacataaaatatcttacaactgtctactttatgctaataagttgaattgcatacaaaaacttacaatttaacttcctccccagaacatactttatgttattattttcaaaatctattcatattatttatcttttaataattgtgtttgtatctttatagttttcaaaataattttttcttttaacttttatgctagaattaaatgtgttttacccaccaccattacaataatacaatattttatatttgtgtatatatttacttttctcaaccagttttatactttcttatgctgtcatgttgctgtttaatgccttttcattttgaattgaagaacaccacttaacatttcttgtaaggcaggtccggtgttgatgatctccctcaatttattttgtttggaaaagtctttatctctctttcatttttaaaggacagtttttgccaggtggagtattatttgatgacagttttatttttctttttccttcagcactttgaatatatcacctcatcttctgccctacatggtttctgttgataaatttactcatagtctcatggatatttccttgtatgggactggtcacattttcttgatgaattcaaaattctcgtttgtctttgacttttgataatttgattataatgtgcctcagtgtgtatttctttgaatttgtcttattgatgttctttggatttgtggatatggatgttcattaacttccccagatttgtgaagccttcaacaattatttctttgaataagttttctggttgtttttctctattatcattaagagacttccataatttgtatattggtctgcttgctggtattccataaatttcttaagctttctttaaatttttttctattctttttttctctttttactcctccgagttatttccagtgacttctattccagttcgctgatactttcttctgcttgatctagtctgctgctgaacccctttagtgcatttttcaggtcacttgtgttcttcagcttcatgattttggtttagtactttgtaatattttctctttctttgttgaaattcttactttcattgggctctcaaccttatgaaagttatttttaattcattgtcaggttaaccatttcattagggttgatttctggaagtttatcttgttcctttttttggagcatcttagtcggattcttcatttttcttgactctctctgttggtatctgcacattagacaaagcagacacctctatcagtctttactgacttgacttgtacagaaggctcccaccaatcaacctacccagggattctggtggcctctatcaactcttttcctcccacaggaagggaaggcttttgtcagcttactctgtgataaactgaagctatggtgtctataacccactgtttctatttttcctcaggtggctagattgtgccatctccatcagagcttcaggactcacaaggcagaagctagttgtttaggaagccctagagatattgtagcattggatacacagatcaactctttcctttccaagaagaaagctgaaaaaaaattgggattttttttgtttgttcgtttgctcactctgtgctgagcagtggggagtatcaatggcctgtaccagcccaagatgttgcctgcattcttcctcaggtgtctagactgtgctgggcccatcagagcttcaaggctagcaaggcaaaggccagttctctgtgtccccccgccccgactccccaccctgcttccttggaaatgcaagggaactgaacatgggatccaagcccttacctcccctgggtgaaaccaggagcttgggcatctctttctgatcttagggaaccacactgagacaagggtgtctggtgagagggtgtttcatatctctctgtcagcttcagtgagtctggttttgcattctcccaggatgcaggaacctttcaattagtttctgatttcccacacagggaattcttccatcaattgtggctgaatcgatatgcttgtatgaagaaggagagtctaggatttcctgttctgccatcttgctgacatcactctgctacattcttgtatgattagttttgtaggcatatgtttttatgtctcttgggtaaatactaggaatacaattgttggcatacagagtaggcatgtatttaacactgtaaggtatcttccagtttttcaaaatgtttgattttcagtctgactagcaatatatgagatgtcaagttgctctgcattctagctaacgtgttgtgttgtcagcctttttaatgtcagcagtagtgctatgtgtgaagtaaaattttaatgaggtcttaattagcattttctggatttattttttatggacattgagtaggtttatgatgattggatattgtttcaagggaaagagtggtaaaaaggatggcacaagggacatttggccttatcaattaaaaagtagtattgtccattaacagaaatggggatgactgaaatatatgcaggtgggggcaggaaaaggaatataaaaaattcagtattaggtgtgttaattttatattcctattagataagttcaagtagagatgtcaagtaggaggttggctatatgagtttaagttcagggaaatatctatttgaaaatcatcagcatatagatgttaataaagccatgagatttggtgagatcactaagggaggaattttaagtagaaaagagctgagaactaagccctggactcctccataattggacccattaaaagaaaccagaaaaagattttgagattaagtagccagagaggacagaagaaacgagagaatgtgacactcagaagcccaataaaggagagttttcaatagagaagtagtgattaattgtgcctgatattgcccaaagggaggattctgctacattcttagggaacaaaaggttgtggtcagagggtgggatgcttgaagctataattatattcagttctagttattagtaatgtaaaggtctggagaatgatgattgagacagtggctctattaggctgaaggacaagatcacaggaagaaaggaatttaagagacaggtcagtttgttggaagcatgttggaacaagtgatatgcaattggaaaagctttttaaaaatgtgtgtgtgtatgtatttgacaagcaagaataataggctaaatctgtcaatatgtcatttactaagattaaaaaaggaagttttgtattgaggtgtaatatattaaatgcatcagggaaataattatttaacgttaggctatatatatggaatttaatggatttagttgactgtgaacttagtaaagctttgccattagattcttaatgatttccaataaattttttcaaaaaggacttacaaaaaacatggttagtccttatctgtattaaataatttcagcaaccaaagtaagaaaggctgctcctctttacaagcataggtcagccacaccttaaatgtcatgtgccttcacatattctatattgagcatatcaaaggaagagagactaggattatgagcgaagttcaagccttatcacatgactatagtgttatcagacagacaatttcatatatttcccttgagaaaaaaaaattaaggaaaagtaaatgagtggcattttatattcctccttgagcagtagtgacaggagaatgtagagatacccctgcttggcagtattaagaatttttatattttagtgattgatagcactgcttaatcagcaatgtaatccttaaaaaattttgaaaatcagtaaacgagttaactttatggtgaagacatcacattttctggattctaagacaccatcagttacaccatataccattattttatgtagcaaactgccattataattatgatatgccttcatttttaaaactcattctgatttcagaaatattaaaatgtgaaaaaagggttttggtatgtatagtgatatgtagcaattaaaaactgtagctcctcaactttttgttttgaataatgttggtgtcttagtgtgctatgtatctttcacataatccaaatctacaaaaatatatttttgaaaacacatactttttactaaatatcaaatgcttttttatataaaatattatattttattatagttagaagatagctaatgccttctctgaataacttttcaaagcacgttcagctcttagagatcagtaacaaaattcttattgggttaatatcagtttttcagataaaacgttattcttcatttgcttcactgatgccatgtcttttgactattagtaacaaaattaagtctacataaagaatatgttagagataccatgtatcctaattactccacctggggttccttcagcagtttgctctaagttgctcttttggctgtgttgtaaagtagttcacacacttgtaccttctggtttatgggtgaattttgtcagtgcattctatctttatttgtaagagttcttccttgaagtcagattaggctatcgcgggaacagcatgcttctaagatgtttgtgtaatgttgattaatgtgacattgtattgtaactttatggtaataattctttatcatttaaaagcatcttgaattcaagatgtttttactttaatgcagattttcttatgaaggatcctaaaaacttggatgcaataatactgctgaaaaaaacattgtttttgtttttgtttttgtttttttgtgtgaatatgcaccagaaagctggactttaaccttaagtaaatttagtggagagcaaagaagtggcacttcacgaaagtgctatgaagcagctatttctaacatcaaaacatccggtaacttgtaagcttcatagttttctaattactgaatgccggctacatgtaaccatagccattatataatcatgtttaaagatgagagtaaaggaagtggtaaagatctagataatatgtaatcttatttagttaatgtttatgaatgatgcagaaaaaataatttaagaaaaacactaagccatagatatactctttcacagatagccaagtagtgaaggcattaggtacagatcattttggaagtatgtacaggagaatacgggatggatataaaattctgcttatttcttaaagtaattagctataaaatgcttttttactttgaattattaacctttctaattatttgccttcccaccaagaaaggcatgagaggtaaaggtgggatgaatcaatttcatatttttcaatagcaaatttgaagtgaattcaattttggttaaggtagaaaaacttatttcatagaaaaattctgtggggaggtccaggagaaaaattaatattgtatttgcatgccataggtaggatcacagatgaatttcagtggtacccaattacctatatctaagcaaaaggtaaagccatccttcctaaatgatctgtttgattgatagcatctttctcaatatttttgattgtacaggaagaacgcagcaaggcaaaatggtcagcacaggcaatgaatgagacagaaagctgacctgagcatctgcctgtgttctactctgttgtaattttagttgcatcggtataattccatattggcatcatgccgtctttcactttattttgcattgtcatataaagctaccattaaggcatatactctgtcctaaatctcatttgatctctaagtaaaaggtcttaacatatgtaacaaacctgcacgttgtgcacatgtaccctaaaacttaaagtataataataataataaaaaaagaaaatatgtagatgtaattggttattacattcaaattaagttcacattatttcattatgatttatgatttaacttgtgttatgcagtgattcaatagcttttcttattttgtgcctagattcattatattattttttataatcatataatatttattcaattttataaaatctgtcattataacatcacattgagtaaactcccatgtgcagacattaaaacagttaaagcagaaaaaaaaaaaaagctatcaggaaagatggcataccttaggaggtttgctaactaaactaaggaaatctggttctctttctcctcaagatacagccctgtagatagctgcagatttttttcaactgaggtctttgtgacatcagagtattagagtattttctttccttcttgtattctggaggtttaaacagagccctggggataaggcatgatgctatcataggaatagattcttgtcacaagggcagaaggttcatatgtcttttctttcaggtctttttctttagaactgatactctcatttatttatatccaaccttaatttaaaaagaggaggtatggctaaaaatatgcacacattgcaataacataaaatgaattaaaaaatcggaataaaaaggaaacaacactaggaaactcaaatgaagccgagattaaatttagaaagtagaaagggatgctctgcaatgtaaattggaatattgcaagtattgtctttaaataattttttcacttctaaatgaagagaaaacaaatgattataagatttgaagtggtcatgctattaatactaatacctcgggagaaaacaaaaacaatttttgcattccagttctcgtagggagcactgtggtgaggttaacggcatcctcaatgataccctctccagtgagtacaataaaaattattgtaggcattcttcttattgtctacatgtaatataagcccaggagtgacagcaacatgaaaactcagtaaaaagcacgtttataaaacagtgatcatctgaaaacagcaatctctgaggacagaggtctataattgtgtcattttgttactgggataaaaacttagaatatatagaggagtaaattggcaaagtcatcctgtacaggccggagtaaatattttggttttggaggtcatatgttctccatctctacctctcaattctgcctttgtagcatgaaagaaaccataggtaatgtgtaaatgaatgggtgtaccaataaaactttaagcagttagatggtgagccagatttggttcatggactgtcgtttgccaaatctgatctagagaaataggattttattcacattagagattcatctagtctgtaacttctcagagcaaatttttaataaatatttgaaaacaaagattagaaattcaagtacatctttgaaattaaagacctgaaagacattctattaccatgtaagggtactatatgatatagctccccaaccagaaagtggttgatatcttcatttaaaaagtaaaaaatttaaccagagttacctcacctctgaataaggaaggatgaatgagtgtaattaatcggggaacatttcccccttgccccaaattctgcattctccagaacaaatgtatgttcctatgtgactcatggaaagtacaataataaatcatgtgcacctgggaatgatcacccacctaccagatctgtgaacatgagcaagtttttctcacctatttttaactaaatctccttatcaggaagttgggcataataatttattcctcacagggttgctataaggcaaaatgtttagccattggatgaatgattgatatgaatcgatagatcatagtttgggccctaaagaacatgccagaactcccaaactcttgcatatgggactgtatctaactcacagacgtatttgctttgtcctgtgaaacatggactgtataagcatctgtgatgcaaatgagaaaaaaaatggtaactttacatgaaaaaatacattttagggaaaagaaaaacaagtagatctgactgccctgggcctgctgcattgaattaaaacagtccatgtgagcaaggcatgtggcctccagtgtgcacagctgctaccagacacctgtcaccctggagctcagactgggctctgctaccattcacagcccagcttgtcctgctgtgttgctttagtagtgtccataagaaacaaatccttcttggtcccatgtatatatcttttctttttcttttgtatacctggcctgctttgttttttttctattatgttgttcttgttaggatcccagagtaacgtaaagtcagggggttattagtagctctgtgataaatgaattctctagttaagtaagcttaggtatgcttaaggaagcaaagaaaacaggtgtcttctgtgggcctctcattatcgtttaatatattaatgaacagtttcagtttccaagataagagtacaccatacagcaatctcaaactcattttgacaaatacatttttaaaaattttattttaatgccctatatgtcatgaccacttaactactgaccacatttttcccatggaatgtggtttggaaacaatgctctttaaatcctcacagatcttgtaattttaaaataaacatcccagatatatttgttgcaaatggtatccaccaattacctgataattgaacctactttataacattagtggataataatagtatcaagagtaatatacttaagatttattgaaaacttataggcaacaggtaagcacttagctaggttattttatttaatctgcacaaaaattctgtaaagtggattgtcttatccctcttccataaatgataaaaatgaggtagagtgaagctaaataacttgctggcaagtaagacaactaaagtcttttacccttactcttagctgctggatttcactgccttgacttcatgcagtaagagttggaaacatatgctctaaattatatctaaattagattgatcttggaccgtgtttcttcctgtagtaatgatatataaatatcaactgcctgttgaaaatcacttgagcttttaaatgtaaaaccttaatacaagtagaaaagtatacgttagatttattttgtatttgctggaacatatggctggctaattcagtagattcaccaatttataagatttacaaagaagaggtcatgaaacttgatgcttttcagttttaaaaccgtatactatttgatgaaagtttttctaaagaaactgatactcatggttctattaaggcacagatttcttttaccagtccctgagggtactgattagtcctaaactgttctatatttaaggacagtgaaggctaaataaagatcaataaaagctaaaccgaatgttcctgaaatcttttctgcaaacggatagaaatttaaccgtggttagtagagaagtagatatgcctaaactccctttgaactcatgtaatcactcctcaccttgccctgccatcttgtgtataatgttgcccaagaggtacaaacttttaatttattaaggggaaaaaatatgacagagtgttgagacgattttcagtgaggtccagcaatgatctgtaagttgtaagaagccatttgttttccagtaggttgatggagaagaaatacacaaaataattataaaatatcaccacccataattgatgattatactatgtaagtatatatatttatagtatatagtacataggtatatctatacataactaaatatatgtatacatacatgttgtatttcactgataccaagatactattaattataataatacacatcattgatgcaatcagagtttttcagaaagaagataagcatatcaaacaggccaatttttggaagacacgttcagatttcaggaactatcagaattgaaatgtgtcttatgattaagtctgtctggattgctcactattcagatgtaggggttgatacaatgaaagaaaaagataagtttttctaggtagctaggtaaagggcaagggttggtagatctgggaagcaaattaatattttagcatgctgtgaagtttattttagaagctctaaattatgcgggtcaagttccaagccttgttgaattagttggggttgcctttaaatgggtcaccctctaatcatgccttatttgtccctctggtatatttacaggtactgaagatggatggggatcattaggtttctcttattatattgtcccacaaatatcttaaccgtgagtttttcagagtaatatttttccatttgtgtctacagggtaatatatatttgaagaactcatgaccatacatcagtgttcatgtttcactaagattgtttcattttcatccagaaaaaagttttattttatgtaaataatatgtatttttctggctctgaaaatgatgcatggtattgaagacaacttggaaaatgttggtacaaaatagattacttaaagtcacccataatagcccatttacctataatgacataatttgaactgtccattcgtctgctttacatgttttttgatataaagttgagatcacgtagtatatatatatttttaattatttccatttaaaatgaacattgtgaacatgttatctttaaaacaagatgtttagtctgggtagataagcaagcatatgttcaatagttttattcagtgaaataattgctgcttttatacaagttagactcaaattatccatgttattagactgacttcagagaggagagttttataggctatcgttttaaaggaaatttattgtcatataaagctcaacaaggggaaagtagaactaattatcatatttgtaacttgtcactgcattttgtgatactgtattaccatgagctcaggtggtcctagatgcttggaaattttaacaaaggaaattgtacaaattccaatggataatagcaacctcaaatttcatagtatttctgaaaacagcagaaagactccccataattttaaatcattgtcacaagtttacattttcttgagagtctctggtccttaaagtttaataagatagtccaaattgataaaactctttgcccctggttgaagaagtttccatagcatgatggtttattattctcttcccccaaagtatctggtgtctacattcatgttaaaaaacaacaacaacaacaacaaaacagaaaggaaataaatataagagaattgcatagaatttttagaaattaatttaatacacttgcttgtagccaaaaggccaataagtgattagaaattaatttagttaaaattatctgtagtataaatcatttttcctgtgattttaatctctattgtgataagtgttaggcatcacatttcaaaataaggttccttttttagctctgttatttagaattatatctagtataaatgtaagctgttactggattgccgaggtacctggaaattcactgcctttagccattggattaatgtgttaaaggtcaccttaaaaattcctggtgctgtgcaaataataggtgctcagtgaatgcttgactgactctctgatggaagacagctctaataggctcctgaaaggaggatggaaatctagagcattggaggggagaaggaggcaggagcttaggacaacatgattacgtgggtgagagagaaagccactgagaccaaaaaaagaaccaaaaataaattccaaaatgtaaagagtagctaattcttgtttttcccagagacagtattcttttttcatactattttttggtgattttcctttttctgatattatatcctagatagtttatgaaccttaagaggtttttgcatagatgtgcatttgttgcgcattcatagcaatatctaagactgtcatttcagagatttgtatcagtcatctagtgattgataaaaaaatgacatggaacctacttttgagattggatgatgacataataaagtagcttctcattttaattctcataatgactttgtggtcttagttatgttataagtaaatattgacctcctgaatcatatactaccaaatggcaggaactgggctctttagcctgttttatcctttcctctatatagttggatgactcagaaacactcaaaactgcaaggagataccactgcattttaaaacaaagttgattgcctaatcaatgttaagagacattgagagagagagagaaatctaagactcgactttggttaattggattgtccagttgttatcataatgcaggatactgattcatcaatatcactggccttttaggatgagtgatcacagtcttccatgtgcattactttattactgcctttcacactagacgatgcagctatgatgctgtcatacttgcttggtctgaaaatgttgacaagtattgattttctacaaaataatggtacctattaatctcatgttttattaatttctaattttaaaaagcatgggttcagttgaaacattacactggaaaagatgttttatttttgtttataattgtgaaagagaagattttatagcacctgcaactgtctatcacaatatgcagcttcattgtcttttcttgatttccagtagctacctcaataaatcacttatttttaatgtcattcatgaagagtatataaattattgctcttccagttaaacacagcattaatgggaaattgttaatgggaacttgaatcatataaagtatctagaatttcaaaatgacaaatctattatttgttatgaataatagtcctgcagattaatatagctacttcttttttccttttacaaaatgttaatcattcagcctaattctttgcacaatagaagaggagacaaatgttaaacaagacaaaactgtgaattttgaaagatgtctcctactcatttctacatataggatcatttctcactttgtgaaccatagcagaatagaattaaaaataaataattattagtattacgcctgtctttgtattgttttttcttctttgtgtctcttatgcatcactgcatgatttagtaaatattgttctcctgaatcaagatatgcagatgatatttgctttggaagtattacagaggtagaggttgatggatctgaactgttcatcattgtgtgcagttggctattcttttcagtgtggccactatcgccttttcctctatgtacttgtaactagagctaatattgtagagtccatttctgcacttattcaaataacaggtcataggtaaatatgaacttgaataagtgcacaaatttcattgtgtcactgaaaaattattttcaatttgattgacatttgcaaataggaggccgtacttatttgaacatcacctatagatgagtcttgttctacctgctgggttgccaagtctaaatatttttaaataacagtggctatacaggatatagataaaagtcctttccataaataaacaaatgtatacaagagtatgtttgattattttatgaggattttacaatagcttttcaggattcagtttcaagtcagttctctctttctgtctctgggggcttgcatgtataaacatacatgcacacgagtgcacactgtggatgtggattatttcattttacctgcatgaaacattgtctgtagtggccattactctgttcctctttattctcttctataaatctcaaattactctttaatatgtgtttatgagacatcaatttttatctgctccatattttaagaaggcaaacacagttaagtcaaaatgactaatgggatggtagggaaaagtatgggctgataaaaattaaatagggcacaaatgattcccctccagagccatccttttaatatggccaattattatgaataaaaaacagcattctaaaacatttcttttaattaaatgttgtaataaagatatatacccctctgctttccaagccacatgttatctgtactatgcttcagcaggcactaacaattcaagagcagttttaagctctagaaccttttacagaagcataggagtcttatttcacaggtttttaaagtgttatgcataatttttgccagaacacaaaagataatcattggaaaaaatctactgtgttttcatcctcttctgtgaacattatttcacctcactactctcccctgacaacactgcattctcaggagcattcacaagccacttgtcatccttcctttgttcccttccaggtcacactcccctagagttcttgaagtgtttcgctcttggctcatcatcaccctcttcaccactactcttgttttaattactgatgatttcaacattgtggtagattatctttctaattatctggcttctcgggtgggtctccctgacccactgcccttcaattttctgtccttcatcctaactcaggcacccagcccatgatcatttcctgcaaccactctgtattctcaatttcaaattgcctaatttccacccacaatactgtctgtctatctttctccctctaatactctagctccaaaaatatttcagtcacacctggaatctaatcctatcatgttttcgcttcctcttgtcctcaccttgtagcaaatatgccacagttccctagtccattgtatttcctacttatacagtagacatttttttcttgactattcaaatctctgccatctcttccttcattctccctcttacttggctaacttggttcttgcctcactgagaaaattgaaggtattctaaaactttcacaaactttcatcatcacatttaaacatctatctgcaacttaactctatctactattgatgaattgtccatggtcttattgaaagccacctcttccaaatgtcaatgagaaccaatcatccctactggaggacactgatttagccgttcagtattgcccaatccttcattacagagagacaaatagctgggcactgtagctcacacctgtaatcccagcattttgggaggccaaggtgagaggatcacttgagcccagtctgggcaacacagtgacatggcaacatggtgaaaattcaatgcaagcctgggcaacatggcaaaaccctgtctctacaaaaaatacaaaaattagctgggtgtggtagcatgtgcctgtagtcccagctactctggggactaaagcgagaagactgcttgagaccaggaagttgaggctgcagtgagccatgccactgcactccagcctgggtgacagaatgagaccctgtctcaaaaaacaacacaatagacgtgctcctgagttatttttaaaaatcaagatcagtttcacagctatgaaggatgatatgatatgatatgtttctgaattagaataatacatatatatatagagagagagagaagaaaatgttatataagtaagttctgaattatgtgttatagacttaacatttgggcatcagtgatgtaagaactattcagaaatgacttccaggtaagacttgagctgtgcattcatggatggagagattctgatatgtggaaagaaaaagcagctgtcccaggcaagagaacacaacacgagcatgtgtgcagacgtacaaatgagctggtatagtcacggttcagaggggaagactgactacctagtataaaggcttcacaagattgttcggaaagagaggtcatagagaaggattcttagaacctgcttcatgatggccttgactttgaggcctaatattagagatgacagtagaatagtcacatggaaatatttactagttaattttgtattttcagaactgagattggataatagaatacactgagtttcatgtcttctttgtttttatacttagaatcttccaaactgagttcacatgccatattttaggatggaggaaaaagacatattgagggctttgaggctgatggtttggtgagcagaggggaaaagcctgggcacatccaaacttctactcactcattaagtgagatgcaggagggacaggcctggtcagcaaaggaggctgtccctgtgagcaggctcacactcaggttcagtttacatttccgccaacctgggcttcaaggtatcaggaggagacagaaggccccatcaggagagtgaggaggtcgatggttgctattcccgttttttttttagatggagtattgctcttgttgcccaggctggagtgcagtgcgcgatcttggctcactgcaccctccgtcttcttagttcaagtgattctcctacctcacactcccaagtagctgggattataggcaagtgccaccatgcccaactaatttttttgtattttttgtagagatggggcttcaccatgttggccaggctggtctcaaactcctgacctcaggtgatccgcccaccttggcctcccaaagtgctgggattacaggcgtgagccaccgtgcctggcccatggttgctattttatgtgttggcagttgggagacctgacagtcatttttctcctaacaaaccaggtcttcacctcacctaaggacatctgatgctgttgttagcatagaaatctcatacctgcattatggtgcagttgaaattttctgatgatggaaatgttctataatatagatagctattgagcacttacaatttcgctagtccaactgagaagcgaagcatttcattttattttaatttatttgaatttaaatctaaatagtcacatgtagttatgggctactaaatttgatagggcaactatagagctaacctctatttaatatttattgggtgtgtcatgtgcctggcctaatctaagaactttatatgtacccttaatattaactatttgaatttccataataatcacaaggattaagcattcaaattttccccattatagtaatgagtgaactggagtagagagaggtttagcataggaaggaaatagcaaggttgggatttaaacctagttagtatatttacagagcttacacaactgtgtctccccatctttaagttctaagttaatcttgctcttctttcttgctgacattcatacatttattcctgtatgttattactatgttcatttatctataaaatatgtcaatctttcttcttgaggtgttatatttttctcccttaccactgccactaaaagagtgcagattcacttaacgtgtgaatgtctgaatacgtttctgatcatcatcctaccacccctctaaacaagtgccagtgaaactttggtgtgcacagaatcacatggaatacagcgtggttgtttctgatacacgaggctcagggtgaggcctgagaatttgaatatctaataagtctccaggtgacagtaatactgcttgcctgtctggagccaccctttgcgaccctgtactctgccttgcaagtctactgccaggctaattgactttaagatagaattgtcagtacgttttggattctttcactgaaagacataacttttcatcattatttgtgtttttgtatgttgtagaaatattaaattatctttttgtcaagagttgaaaatccaactaaaaataatacaggaaagaaggaggagaaagggaagaaggaagggaaagaagcaagaaaaaaaggaaaattggtttatgtaactgaaagcccagatgtagatcaccctctaagatttatgctgagaatgccatcaggtgcccatcaggacagatgtgcctacaaagctatggagaccacaataatatttgaaaacattaaatgcaaatggctattattggaatgtcttcattttttcacaaaggacatcaatgtttcacatgtattgttttacacatttatatcacccccctcagttgaagatttagagtttgctactccagaattaggacaacagcaaatggcattaaggttttgtcactcgtttcttttctccttctgaacagcaatcttttttttttgagacgaagtttcccttttgttgcccaagctgaagtgcaatggcgcaatctcagttcactgcaccctctgcctcctgggttcaagagattctcctgcctcagcctgccaagtagctgggattacaggtgcacgccaccatgcccagctaagtttttgtatttttagtagaaaagggatttcaccatgttagccaggctggtcttgaactcctgacctcaggtaatctgcctgcctcgcctcccaaagtgctgggattataggcgtgagccaccccacctggcactgaagagcaattttttaaacttttttataatgtacttatctcatgtacaatatggtagtgatgatagttttctcagcttcagacttacatgatttagtttctgcaatctaagtgaaaagagcattgctgttttccaatatagtaaaatttcatgattaattctagtgggctcagctttagtctcatgcttacccctctaaagtagctgcggttaggataagggagtatttcctagagggaaactgtgagaaaggtggctacccaaggtagaatttggatcccattacccaggcaaagggggtggtattttggacaacaaaagcaccagagatctgctccacagggtatgaaccaaaatcatgttttgaactgcaactttgataatgttcttttcatctgaaacacagtggccttatgattacctcatcagaaagggctatcaataattcctgttgcgtctcaaaaacctcatccatgaaaactgtaacaacatctgcccctaattaatgtttttcattttaactactgtgacattttattaaaatatttctcatctgtactagataataaaataattgtaaatatgtatatttgctctttttctcttgtatttgcatgcatttgtagataggaattattttaatgcattactatatcatataggtatggtaagtgaatttaatgtttgcccttattttttttttttttggtagaatgttaatctttagtgtgtaaatccaatacttaagatcgatcttcatgctcgttttcactttgtttgaattagtttttgacggaagtaatcacctatcttttaggatgatttttttaaagaaaataattgtgtttatgtaaaaatgaataaagtaattacctggagagtagaaaacaatttatctgttccaggtcatgatggatagaaagtggatataggggatcccatctgggatgtaaagtcaggaaaattcccatggtagcaaaacacaaaaccaaactgctcattcaggtagcaacaagggacgtgtgcactccaacactgcgcagtcctgtcttggcctggtgtctgttgaggtcctattaaattttgctgaagacagtcaatactaacaaagacacacaaagaactgctagctattactttccatgatgtttagaatatcctaaagttataaatcagaattactttaccctccacgagaaacttctgagttgagttttgttgttgttgttgtttgtttgtttttttgatacagtcttcctctgtcacccaggctggagtgcaatgacatgatcttggctcactgcaacctctgcctctggggttcaagtgatcctcctgcctcagcctcctcagtagctaagactataggtgcatgccgccacgtctggctattttttgtattgagttgggttttaaaatagtatctggctttaccaggagaagatggtgaataggaggcaggattaacatgcatctcccacttggccagacagaacagtgtatagaaattcacactgtgaactttgttccgagaaccaccacaggaatgtaccaggaaaaccaaaagaattcagatcctttgaaagaaatgccatgctactgcaaaatcagcgagacaggcaaaaaactgtgagttcccaaagtgtgagaagggaaaaacctgcctccaaacacacatctccactggggaatctgaaaatccagatcacagaaggatttaaccttacctagagctggaatggatttagggagctgtgtgaaatataaaagtagtagcagcagtggaaagagccttgtaggcactcctagtctccagcttgagcccagggaaggcatccctgactatgtctcacagggttccttggggtaggcaaccagaggaattagggagggcttgcagggtaaaagaagcttccaggtgaattttatgatcacttctactaggcacacacttccttgagcagaaactgggggatgaatgggaactgctgcaaacctgagcaaaggagccactgccattgtgagcagatggggagggaggagaggtgtggcctgaaagccatgcttgctttctcagaagggaagcttatggcctggggcaggtttgagttctgcctgcaggctgcctgaatcaaaactcagcactgttaatggggcactgcaggagcaagattgaccttgccaactgaatgagagctgggtgaggcctttcactaccagctatcccccacttctttggtgaactatactgcacagcagaggcagccataatcccctttggaacataaacccattggcctgagaaccatacccctgtcccccacagtggctacaacaagctctctccaaggagagtctgagctcagacccacctgaccctgcccaaattaatggtatttctctacctgccccagtagctgaacacaaaagacataaattcttgagagctttatggccctgcccatcacctgataaaccagaatacttcccctgggtaacttagggcaacctcaaatcccactgctaataccacagctggtgctctcttgaaagaaccacctcatggctggaagccaaccaactcaggccattacagcaactcatgacagaataacactggtcccgggaaagagaaaacaacagttaataccactgcctacaacatcctggctaaccggaggtcctgagtctgtccatgtgaaaacttcactgctggcataaccaacatttgggaaggccaacacaataaacctagctacaaccaaagattctcacagaatctacatcacccccagccacctccaccagggcaggtgttaatatccacagctaggagacctgaggactggtcacatcacaggactctttgcagatgtttcctggcaccaacacagagcctggtagccccactgggtgactaggcctggaagagcaataataatcactacagtctggctctcagggagccccatctctaggggaagggggagagcacaccacatcaaggtatcacaccatgggacaaaagaatctgaacagtgggcctcaagttccatgtcttttggctggtgagtcatttctcgcaacagggacacaattgcagtactgggcgcaggagggaaagtctgcacctctaccccaatagaccagcttctgtgatcatgaagggccttggagaaggggtacttattccctccaggtactccactaaagacacagttggggcttgccccacaggaaagcagcatggaggtacctatagtcaaccttcctagaacaattcagggtgactggaggtacaccttccagattcaggcctgcatgagaggcagagtcaccgttcctccctacttgggacatgaacagtcctatagatgaaaagaggtgcctgtctgatctgaatacctgaaacactaggacagaagtgaggctgtgaggtaaatggctttcctgctgacctggcaaggggagctgaagtagctcccactcttcactctgatagaacctcagcacatctaattgagagctcccccagccaccctgctcaagactgggacctcggcccactgttagatattacatctacccacctgccttagccacaactagtgcctacccagggatatattccctattggcttgaagcccagatcatcaactcaataaataaacaccagaaaaaaaattaaataaataaagtatacaccacaagagaacaagataagcttctagagatccccatcattacaactccataggagacagtgaacttacccacacttcaagaatataactgctacaagtagcatcaggcaaaatcagcacagaagactctataactaaggaactcatagagtcttcacccctagagcactaataatcaaattaggctaaaataaacattaaagtctgatccttacgaggggaaaaaagaaatttaaattaaaaaaaatacagtccaattaaaaataaattcaagaacagtttgaagaaatagcctactcaaatgagaaggaaccaaaaaagtagttttggcaatatgacaaaacagagttctataacacccccgaaagatcacactatctccccagcaactgatctaaacgaagaagaaatccctgaattaccagataaagaattcagaaggctgactattaagctacttgagataccaagaaaaaggtgaaaaccaactaaaagaaattaaaaaaaaaaaaattaaggatgttggtgaaaattttccagagaaacagatatcattgcttttcctaaagacaaaacagtcacaacttctggaaagaaaagacacacttagggaaatacaaaatgcagtgaaaagattcaacagtagactagaacaagtggaagaaagaacttcagagcttgaagacaaggctttcaactaaccccatcagacaaagaacaaagcctcaaagaaatttgggattatgttaaatggccaaacctaagaataattggtgttcttaagggcacggtggctcatacttataattccagcactttgggaggccaaggcgggtggatcacatgctcaggagttcaaggctagcatggcaaatatggtgaaaccctgtctctactaaaaatacaaaaattagctgggcatggtggtacatgcctgcagtctcagctacttggtaggctgaggcagaagagttgcttgaacccagtaggcggaggctgcagtgagccagaattacaccactgcactccagcctgggcaacagagcgagactccatctcaaaacaaatacaaacaaaaagtttggtaaacttatttgagggaataattgaggaaaacttccctggctttgctagtgatctagatatccaaatacaagaagctcagagaactcctgggaaattagttgtgaaaagattatcacctaggcatatagacatcaggttatctaaagtcaagatgaaggaaaaaaatcttaagagctgtgaggcaaaagtatcaggtaacctataaaggaaaccctatcagattaaccgcagatttctaggcagaagtcctaaagtccagagggattggggtcctatctttagactcctcaaacaaaacaattggcagccagtcagccaagaattttgtatccggcaaaagagagagaaggtcacaaacaaatgctgagagaattcgccactaccaagccagcctaacaagaaatgccaaagggagttctaaatcttgaaacaaaacctcaaaatacaccaaaatgaacctccttgaaccgtaaatctcacagagtctataaaacaattacacaatgaaaaaaaaaaactgtttaggcaacaactagcatgatgaatagaacagtacctcaaatctcaatactaatatttaatgtaaatggcctaaatgctccacttaaaagatacagaacggcagatggaaaaaattccaccaaccaagtatctgctatcttcaagagactcacctaacacataaggactcacataaacttaaggtaaaggggtggaaaaagatattccacgcaaatgaaaaccaaaatcaagcaggagtagctattcttatatcacacaaaacagactttaaagcaacgatagtaaaaaaaaaaaaaaaaaaaaagaagacattatataatgataaaagtattattccaacaagaaaataccacaattctaaatatatatgcacctaatactggagttcccaaattcataaaacaattattatcagaaatttaagaaaattgaaatcatatcaagtgtcatctcagaccaaagtggaataaaaccgtaaattaactccaaaaggaaccctcaaacctatataaatatatgaaaattaaataaactgctgttgaatgatccttgagtcaacagtgaaatcaagatggaaatttaaaaattatttgcacagaacagtaatagtgacacaacttaccaaaacctctgggatacagcaaaaacgttgctaagaagaaaggccatagcattaaatgcctacatcaaaaagtctgaaagagcacaaatagacaacctaatgtcacacctcaaggaaatagagaaacaagagcaaaccaaagccaaacccagcagaaaaaaagcaataacaaagatcagagcagaaaaaaatgaaatggaaacaaaaaaacacaaaagataaatgaaacgaaaagatgtttatttgaaaagataaatacgattgataaaccattagcaagatttaccaagaaaagagaagatacaaataagctcaatagtaaacaaaatgggagatattacaaccaataccacagaaatacaaaatatcattcaaggctactatgaatacctttacatgcacaatcttgaggagatggataagttcctggaaatatacaaccctcccagattaaatcaggaataaatagcaactctgaacagaccgagaacaagtagtgaattgaaactgattaaaaagttgccaacaaaaaagtccaggatcagatggattcacagctgaattctatcagacatttaaagaactggtaccaattctactgaaactattccaaaagatggggatagaagaaatcctccctaaatcactctatgaagccagtattatcgttaataccaaaaccaggaaaggaaataacaaaaaagaaaactacagaccaatatccctgatgaaattaggtgtgaaaatcctcaataaaatactggctaacgaaacccaacagcgtctcacaaagataatatgtcgtgattaagtgggttttataccagggatgcagggacggtttaacatatgcaagtcaataaatgtgatacatcacataaacagaattaaaaacaaaaatcatgtggtcatctcaatagatgtagagaaagtatttgacaaaatccagcatctctttatgataaaaccctcagcaaaattggcatagaagggacagggacatacttcaaagtaataaaagccatatatgacagacccacatctaatatcatactgaatgggaaaattgaaagtattcccccctgagaattagaatgtgacaagaatggccactttcagcacttctattcaacatagtactgtaagtcctagccagagcaatcagacaagagaaagaaacaaagggcatctaaattggaaaaacagaagtcaaactgtcactgtttgctgatattattgtatacttaaaaaatcctaaagactcatccaaaaggcttctagatctgataagtgaattcaataaaatttcatggtacaaagtcaatgtagacaaattagtagcagtgctatacaccaacaacaaccaaactgagaattacattaagaactcaatctttttttcaacgactggaaaaaagtataaattacttagaaatatacttaaccaagaaggtgaaatctgtctactaggaaaactacaaaacactactaaaagaaatcatagatgtccacaacaaatgggaacacatcccatgatcatggacaggtagaatcaatattgtgacaatgaccatgctgccaaaagcattctacaaattcagtacaattcctatcaaaataccatcattattcttcacagaactaggaaaaaaaactattctaaaattcatatggcaccaaaacagagcccacatagccaaagcattactaagcaaaaagaacaaatctggaggcatcactttacctgatttcttgctatattaccagactatagctaccaaaacagcatgttaccaataaaaagataggtatatagactaacggaatataatagaaaacacagaaataaatccaaatatttaaagacaactgatctttgacaaagcatacaaaaacacataaagtcggaaaaggacacccaattcaacaaatggtgctgggaaaactggcaagccatatgtagaagaatgaaacttgatcttcattgctcatcttatacaaaaatcaactcaagatcgatcagtggcctaaatctagaactgaaaccataaaaattctagaagataacattggtaaaactcttgtaagcattgtcttaggcagagaattaatgacccagagcccaaaagcaaatgcaacaaaaacaaaaataaataaatggaacctacttaaactaaaaagcaaagaaataatctgcagaataaatagacaacccacagagtaggagaaaatatctgcaaactatgcatccaacaaatgactaacatccagaatctaaaaggaactcaaacaaataaccttatcaaaaaaggggggcaaaggatgtgaatagacagttctcaaaagaagatatacaaatggccaacaaacatgaaaaaatgttgaaaatcactaattatcagggaaatgaaaattagaactacaatgagaaaccaccttactccttcaagaaaggccataattttaaaaatcaaaaaataagagatgttggcatggatgtggtgaaaagtgtggaacacttctacactgctggtgggaatgtaagctcatacaaacactatggaaaacagtatggaaattttttaaagaactaaaagtagaactaccattcgatccggcaatcccactagtgggtatctatccagaggaaaagaagtcattatatgaaaaagacatttgcatgtctatgtttatagcagcacaatttgtaattgcaaaatatgaaactaacctaaaagcccatcaaccaatgagtggataaagaatatataataataataggataattattattaataattatgttatattattaattatgttatataagtggatatataatatatattatatatatcacattatatattatatatgtatatgatggaacagtgttcagccaaacagaaaataatggcatttgcagcaacttggatggagttagagaccattaatctaagtaactcaggaatggaaatccaaatattttatgttctcattttaagtgggagctaagttatgaggatgcaaaggcataagaatgatataatggactttgaagacttggggggaatggtgaagagggatgagggataaaagactacatattgggtacaatgtatactgcttgagtgacaggtgcaacaaaatctcagaaatcaccactaaagaacttattcatgtagccaaaactacctgttccccaaaaacttttttaaataaaaattttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaataaaaattttaagtaaagtaagataaaataaaattggatcctctgccaaactgtaagctgttaaaagtaggagctatgtgagaaaaacatctttctaaaagctagtttatattattcagtattctttctgtaaagattcatgtgacaaattacttttagaaattaacagtagaaaaagagtttcacttaaactagtacacatatttaatctggaaaataaaacattcccattatagtgataaaagctcaaaatcaaattaatgcatagaagaattatgataaaatttatattaaaatattctcctataagatttaaaggtcttaatatatttttttcctgaaaattactttaaatcattttcatgtcattcttccttaaataggctgaagaatacaagcaaacagtggagaacactagtgtttgggagaagaaggatatttatttctctttccttttcttggaaaatacaagttggtttcccaagtattaaaataaaaatcttacaaccaaaaaatgtggctaaattttaggatctatgatgcataagctgacacttatgcacagatgttattaatttctatttttattttcttcactggaaacctgaatctgggaaaatatcagctgtgagcttcagcgaacacaagtaaaattcatatgagaagtgcaaacttcataaggaaactggcagtactgaaactctttaaactgaaactggttctaatagaatattagaatgatgaaacacagcatagcatcacatgttcccattaggcatcaatctttgcccctgagaccttccttttgcataatataaaatgttgctatggtttcacatatagtatccttattatggcattaagaattatgcaaaatatgtaatatgtagattgcaaagttaatgacagctctgtgaatgactgaaaagcataaatttataatacgcatcatgtttattcattttaaaagttgttgacatttctcttggtgtgagacaatttgctatccattctcagatagaggtaaaaacattagaaagacatgatctatgcagtggattttatgagctcagttacatatgttaccttcctttctaagaataattgaaaatacgtgccattttttttactgtactagttcctccctagaatgagttaatgcacagaacatttgagaatgactggtaacttgttcactgactagagggcatgtagggctaggacatcagaatcttaattcactgacttctcaaataaggtatctgcaccagttgactgttcaattcctatccagctatttttttaaaaaaagtgtttgtgtctgtattttacatattatccaaataatacacattcattgtagaaaaaaattttaattactaaaaacagaactgtagaaagagcagaggatcttttgtttcattctgcaacatacaatgttttgattctattattatccttctaactcgaccccaatcatcatgcattcccagaatgaattcatctctacaaaccagactcaaaaatagctgataatatttttactaatatagagataaaactatggagttcaacttgagaccttcagctattagaatcttacagagaataatacttctccaataaggacaaaacttgtaatgattactaccatatgagattgctgtcaatgttgcattgagtcaattaagccagggatcacaggaaattaggccactagaagaactggccctccccaaccatttgtcgttcaaagatagtggaagcaattgtgcgtattgagtcagaaatgggaaaaaataatcaagatttatgactttagtttcctgggagcaatgaaaattccctgtgcttatttcagggggattcacaaagaaaaaaaatactttttactttagacttcttggaccgttagctaaaaatgtttccaccagtctagcccaagcaaaacaaacaatagttataaaagtttattttatttctgtagtggatttgaattttacacagttatagaaaattcaagtataacaaacataaaatatgaagtgtggggaagctcaatttagcttataggtctgcgtttttcctctgtggaggaaagtgtaatcttgccattgatggtaatctagttgcttctggcttaaaattcaatcaatttaggattaacacggtcagttcatattctattttcttgctcatttttttttctccctctcctatgaaacttctgggttcaggagttttgctgggcattttaagtgtgggaactggatttgcaattgattcttggtaatcttctctcattgctggcttctgctgaggtgtgactcatcctatcagatcaatattggttcccttgttcctgatgcatttactgctgaggtgcacattcccactccagtccccaatttcaggttcacaattaccatgtcttcttgaacccaacctcagtgcttctgtagatgatcttgaattgcaaccagttcacaactctaatgacatctcaaaattttcagcttttctccctgttgttcattggtttgtataagatataatgaggctgtgttcagaactggtctaggcactttgctcagaaaataatttcccatcccatagatgccatgttagttgcaagttatctgtgagacttgtaacatcccaggcagtatcttggacaacttttctcctctgacattattccacaatttactgggatgtatactagggttgcagtagtcctacctcactgacacattgggattctacttgggaggggccctgaaatccactagcagaaatcatctttgttccttaaacatcaatcacctcttagtctcttttttctacccactgctgaaattcttatatctttttgatgagaaaaactctacatattcatgaattcctttcgactccacatttttgtttttgatgtgattaccatattttaagtcctaaaggattcagaaataaaaacaaaacattttttatctcaagttcttttattataattgaaaaccaaagcattcaagaatatttgttacttctactaaatacttttcccaagtcatttagagtgaaaaagcccacagtgtgattattgttttcactttgacatctcttcctgaatgcagtgtatttattgacagaggatgggagaattaaccagaaaaaacacgcagttggatagcaaaatattatggtgccacagttaaatttacatatttcaataatgcgagtatctttgtgttttatttgataaagaatttagattttacggtccatattttcaagaacaatgcccaattatgtctaaatgaagtagaaaaaattaataggtcataaattaggggattactatattctagttatagcagatcttatttctaaagcattcattttatctcaagtactatttttgtgttagatatgcattatcattataatcatataaagtgataaaatttattttatcaatgacaaattttgtaaaaaagaagtaaagcagttggctaagatgcagcaaccggtaaaagggaaaataaggatctaaatccagatctcttcactctaaaatccacgtacttaaccattatatgagttttaagaaaatgactcaacctatttaattttatctcatttgaactgtttatgcttctgaagagccaagaacatcttttatctttaaaatcttcacagcatttatcaaaaccctaagcacatatttaaacacaaacatatgtttgcttccagaatgcagtgtttttaaagttaaaaaaatgtatcactgggagcagcagctcatgcctaatatcccagcaatttgagaggctggggtggaggactgcttgaagccatgagaatgagactagcctgggcaacacagtgagaattcacgtctacagaaaaattttaacaagtggcaaggcatagtgtgcacacacctgtggtcccagctacttgggaggctgagacaggaggatcatttgagcccagagtttgaggctgcagtgagttatgactgtgctactgtactccaccctgggtggcagagtgagagagaccttgtctctaaaaaagaagaaaaaagtatcaacaacaactgctcctaattaaaatgatttctaagcaaacaaggaatagaataaaaatttcttatcctgataaatagtgtctacctaaaatctacagttactaatcagacctaattggaatatgtcaagatgactaaatcaggaacaaggcagattgccaccacacccatgtattcatgaatttttgcaaattctgtccagaacaagacaacataatgtaatgaattatatgtagattggaaagtaggaaataaaactgatttttttaatctagtagaattatttataaaaaattcataaaatgtatatacctatcattagaatatgttagacaactaagcaagtttttatgataaaggttaagtataaaactgttaatggttttcttattatcctaccccatgctatgatttaggcttgtatataactataactaaagttagaaaatgcaatataaaagaaaaattacatcttcacaaagcgtacagtgtctagccctagatctgatgtaatgtgcaagtagctgtgttgaaaatttacatatcattattaaaataaattgaagacaatttaatgaagagatgtgccatttaatattataaagatgttaattatccacagattgatctacaaatttattgtaattctaattgaaatctgaaaagaatttttatgaagtttggtaagctcttcttgaatttatatatgaaaacaaatggcccaaatattctagaaattcctaaagaagaagggagattttgtcctatcatatgagggtacttactgtgtagtgttgctgcaagagagagactaacaagtcggacttcagagaccaaatccagacccagtcattagtggtaatgtcatccatgaaagaggtgacattgcgtttcagtgagaaattgtgggctattaagtaatggtattgcagccaactggttatacttacagaagaaaaataatggaacagaatagatccaagaaatagactcagataaatattctctactagtttttggtaagaaagacacaaaaacaattaaatgtagggagaacagcctttttaataaatggtgctggaacatccacaattaaaaaaaataaagaatcttgatctaggtctaataacggtcattaaaagttaactcaaaatgaatcatggacttaaaagtgaaatgtaaaactgtaaataatttaacataaagtatagaagaaaatgctcacaatctaggggcaggcataaagatttaggcttggcactaaaagcataatctatgaaataaatatggataaattgggcctaattaaaaaaagtttgctctgcaaaagttatgtgaagaagataaaaagacaagctatggactaggaggaaatatctgtagaccacaaagaggtctacaaagagaaaaagctagtatctagaatatgtaagaaattttcaaacaacaataacatacagtccagttagaaaacaggcaaaagacatggtcagacatttcaccagagacaatattccgatgtcagagaagcacatgaaaagatgtttaacatcattaactatgaaggaaatacaaattaatactataatcagatatcactacacatatatcacaatggccaaaataaaaatactaacaataccaaattctggtgaggatgcacagaactggacctgacatacatttctggtggaaatgaaaaatgttagacaaactggaaaacattttggcagttccttataaaactaaacatacaactaccacacaacccaacaattatcctcttagacatttattccacaacatttatttccagaaaaccatgcacaaaaaatgttcagaacagctttatttgtaatagccaaaaactgaaatcagccaagatgttctttaacaggtgaatggtttaataaactgtggtatactatttagcaatgcaaaagagaaagctactgatatatgaaacaacctggatgcatctccagggaattaaactgacaaactttttttgtttttgtttttgtttttgtttttgttttgagacagagtctcactctgtcacccaggctggagtgcaatggcgccatctctgctcactgcaagctccacctcccgggttcacgccattctcctgcctcagcctcccgagtagcttggactacaggtgcccgccaccatgcccagctaattttttgtatttttagtagagaaggggttttactgtgttagccagggtggtctcgatctcatgacctcgtgatccacccccctcagcctcccaaagtgctgggattaccggcgtggaccaccaagcctggcctgacaaacttttagtcatagaggacacattactggaactagtagttaagaatatggtgggagtctcaggaaaaaggcagatatggttatgaaaggaaacatgagggatccttgtggtgatagaatagctcatgatcttgactgtgggagtaggtacatgaaactatacatataattgtgtgcaaatacacataaatgaattcaagtaaaactgggaatttgaataagattaggaaatcacattaacattgatatcctagttatgatacactccagttttataaaatgttacctttaagataaagattacatgagactctctgtattatttactacaactgcttgttaatcaacattatctcaataaaaatgccaatttataaagaaattgttagaacacatttgcaagatttacattaaacaaataattagcaaaggtcaattagaaaaaatacaatcgtgggcaaaaaaaatgtacagttttcttttcagaactacaattagaaaaaataatttactaacttagtcattaagtaaattttaattaaattactttatcattttgtactctacagattgtcaagcattaaaaataaattatcaatttgcagagttgacagggatttgaattggaattcatgtaccattgggaggagtgcgagttgaaacaattactttagaaaacaatttggtgcctaccagaagacacagcaattgtactcccaggtttataccctagagtaacacctggttatagaaggatacatatacacaaatgtttgtagaacattgctcatgatagcaaataaaatcagttcacattagcatgaataacctgtgttatattcacactgtagaatattattattcattagaaatgaataaacacactcatatctacatggatgaatcccacaagctaaatattgaccacaaacacaaatcacaaaaaatacattatgattccccttgtaaaaatattaaatctggcaaaactaaatgcatactgtttaggaatacatatgtaagtgaaagaaaactattgaggaaagcaagggaaattataaaattcaggaatatgtttcagagaaaagaaagtaatgctattggggaggaggcgtggaggcttcaaaggcatgttagtgtttcatctcctaaactgggtgatagttacaacagggttattaaactttaaactcttaatatattacatctgttttttgaatgatgtattttacaatgaaaagtaacattgtcatccaattatgtgttttctctggtaatacttgtgcttgcactgattttagtacatgtgcactgcactattttacctcctttattatgataacacattaccacagcatggggcatgctgcggacttttagaaaatattctgatttttcccagcacactgtgtattcattcaggatacactggaaagcgtgacattctgatccatcattatgagtgttcaggtcatccctcactaaccttagaagagtaaacaacactgattgcacacatgggtgctgcagttttgctcttgacccgtggttgttaaggatcatttctagagaacagtctccaccatacatgagcaagttgcaaatatggaactggaagaaaaaaaaatccacacagaatagaaataagatccaatttctgcctagaacaaaagagataaaaagactaaaataaatgctcagatgaaaggttcatttttccaatacgattctcagagaaccttgagagttgattaaacagccttatatgttttgcaatttaattaggtaatgtcttcaacaaaaaaaaagcccacgaaaaaacaaaaacaaaaaaactgaatttgtcaaagaaaaatgctatcaaagtgacttttttattaactctgatagttttgaaacatctccagctgatacgtgtttgctgtggaagcttgttcgttttgcctccacaagctacttcttttaatctttctgtttaattggccattgcttgcactagtaaagctatcagtaggaggatattttgaagtaatggaatgcttaaatctcagctttgtttcttttttatataaagggccaggaccatggatatttagagtataaaaacttcccctcccatcttaaaaacgcgtagtcctcatccctggtcatggcttttcttctctctttagtttccactgcagtccctctatatattagttaatacattatttgatataggtattctataatcattcatttctttaattcctttctgcaaatgagtttccttctgcccatatatatttgagtaaagattttcattatttcatttattttttttaaacattcaggaaacctctattagacatatttttcttgttcaagaaattatgagatgtagcattagagagtttgcacttttgtgattactattttaacattttaaataatagctttatttgaaaaaatgcgaataataaaatcaattctttttaacttatagaatttggtggtttttttagtatatttacaaagttgtgcaaccattatcacagtccaaatgtagaacatttcatcaaaaagaaactccatctccattaacattccttccttatctcccccccgaccaacccctggcaactactgatttacagttctgtctctttacatttgcctatctggacatttcatatgaatgtaaacatacaataagtggtctttagtttttgttttttgactattttttcttcttaaaaaaactgacctctagtcctgcagatcaatatgtggtgtttgggactggcttcttacatttagcatgacattttgaaaattcctgttatagcatgcctcattactttatttcttttcattatagaacaatatttccttgtatgaatgtgccatagtttgtttttgcattcatcagttgatgaacatttgagttttcccaatttttggccatcatgaataatttttctaggaatattatgtataactttttgcatgtgtttttatttagttttggatttataactaggatgagattgctatggcaactgtgtttaacaatttgagaagctgctaagctgttttctgaagtgactgcattatattgcatttccaccaacagcattgagagtaagggttcagtttctctataccctcaccaacacttgttattgtcttttatttttattatagccaaactagtaggtgtgaaatggtatctcatcattttgttttgcatttccctgacaattcaagatattgatcattctttaacattcttgtaagccatttggttatctcctttggagaaacgtctatttaaatccttttcccacttaaaaaaaaaaggttacttttattttcattattgaattgtaagggtgttttatatattctgaatataaagcctttggcagataggtgatttgcaaatagtttcattctgtatgttggctttttactttcttgatggtaccaattgcagcacaaaattttatccatttttttcttttgtcacatgtacttttagtgctgtaattaagaaaccattgcctaaaccaagatcacaaagatttgctcccatgcatttttctaagagattatagttttagctcttacatttaggactatgatccattttgagttaatgttttgtttatggtgagaggtcctggtctaactgcatttatttgcatatagatacccagctgttcgagaaccatttgttaaaaagactgttctgtccccattggattatagtatgcttgttgaaaatcagttaaccataaatgtaagggtttatttctgaactcttgatttaattccattaatatctatatctagccttgtaccagtaccacatgattgtaatgactgtaatgattgtaatggctttgcagaaatttggaaatcaggaaatgtacataccccgattttgttcttttttgccgggtctgtcctgcagaccctggctgatggacgaaatgagtactcagacacaggtatgcagtgtaagagcagttaggtgactgcctggctctagtggccagacagcagcccctagaagctggacctgcttgcttttattcagtgcaggcacaatgccaaaaacctggagccaacacaacctgtaggtaattaaaatttattgttcccctttcggtgaaggtcaggggcatggatgatcaaaggtcagttcctggtcaatataagtaaacaagcctgtttaaaataaattcccccaccctcccttgtacctattccttgcgctctgcctcagggttatagaataggtgtcttcagctattctcccccctgggctctgcagaaccttccgacctttcagaaggtttgcatcctttccctatagtttttccaaccactgtgacagatcccccacactttttcaaaattgttttggctattatcggtttcttgtcagaaatattttttaatcaagtttccagttatatttgtttttgtgaaagtttttggttaaaaaaatgctatcaaaactaatgtattgaaaagaaagtctccttcccactccaaaacctcagacatatctgttcactaagaactgctgaaaaacaatatgtcattcaataaattatacatgcatgtattattttataaatattttattttacaaacatttctatagtttgccttatacattaatgatattacctggtgctcatgccacatcctattcattaatctgtctaaatgattgaatagaattccattgtaatgatgaattacaatttatttaaccagttccctaatgattaatatttaggttaattatgattttttgctattatactcaattctgtatgaaaatcttttctgcatttatttttatatttttgaaagcatatctgtaatgtcggtccctagaaattgaattcctatgtcaaatataaggggattttacatttttaagcacacagacaaactacactccgggaggccttcaagaacttacaaacttagaacaatttttctacatctttattaaccctgtgtgttatcaaattgtgttgataattgtgaattggtagatgtaaaaacattatatttgtctgaatatatgtataatagtgaatgaaaattgagcatttaaaatgtttgtaagtaacatttgtaattgtttttctgtaaaatccttattcttctttgttcatatttctatttgaataatggcattattgaattgaaactatttgttcatattgaaataaaccctttgtcatgtttcttttacttaatcagcataactcctctgatgggatcttcatatcattcctaatagaagattgattacccatgtatatttgactagggttggctgggagcaaagggaagaaaacttttatcatctagtataacaaaacaaaagatatacaattcatacatattatttcaatatgaatttaattcattttacatgacttttattttattgaaggtataaattacatataatgatgaacacaaatcagaagtatacaacagatcaatttaaataattgtaaatgcccaaataacaacgtcccatatcaagattcacagttattttagatcctcctttctcccttccatgtatatggactcttggatgcatatgtggtttttttccagtgtgagtgtatgataaataacactgctacaaacacttacgtgtctgtcttttggtggacatatgaactaatttcttatggttgtctatgtataacaagtgtaattgctaggtcacagagagtgcatatttttttgtgagtagaaaatgccaacaaatttctgaaagtacaccccacaagcaatgtgtgagatttctggttgtcagcatttgttattgtctacccttttcattttagcaatctaactagtatatcacagtatcacaatacagttttaacttgccttttcccaatgacttacgatgtaagtgctttttaatatgcttattatgcatcttgatattatctttcatgaagtacttgtacaaaatttactaactttttaaataaggttgactacatattaatttataggaatttaaaaatgtatttatatatgctagatacaactctttatattttttctatactgcctttttcgtacactatctcttgaataatagatatatttacttttaatgaagtccaactgatcctcctttttatgatattttacttattctgtttataaaatccttgctttctcaatgccatggagatagtttcctatattttaccctagaaaacttattaccttatttttcacatttaaatttatgatctatctcaaattatttgtgtatgcatgtgtggtgtgagatagggttttgtattcccatacagatgtccagttgatccaaaatattatattgaaaaaacccctcttttgccactgaattgttgtgacacatttgtcgtaatcacagttaataataattgtaaaagtcaaattctagtttctctattctgtttcattagtctaattgtgaatttttgcaccagtatgcatgatctaattaatacagtttcacaataagtcttgaaacctggtagtgtatgtcttgcagctatatttttctctttaaagattgccatggggaaatgcaaatcaaaacaataaataataatgagatatcatttcactccagttagaataactactatcaaaaggacagaaaataacaagtgttgatgaggatacaaaataaagggaaatacttgtacatgtttggtaggaatatagagtagtacagccactatgggaaacaatatggaggttcttcaaaaaactggaaatagaattaccgtatgatccaccaatccaactgctaggtatatatccacaagaacgaaaatcaatatattgaagagatcactgcactcttgtgtttgagtacttcacagtgggcaagataggggctcaacctaagtatctgtcagtggatgaatggaaatagaaaatttggcatatatgcacaataaaatagtgtttggccattcagaaatgaaattttgccacttgtaacatggatggaactggaggatgttttgttaagtgaaataaactaagcagagaaagatgaatattatatgttctcacatgtaaatgggagctaaaaaaaagtacatctcttgcagttagcataatggtggttgactgaggctgggaagggaagaagagagggaagatggggagaagtttgttaatgcatacaaaaatacagttagatagaaggaataagtactagtattcaacagtatagtaggaaaatgacagttaacaataatttttgtatatttcaaaatagctagaggagaagaaaatgcacacaacaccaaaaaagataaatgttgaggtgatggatattccgattaccctgattttattattacaaattctatctatgtatcaaaatatcacatgcaaccccagaatgcatcaactatcatatatcaattaaaaaatataaaaagcagatctctatggatattgtagattctttgagtttctacatcaattttagaattctatgtttgatttctataataacaaaaactgcaactacaatagcaacaatataactgatattttggttggaatagcattgaatttatagataacttgagggataattaacttttaacattatctagtattcaattcatgaaaatatcatatacttctacttattaaatcttctttcagtccttccaggaagcattttgtaattttcagtgttgtagtcttgcacatattccattaccctttttccccaaatatgtgacattttggtctctttcatctcgatatttttctttaatttctcaataatttgtttctagaatatgaatatgctgtgtatttttgtttattgaccttgttttcagtgacttcattaaattcatttaattataattgtttataggtccctttgcaaataaaattagttttcccttttatattaaatttttatgctttatatttatttttcttaaattattgcactgattaaaacctgcaacataatgttacataaatataatgagagtgggtacttgttttctttccaacttcagatggaaagcattcatatgttatctattccttttttttttgtagttatttcttatcatactgaagaagttcccttccatttctgatattctaagagtctttagcatgattgggtgttgaattttatcaaataatttttctacaacaactgaaataattatgatttttttcttgtactctggtgattttgtaaattgtattgacacggtgaattatattgattgatttttcaaatgttaaacaaattttacagttgaggactaaatacctcttgattatgatctagcaccatttttccaagtaagttatacgaagtataaaatgtttactttgatgataaatatgaatacttaatttgaatgatatcactggatatgtatcaaagaaatgtttctcaagtcatgagactgtaaaacttctctgtcactcagttctgttcatagccatgcttacttcctttcataagcaatgtaaggttttttccttgacagacattatttgtctgtttgagacatttcagatattcacatacttgaaagagaagtcacctgatattaagttaagtagataacttagcttcttactgatgctacgaagacttttctattttccctttcctaagaaaattatactgccactttgtgactcttttttatgtacgtattctagcccaccttaactctaactctttctttaaatgaaaatcgtatatatttaaagtgtaagctaggtgattattttgctcctttttaaggcttaaagtgagtattaattaccactgacaaatgtttcttgagtatacggagcaccactgaattgtgttcttcttatttaatgccaaattctaggaccttcttggaaatcatattcttaactgaaaagaaaacctgacagtaataatatttgtcagataacaatatacaaaaacaaaaatattccaagtaaatacaaaaataaatattccaaatgatttatgacaaggtggtagacataaaagtattaattgagagatatatatgaaaatgtgatttttaatcagagttataaattatcaatgtacaataccttgccacatggcaggaaaagaattgttttagatatgaataggtgaaactgcatgatgggctatgagttatggcatttcaaaattgctgattgacctagattagaagctatttgaatttaagccactaggatgggcgatatttttgggaatgagttttctttttttattaattctagttatcccaacatcaagcatggtatctggatgattgctttaaaaatgttgttaaaagatacaaaattatatctagatgggaagaataaaactttggccttccatagcactgtaagatgactctagttaacattaatatatagcttcaaacagctagaaggaggatactgaatgttcccaacacaaagaaatgataagtgttcaagatggatatgctaattgccctgatctgatcgctgtacatcatatgtatcaaaacattactgtgtaccccataaatatgtataattattatatgtcaattaaaaagaaaaaaatttaaatgttgaatgaggtaaagaatgaacaggccaatgaaggaagagcttggaatttaggggaaatcaggaaatggaaaaaatgagagtcttatttaggatagatgatgaaaacatatgtgtgtaatatatgctatctttttttttttttgctattctgtgtgttccagagaggcaattttgatatgatttaacaattccatgatatggagataaatggaaaaaaaatctgaaggaaaataagaagcagattatgctgctgaattctgaatttggggaactgacacatgatggtaatagataattgacgtatagtgaatggaagaatattaaagctgatgttttcaagggtacaaggaaatgggcataaatgaaaagataaatggtgtgatctcatttcatattgtttccttggttttaaattgcaccttaaggtcctttgaatagggctatagtaacaacgggaagcccagagatgcaaatgctgggaagacagagaatggaaaaaaaaaaaaaaagggatactaggccccattatacctccaccttacatcaagtttggtgggtaagtgcagtgaagggaggtagagttgcttttgaataggagtaaaggttatttttgaaaagatgtgcattctgagctaggggtgacttctaattgggagaaatgtttgattttagacacttaagggggccaggatggagatgagggaacagaaagcaggtcactagatacttatggatgactaaggtttaagggagagcagtaagtggaatggactatatgtttcttttaatttatgcagtttttaccagagtagaggaggtgggctttaaaattggtttcgatgattcacgcatgtgtagatatttattgagcaccttccctagatacagctatcctacataccaggatttcagcagtgaggaaggcagacaagttaagggctactgtaggaagggtgctcaagggagtcacatctgaagcaggaggagtcagtcatatagccatctggggaaagagtgtgtcaggaaaggaaacaccaagttcaagagcactaaggtattgtttagaaatgaaaagaagttcagtgtatctgaaacatagagtgggaggatcatcacacggcacaagtttgcagagctgagcaaggcacagacagactggaaagagttgaaaatctacttaaaaccaaggagaaaattgttggaagtctctaatcaagaaagtgaaaaaatctcgctttatatttttaaacatcacccaactgccttgtggagaatggactataagaaagcagaaatcaaagcaggaatttaggtaattacaggagtacacatgagaaaaaatgatgacctgtggctgggcacagtggctcacccctgtaatcccagcactttgggaggccaggcaggtggaacacttgaggtcaggagttccagaccagcctggccaacatggtaaaaccccgtctttactaaaaatacaaaaattaacgtggtgtggtggtgcacatctgtagttccagctacttgggaggctaagccaggagaattgcttgaacccgggaggcagaggttgcagtgagccgagatcgagccactgcactccggcctgggtggcagagtgagactctgtctcaaaaaaaaaaaaaaaaaaaaaaaaaaggtgacctaaccaaagcagtaacagaaaacatggagacacagagatattcttgggatacatactggagaaataccctgaaattaattatgtatgggacacggtgggaggtgtgtcataatggacacacacacacacacatacacacacacacacacacacagcatgcttcttcctatgttcttatttactgtatactgatagtttggttatatattaaggttttttatgctgcttaccaattattttactttccttctttattttctgtgtgtagtaaatttattgtctgacattgttcacaaatttaaaaagtaatcctataagaggtagcgctattgctttattttgaaacatggtgaagttgttttcacattgacctgggagccattgttgaaattaaaaaacctcaacctctcataaccgacatctctgtgaagggccaaggatcactgacacatgattgcatatgttgtcaactgttctcccttgagtatcttatttactctatttttgatcatgtacgtatgctttttaaactttcccattaagtggctctaacactcagccttttgagatttaatttgttttattttcaacaagctaaaaggattgtcattctcttagattgtttatgttaatctcattaatgtaaatgaaagttaaactaatggggaggattgtttctttttttaaagctatgatttccttctggtagttactattgtatgttaatgcatacacctgcttatctttttaaagtgagactaagcactgacaacaaatttaattaaagatgaaagtgatctatttgtgtccacatttactcaacctgcttacatttgcagttttgtgcaaaagtctaaatatcaaaatttctattactgaaaccaatatgaagaatttattgtatattttttctgcttatattagtttgttaggactgccataataaaatactataggttgagtggcttaaacaacaacaatttattttctcacagttcaaatgtcaaagtgccagcagggcagttttcttctgaggcctctctgcttggcttgcagactgctgcctttttcctttgttctttctcttcttatgcatccctggtgtcgctgtgtgtcctaatcacctcttcttataaggatgctagttatataggattaggacccaccttagtgtcctcattttaacttaattacttctgtgaaggccctgtctctgaacatagtcactctgtcataccaggggttagagtttccacatgtggattttgtggggatgtaattcagaccataataacactgaaaagtggaacgaagcaaattaaaagtatgacagtatgccagaaaattgtgtggaatcagactagactgatcagtgccagaatgctattttattgtatgttactaaaatctgtaaagttctgcaatgaggtggaagaagtttggcactcatcttcaaatgatgacattcactatttatcccctgcctatcccaacacacagagcaccttggaatttaactgcaatccccagcttggtacttaaatccccttgactaatgaagaccctgcaatgaggagtgataagagacatccagttagacaaaacaaaacttaatttcactctgcatttatagtccagaacccttttctatttgccaagttgtcacattatgtagatctagcccatcagatacaattgtaggagcttttcttatagtaagtatccaacacatggcctgtgtttgaaaaacgtttgctttcggagtcacagagacctgattatctcccagccgtgccacgtaatgttagacatcagcttgctcatcgatgacaccctcataggattttggtggagattaatcactatgacatagatgtaatgctgacacacatattcatacttcatagattttagggcaattagaatgcaaggatatggtagactgtcttttactcaattagtcactcacttccatatttgtttctctatacatttccatatttgtttctccatcaaccttacaataatatgaaagagcctcacatttttctagagatatgggttcagtgttccagaggtcttcagaattttattttttagttttgtcctaatgccagtatatgcaaacactgatggattaacatctttatgttttaatcatttattgctattactaaaggaaaattattttgattgcgatggggtatggtaaaaccactcagggactctcaaacctgaaacaactagtatttgtactggtggcttgtattgtgcattttttgtctgttattctcagaaatgactgccctcagaatgtaacatgtacttgaaattaaaaacctcaccctctgccttcttagatgtaaaatttctctgtatgtattgattaggaattggagcatttttactcaaagttttaacttacactaaacgtgatgtctttgaaaggactgttgaaagttaaaccttatattagcccattcttgcattactataaagacaaagaaaactaaattatatccgagtgcaatagtgaactgacctgttggtgtcagaatagtggaatcatcaaaaaggaggaactaggaaacaaaggatttgaagtggcctcagaaacccaagcgcaagaggctacttttgcatgccaaatgccagttatgtagatacagccaataccaaagtgtgcatatggaagaaaaatataaataaacctgaccatgaaatacagacagccatattctgagctgcaaactaaatgaaggccttggtgatgggagaaaaatattcgatgttctacagccagccagtgtttgccctcccttttttcttactactcctttcttgtttttgaaggcatcatgtgtgttgggaattggcaaaaaagcttattctgagtaaagcaatgccagttgtttggcagatggaagatgtgggataaaccctagcttacagatcctcccagagtacaatcgggaaaagagctttccttccagataatatacctagtgagaaatctgttcaattgggtgaggcgatctacagtgaaaaagggacagagctagagggtaggaaaattttcccctcgctttatctatacagcagacttttctttttctcactaagcactaacagcagcaaactattctcaatgccactctcatccccaagctaagatccaatagcttgcaagtgcactttctgtattgcaggctgtcaagagggtccaagagtaattctatcagtaaaaacgtattcaggttttccttgaaagagctgtatgtgggaacaactgtattttctacattaaatttatgcaccattatatgctacatactgtatgtatatatagatgtatatgaaaatggacttgcaaaaatatttctaaattcatgtgcaagttaaatatttaacatatgttttgcatatattcagctactaaaatgatctaaatttaattaagtaaaacactaatttttcatgaaaggttggtttaacagaaaatgataaaatgaataatctgtcaaaaggatagcaaattttattattatgatcctaaactaccaaacctagaaatttcatattcaagagaggggtgatttatgaaggtgtaaatatgcatgtattaaaaatgttttaatttttttagaatatctgaaatcccaaatttataatcaaactacaatgaaattttagttatatgtgtgagatgtctgcttttccataggagtttcccatgaacacatgaaaactcctttgttttaaatttcaagatccaaatattctgtggtaaaagttgctcagtgatgccttcttagatataaaatttctatatatatagattgtgaactggagcatttttattcaaagttttaacttacactaaatgtgactgtctttgaaaggactgttgaaagttagaccttatattagtccacttttgcattgctataaataaatacttgagactgggtaatttataagaaaagaggtttaatgactcacgttctgcctgctgtacaggaagcaatgtggcttctgcttctgaggaggcctcaggaagcttacaatcatggtggaaggcaaaggagaaacaggcatgtcttacatggcaggagcaggactaagagagtgataaggggaggtgctacacacttttgaacaaccagagctcatgagaactcactgtcacaagaacagcaccaaggtataaatctgcccccatgattcaaacacctcacactaggccccacctccagcactggggattaaaatttgacatgagatttggtcaaggacacagatccaaaccatatcaggcatatattgttattatcatatcaataaaacatgaatctgaaggcaagctgattttatcttttaaaattacattaacactatttagtaacaatactcatcagaaatagcaatgacaccacaattcctcctttataagttgacacctaaagtttatgttcattgaaatgctgaaaaatgagcatgcataagacattataagggtgcagaaactttcaaaacatgactttgtgttttagattttaaaattatttgataccacatgttctcacttataagtgggagctaaacattgagtacttgtagacataaagatggcaacaatatacattgaggactactggagaggggaaggagggaggcggaaaggattgaaaaactgttgagtactatgctcactacctgggtgacgggatcattcataccccaaacctcagcatcacaccatatactcatgtaacaaacctccatgtacccctgaatctgaaataacagttgaaattctaaaaaataaataaaataaaataatgaaaaataaaataagattatttgaagtttaacagggattgtaagtttgttcgaatagctttagaaaataaattatttctaagttttcttttatttctggggaaagtcagagagacctgatgttaaatctagttgtatcactcatttgatttcaggcaggtcaggtagttcttaagcatcagtgcccttggtggtgaaagagagatatgagtgtatacctgcaggattatgtaagaatcagttgacatgacatacacctaagtaccaacacacatagtatgcgctccataggaataaggactattagactggtatgatggaagacttcttctactcaagttattatccacttttcatccagttttccctagatctttctatttttgtgacagttaacagacaatcattgaatgagatggtattaaatataaatggagttttgttggtattttttaccctactgattagaaaaattggcacagatatggtacagcatagaggggatgaactatgcatgtgtatagcagagaatggatcagaaattatgctggatgacagctgtaaataatttctgcacaactgctgaggctttatagttccagaatgtttatggaatttggaatggtagacttcatttcaaaaggagaatcggtggtgaatgttgatcacaaactcaaactgccataagacaggtcacataaaagagagaaggagtcctagtgaaagaagccatcaaagtggtagccagacagtgtgagagccagacattgcctgtgacctgctaacttacaccctttggaatagcatttaaaggtattactgctgtgatacctttatgtttcttatgtgtaaacagataatgtgttcatcctttcccatacatgaagtcttcttaggcaaagttctaatgcatgtggatttactttttaaacaggaatgttcttaatttagtgtaaataaattttactatccgattctgtgtggaagttgtatattatttagtttataatgttcttattttctgattctacccttattacacaattgcttccagaaaagtttatcatatttatacatcaaattatgattttttcatcttcatactgtgaatattggaacactaggtaatgtttcagtatcacatagttgatattcagtatgtattaatctatgtgaattagagtaagttagaaattcagcttctaaatataaaggaaaaacagacaggtgatttttttttcatctgaggaaataaatatactgtagttaaaaaacaaactaaaagttgctggtaaacatgcttgaattataaggaacagtcctactttgtgtgtgtgtgtttgtgaatctaaaagatgcccataagaaatggaatgaaaccattaaggccaattttgcaaaaggccaacaagaatgtctcattgatatttttttgtttcctatacaatatttttattatagatgtggaaatgcaggcattttccacaactttcctcctagtcttgagttctctaaaaatttcctcaaatgatgtttctaaacagcaaagtatcccatcattagaatttttcagatttagaacctatgtaaaatggtaagacatttcattggcttgcaaaagtctctgatgtccgcattcttacttaatcgcatagagctgtgttctataattggagtattttatctagtgttttctctttgaggatttattgcattgaaaaaatttggtgatattgaaagaaatccaaagaacagaaacagagataattaaaggaatgaaaagtggaaactgtgagggaagattaaagacagctgtgatcatttagtttggaaagaggtaaaaatgatcttcagttataggaaagatttaatatggaaaagaacagttagtctccattgatacaaacgatggattaagataatacgaactgaaacttgcagaaagacgaatagagagcaggctgttatagacaaccctgaagtcatttgaagtgaactgagtccttagtcttatttccttgactgctcagtcaccaatggatagtccatatttggtttgctttttaaaaaaaatttccatcaatatttacaaagtaaggtatatgaagaagtcttataaactaaataagttttgtgaaaactcaaaagttagaattgtaaacaagattttagcaaatattttggtacatttatttaagtacttcaaatgaacttttcaaataaactcttaatatactttcattttttgccacggaaaatagagagcctagagtaaaacagcatatacccacgtttcccaaactgtgtattaaagcgccccaggaaaccatattaactcaaataggcaccatggattattttaaattttaaggaaaatagtgatactcaacatctgttaaacatcacacagagtacttcctccaagtagttcacagatttaacattagaacacaatagtttcttttgatgatatcacatcgttgagaagcagagttttcagtgcttcctgtggtaaaaagcaagtaccatggggaaatcagcgtggaataggatatataggtggtggtgtctaattcgattccaagttttaagaagttgcacaacatccaatagacacatgttattagtaatgttgattacgtaagagtaaatctttttttctttcaatttatgtgcattatttttttcaaattgctactcgggtagaccataagtatgttttaagtagtgtgggcttaactattaaactggcggtcgtattacaaaaaatattcatggagtgctgtgaaaaattataaggcaagtggatcgccacaaaaccagaaaattgagagtattctttgttaatttgtttcttattttaaagtaacaatgtgcatcttatgtgcttcacaatatgcttacattggtacaagtaggggttagaacaaatcatggtacatttgtgacagaatattaggtttagagccataacttgattgttcatttaaatgactttcatggtcagaggttctttttctagacaatcttgtagggttttagaaatatttcttattaattataactaatatcttgtaaaatgaagattactttattacttctttaaggcccaaaatttcttaagtgctaaagaatactttagtggtaatctgtgtctgtggctcttatatttttggtattggtgaaaagcatttattgtgactataaaaattttaaacattttgaaatatgtgaatatgccttgaaatatattaagaagctttctttaataatagttttcccaaattagaagtgcactgtcccttgaggaaaaattggaatcactaattatgggcttaataaaatgttgctaataggcaggaatggtcagccctgaattaaaacttctactagtgagaaaatatgaatgaatgtaattctacattttattcaatttccttttttgctatattttcccaatataccagtttgtttgaaaatgatgtgttagtaaaatatgtcctccaactctaacaatcagtttatgtatttttttattttattttattattattatactttaagttttagggtacatgtgcacaatgtgcaggttaattacatatatatacatgtgccatgctggtgtgctgcacccattaactcgtcatttagcattaggtatatctcctaatgctatccctcccccctccccctaccccaccacagtccccagagtgtgatgttcccctccctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatttccttcgcccacttgttgatggggttgtttgtttttttcttgtaaattggttggagttcattgtagattctagatattagccctttgtcagatgagtaggttgcaaaaattttctccaattttgtaggttgcctgttcactctgatggtagtttcttttgctgtgcagaagctctttagtttcattagatcccatttgtcaattttgtcttttgttgccattgcttttggtgttttagacatgaagtccttgcccatgcctatgtcctgaatggtaatgcctaggttttcttctagggtttttatggttttaggtctaaggtttaagtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggggatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgcttgtgatttttgtacattgattttgtatcctgagacattgctgaagttgcttatcagcttaaggagattttgggctgagacaatggggttttttagatatacaatgatgtcatctgcaaacagggacaatttgacttcctcttttcctaattgaataccctttatttccttctcctgcctgaatgccctggccagaacttccaacactatgttgaataggagtggcgagagagggcatccctgtcttgtgccagttttcaaagggaatgcttccagtttttgcccattcagtatgatattggctgtggttttgtcatagatagctcttattattttgagatatgtcccatcagtacctaatttattgagagtttttagcatgaagggttgttgaattttgtcaaaggccttttctgcatctattgagataatcatgtggtttttgtctttggttctgtttgtatgctggattacatttattgatttgtgtatattgacttcagtgatgcattatagattcagtgatttttatgtacttaggtagcctcttgaattgagctcctgaaactttgcaatgtaatgtttatcaaagtacatgtgaccatagagatatatttctaaccatttccttctcttttgagaatccaaaacccatgtggtacccacataaaaaaccaagcatttattctgcctcaatgccacattatttgtcattacatttgaatcataggtgaagagtttgaagcaaaatcaaattagtatctgtcctggtttatcatctctttgcaaattggacatttaatttttttataatagtgcacaagttcatattacatcattgtcagtttgtattagtattgctatatatgctggccataagtctgtaaaatttgacaagttaactgaaggactaatcacctgaaatgcatctgaccagtaaagataccatcagaatgatcatactttaagtttccaaaaatgatttggtgtttctgggaattttagctacaacagaatttaatgatggttcagaattatatgatattgtagtatggatactcttgtacatacactgaatttgaaagagacattcttgtctatacatggaatattgaaatattaaaatgacagttatccatgggttataattttttcttttgtgaaaaatgctaaatattaatataacaaaagttaaagcctgttaattttgtgtgtgtgtgtgtgtgtggtctacacactaagaatgacatatctaacataaaacattctttgagtaatatgaattttagaaccattgcctgtgtgttggccagttcacacttaataaatatttaggtattgtgaaattagctctaataccaacatattatcttgaaaggagaatcagtcatcttaatgatagtaacagcctcttgtaaattttattaagtatattaagaacaattcctttggttgaggcaaagtttaacttccaaaatgatgtaaggtgaatgatacttcagagtactattcttttgcactatttacaggttacagtgtcaaacagaattattggcatattttcattttaacaatcggaatatttggaggcccatggttctttgtcaaatatttgcgtatattttagtaaagctagttaaaaaattcacaaaacaagtaaaatgctcttcttgtatacttttgacatcagtatttctcatgttcaatatgtgctttaatattgaatgttcagaattggatgtgtgtgtatatgtgcacagacacatatatgtacatttaaattttgatgtttattatccagtatagcactgtgcacccaaagatatataacattacttaatgataaatttctgtgtttttttctagtattatcttgctgataataaatatacatagtctcaaaaatttatttctcttagatctaaataatattctttacattctgagaaatttgcatttgataaaatttggatattgaaagaggctaattctgctcttttcacaagtttatctttttgcaatcaaagtagataaagattattgctcattaagtattaaaaatgccaagcagtgggatttgctacagtttcacattgatggctgatctagaattgctacattttacaatccatggcacatattttaatatctcttagttcctaaatatagtttctcaaattaaattaatttaggcaaaaagataagttcactgacttacagaagttaacttaaggaaataattaagcacctcaccaagcaaccaggcttaaattctactgagaccctctcattggcctgccttgctcctttcctttctgagccatgctgattcttagtgcgtatgttttttttctccatgcactttgaatggaaaatcttatctccatgcacttaggatggaaatcttcttaggtggaaaatcttacctctgtttgcttcctggttttacattctgcatcctcaccattggggtggaacggactttcaccccagactcacttattcagaaatcgcagagaaagagcctctttggtccattttgggtcaaatgctcagccttaaaatggtcagcttgggccgaggcctaagtactgtaattaaatagatttagttagggaactttggggtttttattaagagtgtttccttcccaacagtagccacatcatttaggggctgaagtgaggaaggacttcctagaagaatggggatgcaaaccattttctgagttcagccttcttttcttcttgctgaatctctattcctgtaaatcctcaccagggatgcttccttatttcatgcagatctcagctcaaatatcacctttccctgcattattgtctaatattttgtactcctctttgcactctctctttttccactgctttattgttccttcacaacattgcttggtgttatttaagtgttcccttgtttatttttctactacactgggaacagtgtactgaacagtgaacttggcatattgtacgtattccagagatatttgttgaatgaatataagggaacactatgccatttccatagatatttttttctatttaccctaacctgaatttctctctgctaaatagaaagtatgcagggagaagtatctctgatgtatggcaaaagaatgtcaagacaaaatcattaaatgtaatggctagagttggacaatgaaagtgtgctgtaactcattagagaacatttctctgtatcatttcttccccatatagtaactgattttttcttaaataaagagatagtggcttcttggattccacaaaatcctttgatattttctataaatacagtgaatttggcctcaatgaagccactttttatgtccaatatatgcatttagaatacgaaagtataaatagcaaagatagtaatatgtgttttagttccgtggatgttcctaataaacattcaggtgatacctagggtgtttatatttagctaaactgactagataatccagtcatatctgtggtctctttcggtaaactgataattttctgacaaaatttatcacatttgactcattagttctttataagttttttccccaattcaaagcttaccttttcactctggtaaaatgctccttaaagaaaatttaccgtgatttctttagaatttttgtcactatctttaaaaaacaaattttcataattgtgaaggtttttttttagaaaatttcatttgagatgtgtgggaaagaggttaaaacaaataaagtgaagactaacactcaactctcacttttccactaaatgtaaattttatcacagtttctataccctcatccttgtcattaggtattatgcttttttgcagccatattcttaaggaactttttttgttttgttttgttttgggagctaaattctgttggcagaaagacaaaattttcccgtgttctgctctctagcatatctttctaattttaaaattttaggacctagagattttcatctcttcattttgaccatggtaatttgaagtgaaacagcaagatttgacataagaataaaagatataagttagaaaattcatttctgcagtttattcggatccattctggaataatttttcctcctatgatagattcttaaagcaattagaaaaccaagattttgtgatattactaatcataaaacaatgttaagttttcgtaagagagggccgatttgattttttttttttttttttttttgagacagagtcttgctctgttgcccaggctggagtgcagtggtaccatctcggctcactgcaacgtctgcctcccggttcaagcaattctcctgcctcagcctcccaagtaactgggactacaggcacatgctgccacgcccggctaatttttttgtattttagtagagatggggtttcaccgtgttgcccaggctggtctcgaactcctgagctcaggcaatccgcctgccttggcctcccaaagtgctaggattacaggcgtgagccaccgcggccgactcttttttttttttgagagagagtctcgctctgtcgcccaggatggagtacaatggcatgatctccactcacttgcctcagcctcccaagcaactggtactacaggcacatgctgccacgcccagctaattttttgtatttttagtagagacggggtttcaccgtgttagccagggtgatctccatctggtgacctcgtgatccgtccgcctcggcctcccaaagtgctgggattacaggcgtgagccactgtgcccagcccccaatttttttaatgatagtgaagttgaacaagttttttgcatttttggaaacagatttgaatattttaactttttaattcttctttgaataatttgcatgtttttaaaaaactctttcatggaatacatgactggcttttgaagtaaatttgttatatcaaaaccagtattttctcaggtgaagtggaatggaatgaaatagaattgaatagaacactgggatagagtaagtagaatgtcctggttgcaatatattccatgaattttgaattctaattctaactactgctgtttggtgggagttctcctacgtaagtttcattttattatggagtgtatgtaccatcttgctcatatcaaatattcctttaaattctataaacctcaaaatttccctctgtttaatacagaatattgactgcaatgatatcagattttaaaaatctgtatatcattcttgtggaaggaagtatatattcttgtggaaggaagtaaaaaagtatatattcttgtggaaggaagtaaaaaagttccaaagcctgttagaatctgtataaacttatggaatcattacttctttttgttttactacattaaattcaccttaaattcagtccaggtttttactttgagatatttcatatctgaaatggctacagcattctgttgcactcatctgctggagctcaagcaacttataaacatctttacattaatattcagaaatcagtttctatcatttaatatgtagtgtgggaatagttcacatatagagtttggctgtatctttgattccttatcctgtaccacatgagcaagatttcttcttctacacatgcctttggaattgcctcatatacactcaaagctttccatttaagcaatttagtgacaattgcattaattcaaatcatagctgattttacaactgaagtagaatatgattggggattatctgaagtctcctctaaaactctctcagtttaaattgatggtaatctactcctgaataatgaaatatttcaaattgtctaattgcatgatataaaatgcatatacaattgtattaagaataatgataaaatgagaatctctcttgctcttataaaagcaccatgactagtttttacatatgaattcaaaatgattcggttgattcttaacatttcataacaccaacctgttctacacattcattttagcatatattacttttagtacgtgattgggagttttactggaaatgtttctgtcttccagtctctaacagctttaagcttatattctaatttcagtaatgaagtgagatacctattcctacctcaaaaacttccctttcacaaagactaaatttcctcaaagattgagccttaaagaagcaacaagaaagtgcataaaaaatgcaaagctgattctttgcataatattaataggccctttgaagaaactgtagagtgaaaaagggatggtggtattatatcttgctaaagctgctccaaatcaaattatttctaaaattatacttaaaaactaaatttgatactgactttatgatacctatatcaaatattattttatcttgttttctcttgaaagtaaggagaaattgaaataatttgaatatccctcttctttgttatataatcatcatttttgaaagttttttcaggtttgtgcaatagagtagagcaagcaatattagattgatacttagtggatggttcttattccttatttcttcaaacttctcttcagagtaaagttttgataattgataattttaatcattgatttctagggtgatagctattattttggaaaataaaggattaaaattttcatgccgaaggatactgtttacattcatgtatagcatgcaatagggattttgtttatctggccattttgaggcaagaagggatattatgttgaagtattcatttcttatttttaaaatctgatatcattgcagtcaatattctgtattaaacagagggaaattgtgaggtttatagaatttaaaggaatatttgatatgagcgaggtggtacatacactccataataaaatgaaacttacttaagagaactcccaccaaacagcagtagttagaattcaaaattcatggaatgccacagaatcctgaatttggaagaaaattcagaagttgttcattcaaacttcacactaaaagcacctttcaactttacctgttaatcattctaaaccaaacttcctcaagtgtctccttaaataaaaggcacacttctggatttaaggaaaacaaagataaaaaggtcacaatctctaccttgcagaaattagttagggcagcctaagtacaatgaagaaaaactcataattttagtaatttagcacaataaaagcttatttcttgttaaatagatacaggggtagtactctgttctacagagttgttctgggattcagcctccttaccctgtccaactccacccttttctaattcctagcactcctattcattcaactattctttcaactagggaatggtcaaagagagtgagggcaggattgcatcaagagattattaagggtcaggcctaaaagaaggcaccacttctactcatatttcattggccagaatgtagtcatatgaccaaaccaactaatgaaagaaaagcagggaaatgtaggcaaccttggtgtccaggaggaaggaaaaaatagtttagtgacacattggtcagtccctttgaaaaggtctttgcagttgacttatatatctctgaaagattgtccctctagctcctttttgaccacttaaatgtcaccactttagtaaaatgtatatgtaaatttgaaattatctgaggactttaataaaaattttaattcacagaatgattctccttttactttgtgaatacctgtatctaccttattaaaataaggccattttcagttgtaataataaatagaaagtgtgtttttaagcaccattgtaacttgggttatcaaaaggtgggtgctgaatgttattaatactattgattttctttgcactttacttctgttaagaagcaggaatcatgtggctctcattgcatagacagcgtgaagtgcttgtagaaacttgcagttcaccctgagtgacagatctacactcacacagactgcatactaggctgcacatctgtatgaaggcattactatttgtagggaaaaaaagaacaatattatgcttcaggccaggaaagtcaaatagctgaagtcaatattaagatagttaggataatatttcagaaaagatttgcctgcttcacttggcgtaaatttaaatagtcaaacttcctaaacatttaaaagttaaaacaagggcttaaaatatatgatgtgagtttcacataatgtctacactgcctctgcctgtacctaatgggaaaatgaaaatcacttacatgttaaagtctgattggtttacaaatttcaatgactacccacttagtagatacatctattgtttttatatcattatttttatacaatgggaagttactaatataatttttcccatatcccaaccttttactcttccccttctgtttacaggatgaaccccaaagtctttagtttatcaattcagattttttttaaatgtagcctcactgggttttcaacattattttccaatctacgatttgctaaataaacttgttgctccaccaaaactgttctctccaaagtttgtgaatgtacatctctctcttgccctttatttctctctttctcactctttatttcatcacatgtgtagatttatgttattgtaatctgctttttacatttttttaagtactgacactactgttccatgctgcctctcatgagaaattttctagtttatgcagacttacctcagagatattgtagtttaggctccagactatcacaataaagggaatattgcaatgaagtgagtcacacaaatcttttggttttccagtacatataagggttatactatactgtagtctattaattatgcaatagcattatgtctaaaaaagtgcatactttaaaatactttattgtaaaaaagatgctgacagagacacaaagtgagcacatgctgttggaaaatggctctgataagctttctcaactcatggttactacagaccttcgatttgtaaaaaaatgcattatctgtgaagtatgatttaaaaaagtatgcccatagtttggttccaggactagctagtctctaataactagctctactggttatattttgaattctttgggattttctatatacaagatcatgtcttctaataaaagagattgttttattttgcctttccaaattgctttctcttgcccaattgctttggctaaaacttccagtacgatgttgaatgacagtggtgaaaatagacatccattatgatcctaatcttaggggataaacatgtaatgtttataaacagtgttgttaactgaagcattttttcttccttattctagatttattaaaaataaatagtagatttatagaaggcaaggataaacatacagattcctgccatgttaatatgtaatttaacaacaaaattatatgtctgtgctgctagatatgatagaataaaaatgatattgcattactaatttaactggaatctattttattattagtgaggttgaatatcttttatgtttcttgtgtgtattcttttgttaacatctcatacattttcctatttttattttcatgtttgtcttttaatatgcaagtttttatattgactattaacttttacccatcttatgtcttgcaaaagtctttcctagtatgacttttttaaaaatgcctttccatatagttttaaaattctgtggcataaaattttttatctttcattttattctttcagactacgtgtcctactttaaaagtcctatgtgggtataataaaaaatgagtaatattaggttaatctaccaaatattttttgaaaatttgacaaacccttgaaatccaaaatgcaaaagtattttatatcaattaccagttttaaattaggagtcacatttattgtaaaaataaacaatttttgatacttggagaaaacaaaaaagcattcgatacaagtagtccaaacaattagaaattttatttcacatgcacagtttagatattactttataaggggaaaacagatacttgagtatgacatggagaattgtgactttggagggtggcagcttcttagcatgatttcttttaaacttctggtataatcctgtgacatttctgtaaatgactaccactggaatccttttttgtggcccaggtattgactttcagaacccctcattaaaacatagttatggcatcagtctattaccagtccataacattattacacttatcctgggaaaataggaaatacaaaaaaattaatccctatttagaaatctctgcatagcagatatgattgtgttttacgtacattgttatggttgaaagtttttttttccccaaaatctatatgttgaaatcctaacctccaaggagctggggccatttgggaagtgattaggtcataaaggaggaagctctcaaaatgggattaaagcctttataaaagaggcgcaacggagtttctgttcatccattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatctgttcatccattttaccatgtgaagatgcagcaaaaaggtgccatgtaagaaacaggaagaagagggcttcaatagactccaaattttctggtacttttatcttacactttccagcctccagaactgtgagaaatacatttctgttgtttatcagaccccccagtttctagtattttgttacagcagccaaatggatttagacgtacattaacttttttttttttttttgagacagagtctcgctctgttgcccaggctggagcgcagtggcatgatctaggctcactgcaagctccgcctcctgggttcacgccattctcctgcctcagcttcccgagtagctgggactacaggcgcccgccaccatgcccggctaattttttgtatttttagtagagatggggtttcaccgtgttagccaggatggtctcaatctcctgatcttgtgatccacccacctcggcctcccaaagtgctgggattacaggcatgagccaccacacctggccgacatacattaacttttaatgatcacataatcctaattaagatatgcagataatattaaatagccacatgtgatgcatgaggaaactaaggatagtgtggtttaaataattttctcaaggtgacagagctattcttttagaaagtcagtattcatacctgggcaatttggctctaggctctatgcttcccacttgactggccagttttgattcaggaaatattctgagcacaatgtgctcaaaaaagaagagactcaactctgattagaatagaaacagtgaattcagactttgaaagatagtgtaaaatcaaggcctctaaatgtgttccagatgtggtactatccttaatgagagaatgtgtaattgtttcagatgttggtcatggagcacagtgaatttggtaattattgacccaacacaggtgctgtacaatacaggtactacaactcgattaaaattagcaaagactttaaaattgttagcttgcaaatataaagataatcaaggaatttgaaaccaataagaggaattaagatactaacctgtagggatatatatgtttcctaccaaataattagatcttagtagaaaatgtattagctctatgttcatctcagtgaagacctatggctcacagagctggaggcatcagaaggtgactggggaagagtttgtcaatacaggctttgcagacctttactgtctcatttaacactagacatgttcttcagctattctgtgtgtaggtagtgaaggatttgcaatcagaaggaagtgatctcaaatgcaatgactttgcacaagtctgttaatgtcttaaagtgttatatagcacttgttttatgttgtaggatcaaataatgtaaacaattgatagaaatgtaaagctctatgcatttctaattactttggtaattaaagtttaaatcaagaaccagagaagttacaaaattacagttgagaggaaaaggaggggagaggaagcagaaaggcagtgagcagacagcagagggactgctgggagagcagtaggcactcaaggcgcatctgctccatttcacccattacccatgggtaggcgctggatattgggccttttatccacagaattactttctgaggggaaatgtaactgtgactgttatgttggtttcttttcctgtgaagcaatgtgcaaacatcaaagaaggtttctattagaatcaaagtactccttgattgcaaaccttcttaaataatggatgacacttgaagatgttggttgtcatttttaataattaactatgtctaattttggcagtaactgaagctttattttctgtaagagcttgacagattacttgatttagaggagcaagagatttagatattgcatagtgctgagagccacaaattctgaataaatttcccactctctgtatgacattttcttttcaggtgaagttttctcctttcatgggtaaatagattacaggtagataggtaggcatgtaagcaaatagatatctactgtgtgtgtgtgtgtgtgtatgtatccagatagatagatagatagatagagctaagatacagatataaatacctaattgtattctcatgctgccaataaagacttacctgagactgggtaatttaacaaggaaagaggtttaattgacttacaatcccacatggctgggaagactcataatcatggtgaaaggcaggcaaaggaggagcaaagtcatgtcttacatggcagcagacaagagagtgtgtgtaggggaactccccttcataaaacaatcagctctcctgagacttattcactaccatgagaacagcatgggaaaaaacccacccctatgattcaattacctcccaccagttccctcccatgacacctgagaattatgggagctacaattcaagatgagatttgggtggggacacagccaaaccatatcattccacccctggcccctctcaaatctcatgtcctcacatttcaaaaccaatcatgccttcccagcagtccccaaagtcttaactcatttcagcattaaatcagaagtcaagagtccaaagtctcatctgagacaaggcaagtcctttctacctatgagcctgtaaaatcaaaagcaagttagttacttccaagaggtgggctcccatggcctttgaaagctctgcccctgtggcttcgctgggtacagcctccctcctggctgctttcatgggctggcattgaatgcctgtggcttttccaggtgcatggtacaaacagttggtggatctactatcgtggggtctggaggatggtggccctcttttcacagctccactaggcagtgtctcagtggggactctgtgagggggctttgactctgcaatttcagtctacactgccctagcagaggttctccatgaaggttctgccgctgcagcacacctcagcctggacatccaagcatttccatacatcctctgaaatctaggcagaggttcccaaacctcaattcttgacttctgtgtacctgcaggctcaacaccatatggaagctgccaaggtttggggcttgcatcctctgaaaccatggccccagctgcaccttggggcctttttagcaatggctgggatgcagggcatcaagttccaagactgcacaaagcagcaaggccctgggtgtggcccaggaaatcatttttttcctcctaggcctctgggtctataatgggaggggattccatgaagacctatgacatgccttggagacattttccttattgtcttggtgattaacatttggcccctcattttgcaaatttctgcagctggcttaaatttctcctcagaaaatgggtttttgttttctaccacatcatcaagctgcaaattttctgaacttttatgctctgcttgccttttaaacataagttccaattccaaaccatatctctgtgaataaataaaatggaatacttctaacagaatgaaagtcacctcttgaatgctttgctgcttagaaatttcttccaccagataccctaaatcatctttctcaagttcaaagttccataaatctctaggacatgggcaaaatgttgccggtctttttgctaaaccatagaaagtgtgacctttgctccggctcccaacaggtttctcatctccttctgagaccacctcagcctggactttactgtccatatcactatcagcattttggtcaaagccattcaacaagtctctaagaagctccaagctttcccacatctttgtgtcttcttctgagcccttcaaactgttccaacctcttcctgttacccagttccaaagtcacttccacattttcagttatctttagagcagcaccgcaccctaccagtaccaatttactgtattagtctgttctctaataaagacatacatgagagtgggtaatttataaaggaaagaggtttaattgtctcacaggctagggagacctcacgatcatggtggaaggcaaaggaggagcaaaggcatgtcttacttggcagcaggcaagagagcatgtgcaggggaactctcctttataaaaccatcgtatctcatgagactcattcactatcatgagaacagcatgagaaaaacctgttcccatgattcagttacctcccactgagtctctcccatgacatgtgggaattatgggagctacaactcaagatgagatttgggtggggatacagccaaacaatatcactaattaagcattataataatgaatagcttgataattacaaatatttttaaaaacaagtcattatgagttacttggaataatccataattgttactatattgtaccatagacaaagactttgtcttattcaactctgtattctttgaaattattagtaaaatattttaaacacaacaagtcctcactaatttggtgtgttggattgattttttaatgctgttatccaagtgattaatgaaattaaattttacttatatttttatttgggaaaattcaattcagtaccaggtggttttatttgaaaagaagccaataaactaccctgaacattttgagagtagacctgtctatatccatatattaatgtttgacctgaaactaatacacctgattgagaaaataattaaggtgtcagatggtaagtgtattttatttaataaacattggtattggacatccatgtgaggtattgttgtaacttaaaatattgggaaaatgtagctcagacagatatatatataggcaaacatacagatgagaagtctgaaaatatgccctatgttcctactgttttcaaactatagttattagtagattttgtgccatgtattagaactagccctaaagcctaagtattactgaaatcagaatgttaaatatgtgaaagatgtatttttgtgagatgaggaattaattattattttattttagtgctaggctacttatccatgagctttatctacttttaaaaatgtaatttgagaattatggctgtttatggatgtgtgaaagtaggaatattcatattgcattggggttaagcaatcagagaccccatttttgcaggtctcaacataaaagaggctgaatataataattgaaggagaaaataaagatattggaagttgcagttataagcaaggcataaatttagaagtaaataggcattacacatgtatataaataatgttggttgttactaagtgcttgtctattttgtttatattacacttctattactaataaaagtatagcaatataaattataatttatgatgaacaagcttcaaaatcatgatcagtctgtgagtaaattattagatagagtatagtctctgtattgagcatgttaattacatttgaaaacttaatccttgagtatatgtttcctacatgacatagcctcattattttctcaagatatatgtttatatttagtaatgatggataatcagtaatttccatgttaatgtttattggaatatttttctaaaagagaaaaaaacactcttttttcttcaacaactattactgatgtaacatcctttgatagttttcaagggtacattttatatccctcctaataaactgaaatgctgggtttcatctaggaaatctcatgccctgcaagttttttcatataactataaaatatcagaatgtggtagattttttatgtgctgatttcatgaatctcattagaaaatcctgttacttttttgagattgaaattttacactgctacctttgttacagaagatgattttttaaaatgcgtttttgattatcatgtagaactacagaaatagtgatgaatagagacatctgccagcacacatacagattgataatgactttatttgtactttggcctaatgtgtatcctgacagatcatcaaaacaagaaaagaaagagctcagcagacagtaagaaatggccagatgctcacagaatgatgaaaagtcattgtctcttatcttttaatgttcaaattatgcaaagaagacacttttattataaattttaaaaggaatctaacttatcaaacttaactgctacttcagggatatgccaaacattctggtctcgaaatgtttggttctcttcatcttctgtgttcatcctctcctttttcactatcagcctttctgcaaactagatgttatctctacctgggaaccttgaagatctcaagggctcccagaccattttgtaactgtttccctacatttaccttagtcttaaaaacctctctaatacattcattatttctggatccctccttatgttttagcctgtctaactccttctagcaacaaaatgtaatgtttatgtcattctgggcctcataagtcatttggcactgtactcaccaccacccgaagagtcccttaatatcttggtgaagatatagctggtatcttggtacagcactgagtatccctcactatctgtactctctgactgccctcccagggaacagagaaaagtaataagactaagctaatggattcactataaaatcactcattttcataattgattgatttaattctgggggaagaaacaacaggtctgtgttttaactttcaagactaaagagatgttctcctaattttgaaaaacatcccagatcaacaaaatatctttatttagtcccagaatcaaagggaatggacaaatctaaaccaaatccttgttaaatacagacttacatgatcatcttgcattttttttcagcaactgttaaccatggattttagtggatggaacagtagactggtgacaagggaattaattagtagaaaattgaattaattattacataatatacatctatttctatcattagttggaagaacaaatggaaacattttcttcatattcaaatttatgacatactaattttcctgccttgaagtacatcatttactctatttttatgttcattagcttccaatataatgatttaaatgtaaaacatatctatgtatgtactatttctagacactttggctttagacaatgaaagtcatagcaattctactatatttgatgtcttcaacttgaactggactctttcatattatgaaactttcagatatattattatcgtacagtagttttgtgcaagtaacttattcatttcattataactgtattaaaaacaaaacattttcaattttcacctaatgcggtttaaaattatgagttctgattctttggtgaattctacaaattagagaagtcacagaagtactgtgtgtcagctacaaagccctagggacttaaacagaaaaccatctcccaccaaaccataaaaataaatgctgatacaaagaatgttttgtatgctcaaagaaagatgaacttatataatgaacaataaaagactgtgtctactgtctttctctttctacactaattgcttttataacaaatcaaaatgtctaatatatatgattatttaataagaacaattcctttgaagttattcctgaaaatccaagaaagtagaagtcctctcccttcaaatacttcatgaaatagcattttgtgtgtacaaatatactttttatttattcacactaagtgaaagctcttaatgatagcccagtttcacagcttcttctttttatggttaaacacatctgtttgtttattgactctcctttttggaattaggttatgggagttcttagtatgacagttttagatatgatacagaaataataccaacatcaaataatttaggggaaacatgtggaaatggaaatgactaacatttcccctttgaatataattttgttagaagacaaaataaagcttagtatattattatataaagcatttgcttgttacccaaaataggaaccgtagaagctcggaaaaaagaaaactgggggctcctacctgtaattccagtgctttgggaggccaagtcagaaggattacttgaggccaggagttagagaccagcctaggcaacatagtaagaccctgtctttacaaaaaataaaaaaaagaaaagaaaggaaggaaggaagggagggagggagggagggaaagaaagaaaggaaggaaggaaggaaagaaggaaagaaggaaggaaggaaggaaagagagagaaaggaaagaaagaaaagaaaaaagaaaagaaaaggagaaagaaagagagagagagaatagctgggcatggtggtgtatgccagtagtcctagctaccagggaggctgaggtgggaggaccacttgagcacaggagttccaggtgcattgagctgtgattatgtaactgcactccagcctgagcaacagagcaagccccgtctttaagaggagaaaattggaaagttttccacagtgaaccttgagagaatatcaggagacacaatgaaggaggtcaagggaaatgtgagggagcttatgacccttaaggaaattcgatgaaactatgcaggtttatgacagtccttgccaatcaagtgaagcatttgaaagtatgcacctgtgtctaggaaatctatcagataccaatatatgtgttttctaccctaaccaatactattgctttcaacttactatgccaaaaactttatttagtattaaattaatatgcctactgtggaaaatgtccatgtattcattttaaattagctaaaaagcataaggagactttaagaaatgtttacctctctgtgaaaacaatataaaatatataagcattagagccaccatgtcagttgctatgcatttcagaattattctcttaaatatttcattattggggctgatttttataatccttctaggataccttaaaacagagaattttttctgacaagaaaagtactgatgattttttttaaaaatttttacttaaactgaactctatatttgctggtggcatgatgctttttagagcagtctgtgggatttatctattctatacctttccacatagctttgttacaacagagatgactataaaaattttaaggatttattttctttgtttccttttttctcagttcagtggagtctttaatacttttcttaatgtagccctagctttacctaatgctatgataatgctcactaacctgatatggatggattagagatgacttcataacctaacctaccttggcattttatttgactttatgcctactagtcattcaaagacgactcagaaaaaccaacatgatttgaaaacatgttctttttattctgactctcaaatgtcatgctagtttaaattttggcatagataaaaccattatgtcacatcattaagggctttctttattctatagctcttttgtttattgcagccacccatagtccaattgggtagacagggcagtttcggataagatcaaaaagcatatttttggtcttatcctaaagtatgggccctactttaggcgtattgaagcagaatttccgaaggtagggcacaagaaactgcatttttaacaccattctcaactgaagtttgatgactttttgataaacatgcttattttcatttcaaacttagttaaaattctctgtctaccgtccattgcctgaccctcatcctttttaacaacatagtacatgcattggaagtcacttatgtccacgcaactctctattttcaagttcagttttcctctgccataccttctttttcctcttgaccctcctaagtacttttactaagctgttttgaattcttgctctgtcaaggactatctatacatccttaactatcttctagattgttttagtcatttcctcttcttaaccaagatgttattccataagaatgatgctgtttgatctgaaacactctcaaaatgaaattgtgtatttttgcctgtccattgtgtcatggaagcaatagatggtcattgctttccttatctttccaccgtagatccagtagccttattattccacattacttgaagtaacatacaaataatacataagcttttcagaagatgaaaatgcgccacagttctagagctcaggagaaaaaattttaaacctagtgattctacactttgcctgaatttggtccaatagcatcatatcatgattcaatcagagaagtaaattcagtaggaaatatatattaagagattggttgcaaagaattggctcatctgattatggggactagctgggcaagtttgaaaactatagggcaggctatcagaaggggcaaacttgaactctcagccactggctgaagcttctatccattgggagaatttcttaaagaggtgtcagccttgcctttcaattgattaaattaagctcatccagattatgtaaaataatctcttttactcaaagttaactgcttatggactttaatcacatttataaaatgccttcatggtaacgcctagcttagtgtttgattgaataactggcctaggcaagttaacatgtcaaaaagatcatcacatgcaaattatttcatgtgaatttgtatgtatttgacatagttctttctgtgttggtacttgcagaaaattgtttcctaaatagcagtttttatgcatttgagatactcactaaagtcaatcctttttctgaaacccgttcccctagggaattctataaagctctgatatgctgtggagcctattggtcaatagtttgatagaatttatagctgtgtttcagccttttaatggctctctggaagtcatcaaaatccatacttaaatgccatgttcaatataattaaatatttaatagttacagaaaatctcttaagctttattctgattcctcccataacagcttgattaggggaaacatagctgtttacaaacagttctgagcaaatttgaaaaataatcatctctgaagaatttataataatttggagaaacattttagttaaacaccagattttctaatacatcactgatttaaatgacagccacatcatcattttgttgccaattgaaatcatgcacacctagaaatttttttgcattaaggtgctcacatgaaggaaaaaaaacgtatttcttgctatcagaaataacccaagcaacaaaccatgagattattcagataaatataataaaccactaatacatgagacatgattgtgctgtgaaaagtaagaatggcctttaaagggattgagctcttaaccagcacaatttaaaatattattaaaaaagaaacccatagaaatgaaaccctatattggactaagattctattagatctttagtattacaaaaacaactgctaactgtgtgatgtggttattcatgtttaaaaaaaatgcaagccaggtgcggtgactcacccctgtaatcccagcactttgggaggccgaggtgggcagatcacgaggtcaggagttcgagactatcctgctaacatggtgaaactctgtctctacgaaaaatacaaaaaagttagcctggtgtggtggcacgcacctgtagtcccagctactcaggaggctaaggcaggaggcggagcttgaagtgagccgagattgtgccattgaactccagcctgggcgacagagcaagactccatctcaaaaaataaaaataaaaaataaaaagcaaaacacttggtacaaaaatgtcctgggacaaattaataatggcacaatgccagaaactagcacatctttcctccttagtggtaattagtgcctttttacatgttgcacacacggagggaagaaagctcttcatcattgttctcccaactcagacatagaaaaacagaatgtcaggaacacaatgagccttcattttatagacatttggtactttgatgtctgtattatcttttggaaattattccttttagtgaaaacaatgaaggtcagagggcagatttcctaaaagcagcaattaatgtgaagtgttttaactattgcctccttgttccaaaactacctgcacatggccacaaacatatgaaagtgaatctttggtggccatagtaaacaattcagaccttggcccatagacagggttacacgtatggtggccctgtcttcatagaggccacctctaatgttaagttggaattgccagacccacttattctttctaagccttggtttctttacttgtagagtaggtttaattattagatattacagggttatcctgaggctcaaatgaggtaaagcactttgtaaattataaagcacagtgcaaatgttagcaattaccttaaatgattttaaccattcaaatgaaaagtgagaaattccaaccttggcatcatgtagacaaaccatttgaatgactgactcaatttctcagtcttctggagacttattatcatgtagctatttaaaacatgctggaatttttatcagatagtaaccagtctggcaggttcttttgtgaagacgtttgttggaaggatgtgttcttttacagtggctctataattggcatttaaacattttctcttgcattaaatatctttagtggtgcaatgttttgttggagttgcaaattcttaataagcgtatacccagatttttaataagcatatacggtagtaagtgattcagtgtaaaattcaaccagaaaatatccatcttctaagatgacagggtgttagacaaattacatgtaagattaagacattaatagagagttcatttctgtcaccccctaccatgccaactccaccccactctttgttagataatatgtggtctattttttgaattctttagaaaatagactctcttttttagagcagttttaggttcatagcaaaaattgagaagaaggcacagagatttcccatatactctttttccctctctataacatcctcccccaccatcaatattctacaacagagtggtacatctactacaattgatgagctgatattgatgcctcatcactcaaagtccgtggtttatgtgaggttcacgcttgctgttgtacattctattggctttgacaaatgtaaaataacatgtagcgaacattacagtatcatacaaaatagttatactgccctgagtgaatcagcttgctgatttacaaaaacgtttgtagaatttctaactggaattgcacaaaatatatagatccaaatttaatcttccatttcatgaatttggtacaaatctgatttattcttgtcttttaaacatttctatcagtaatgttttgtagtttctgtgtataggtcttgcacatcttttttttgtttttgaatgtattcataagtatggttttgctgctatgataaaaaatattatttattaatttaatttaaaaagtttatatttccagtttatagaaatataactatttttccatattagtcacatattctgaaaccttataattttatttattaattctatttgttatccttttagtcctaaactttacaaagatgatcaagtcacctcacaacagtgagctgtatgtcttcctttccagtatttatgccttttgcccatttgccttactactctggcggctaggacttccactacaatgtaaatagatataatgagagcagacatctgtgtctggatcccagaaatgcattcattcttttatcattaagtataaggttagcccttggttttccagatggctttacaaagttgaagtgtgtcctatctactcattcctagttcactaagaattttttcatgcatggttttgaattttattaaatgtttcttcagtatctatcaagatgattatattactttacattttataatccttcattttttctaagtgttcaaatttattggtctaaagatgttggtaatatcttatccttttcatatctgtaaatggtattccaaaatttcttctgatactgtaatttttgtttttacttttttcttaattagtcttcttaggagtttatcaaatttattaatatttttgaagactccacgtttgctttgatttttttcctatggttttcctgttttctatttcatttatttctgctgttgaatcatttctttttgcctactcactctgggctacattgctcttctttacttttcttcttacagtttcaaattaggtcactgctttaaattttttctccttttctgatatagacatttacaaccataaaggtccctccaagcactattttcacagtatcccactatttttgatatgtgtgtttttgtgatcatttcatttgaaagagtttctaatttctcattgtgattacttctttgatttatagattatttagtggcatgttatttacaaataatatgaggtttttctaaatactttactgatagtgatttctaattaaatcctgttttgatcaaagaacatattgtataagacatcaatcttttgaattttattgctaattattttatgaccaggcatatggtctattttggtgaatattctctgtacacttgagaagaatgtacatcccactgttgttatgtgtagtgttcaataaaagttaattaggtcaagggaatcaatagagttgtttagatctaatatatccttacagattttttttgttggttacatgttctgtaatgttctgagaggattttaatactaccaattgtggtgttgtctatttctctccttagttccatccgttttttttttttttttttttttttttgagacagagtctcgctctgtcgcccaggctggagtgcagtggcacgatctcggctcactgcaagctccgcctcccgggttcacgccattctcctgcctcagcctcccgagtagctgggactacaggcgcccgccaccgcgcgcagctacttttttgtatttttagtagagacggggtttcaccgtgttagccaggatggtctcgacctcctgacctcgtgatccgctcgccttggcctcctaaagtgctgggattacaggcgtgagctaccgcgcccagccagttctatccattttaactaatgcattttgaagctctgttattgggtgcatacacatttagaattgttatgtcttctagattatgttatggcatacttcaggtgttgcttttctggctggaaacttgtggccagtggtgcctctgcccgagttttgcgagggccccttgggcccatttggcccggcaaacagggctcagttcgcactaccagccgggatctcatgcctgccaagggcaagcagggcagcaaggggtgtgtgagtgagcgagcatgtggtctggccactgcccatagccaggtatgctggctgcagcagggcaggcagctccaggcgccaacatgagtgctagctccctgcaagtgtgcagctgcaccaggcataccataagcagtttccatgacagacaccagggaatgtggctgggcccagaaacttggagacaccaggaaccgcagagccctaaggaaggagtcaaagccctggctctgggagctcctatgtctggctcccagaagggccgcagctcttctctccttgtcacccgcaacattgtgagcaagggacgtatttcagccctgtttgttttacagctcttttagccctgccattcagtaggtcccgagttcttgttctgtgaccaggaagaacgaggtatgcagacaagtggagggtgcgcaaggagaagaggagctttactgagggtagagcagcacaaaggagacccacagcgggtagcttctttctgctgccagggtgtcctgaggagtgttcaggtcctagcagaggggaaaccctagagtgggtagctcctcttggcaggcaaatcattccattgagtgttcagctcctagcagagaggagaccctggagtgagtagctaatctccacagctggttgtgtcatcatctgtttagccctcagcagagagaagaccctggagccggtagatactcttgcaggcaagtcgtcccattgtctcttagtctgaatgagtctggggcttttatgggtctcagtggggaggacgtgcactccgattgttccatgggtggccatgggtgggcccagaaaaagcaccacaagttcccactctggtcagcaagaccagcagcccagcccccaggcttcagccactgcccctaacctgcttgaaggtggggcttccacccaagatctagtctgcctcctgcccagactgcccaccactgccatcaatctcctaacatcttttgccttattttactttaatttaatgtagccataccatttttttgtgtttaccattttcatattacatgttttctttttatcttcctttcaacatatctgtttctgttatttaatgagcatctttcattgacggcatacatttgtgtttttcttttatatctactctggcaatattttttaattggaatgttgatacatttatatttaattaatggaatttgatttaaatctaccatcttattacttgattttcgtacattccttctgtttttttcttctcttgcctactttctgtcttctttggggttaatcaatatttattcacatgttattttatgatttttttatattctaggtcatagatggcttaggtatttattgagatttccatagtacacgatgctatattatgtctttttatttctgcatatagtattactagatcaacttacaaaatataactaagaggacttctagtttactacatataatggaagggaagagagccaataagaactactttcaaatttttggtaagctgtcatgccatggactggaatagggtgcactaaaggataaaaggcaagaattcttggatttaattttgtacatttttaattagatgcctgtaagtcattgagaagtcgagggacatccttggtaccagctttaaatgaagaggtgaaagtttcaaattatttgtcatattattggcttttttttttttttagttttaaagtataaagaatataaaatgcaatttttttattttttgtgttctattctgaaataatattaaacattataaatttaattcttaatgtttaatcataataagtatttttatacttattatattcctttgaatagccttttttattgtcaaggaagttttttaagataaattagtctctacaaataatgtgctccatattccatgaccttagagtaaatcagttctacattagttgtgagatctcattaaaactacatcaatttccatagaatgtatttattttaaaaattactttgtcaggtttaaaattattttcttaaaactagttaactcaatgaagtggattcaagtttggatctcttcacaataggaaacaaattcaatgttagctaactatcccctgctgttcagtctcttgccagaaagctacagctttctgcccacacttacttgctagacatttgatttaataactgcacattcatatatattttttgaaaggaatgctgaaaacttctcatttgtgtatgagtaaactgaatcccaaagagttgagagatttgtccaaaggcagtgaagtcactgatacaagtgagaaacttggataaagcacaatctcctcacctttcctcattttttatttttaatttcatttcataacaattcctcaatggaaaagtaaatcattccatgatctcaaaaagctgtgatggatctatgagctactgagtttataagttaattgctcctttgttaaataactttaaatggctatttttttgttgttgcggtgttttttaaatattcatctcccatttccttcactctcagccatcattttggctactatcccagtgttgcctcaagtacccctttttcctttcttcaaatttgctccttctagtgtacttgggaaacactgatattagcccaattttctctaatacatacatttaaaaaaatttgtactaaatattataaatttgttcactctttaattgaagatatgcaaatatctaccactaaaaacaattatgggtttaagaaaagctatttctttccaacaaactagtgattatacctcattatctgatttgagattccagtcttaatattttcatatattttttaagtactagctcattcacattcatcattaactatttaagacaaagcattgtcttgaaaagtaaatacttatccgggtaactataactcaaaacacaatacctgattgttttgtgtgtgttcacaaaatattaaagattatatgacaataacaaagaacatacattgactgctttccaggtggcatgtactgtgcttattcttcacaataactctacagacaagaaggttccactatattccccatattatatatttggaaagtgatgtttacagagattttaaaaattgccaaagtaaatcatatagtaaattatagtcatcatttaaacagatttggttttaattgtgagcctgagacttcaattatcatgctctaatgcctattaacactgaaacaggtttcaatttgtatgtttatatacccaacctttgcatcttggatacacaattttattatttgctttgcactaacactcttacacattcaatttttcataattttaaattaaagattttcacagtccatcctcacaatgcattcagtgttacattttgatcttaattatatttgcaaatttaattgaactattaatattgaagatcaatcagtgtctaatataaaacataatatatttgtatcatggtgattttaatttattttataaaagtttattcgtgcttgctttattaatatgttttcattttcaaactgagctaaaatttgtggattttccctaataaagattaataaggaagaacctcattgtcatgagatatagacatgcacaagaacatattcaagaattcctagtttcattaaggaaaggtattaagaaggttgtagtctatatcattagagaaagaaaaaatgtttactaaatctggaatagtatgcttattggtatcatagtcaatgttctttaaaattttctttatatatatttatatagtttttctttaaatatatttaaattgtagaaaataatattttgaaattatagtctttgtctgctatttccatcttttattttaaaatactgcatttatttttctctatgctaaattcataagtgttttgtccccagttcataaatgttactatgtttctttctaatctttcttctttttttttctcttccttctatggcctctctttcactctgttttcctcccactttccaccccaccagccttatatggctttgtattgttcgacagtcaatacagtttgtgtccccttggaggagctcacttctctttggaattcaggttatttggttgtattatgactacaactttccaatgaattcaagaaaagttatcgttttatagattatttggtctattttcattgtttagttggctgggacactaatagaagctttctataccctaagtagaagtggaaatcctgctcttcatatcgtatttgcttttaaagtcaaatttattacattaccattttgtacagtaaaattcacccttttacatgaactattttactcatttggacaatgaatacaggaatataaacatcactgcagtcaagattttaaaaatcttaccattgcccagaaaggtccttcatgccccttggtaatcaatctcctctcttactaccctttaataccactgatcagttttctgcctctgggatttttcctttttcagagtataacctgtgtctggttttttttttttttttttttcatgattttgttgcatttatgagtgcttccttcctttttattaccaacagcattccattattatatagctccagaaactcagtaccaactgagatatttacatctgagaagggccagctttcgaaatctgccaggttactagtttgtggggattgagtgactctgttcagaaattaactgggtttgggatttttcattgctgtatgtacttgttgtacatcacgagtttaaataactctagatatgggctacctttgcccataactccaataactctagatataggctgtttttgccatgtaccacgtgaaggctaggataatggagagttttcttagtatgaatccgctggccccgcttttagccattcctataggtatgtgctatacctataggagaactgttagtgcttacgtccttatttagcagtagactgcagttgtttagtacttcatgctccgcccgtgttgtggggatagcagttctctgttgttttggcccagccacagttctgggaaacccatggagcctggactctgggtggagaattctcagtatgcctttcactcttctgcttgacagtcaaactctctgccttgtatttgttgtagatcttgaccttgagtgagagtttctcttcttctctattgataggaagctttgagtgggtataggattgcagttccaagagtttcccacccttcttataatcacaataactctgagttttttccttttctttcctttcctcagccgtggtatatctttactgcttctctcctgtggcttaagaccttttgctctgcatgagagaagagtccaaggaattgcacagtattttgtgtgtgttccccacagctgctcattctgctcctgcctgtctgctctcccaaggggcatttttatggtggtccacgttctttggcagttgagacagtttgtgtgtcctgtatctccttgtagggactcacgcttctttgtaattcaggtcatttggttgcattatgactataactttccagtgaattccagaaaatttattttgtaggttatctggcctatttttattgtttggttgtgtgggacactttgcgcctttcaacatcttcagtgggggtggaaatcctcttctttacgttattttataatctgctttttgaacttacaaatatatttgaagcaacattcctttataatattaaaatgatgtgtcccacaatttattttaccaatatgctatttttagatttactttgcggtatctcctttgaaaaattgtagttagacgacaggattttgcttggcacaaacactggcgtgacaacagatctcctaaaaagtgtctggatacaaacattctggtcttttaaaaaagatttttaagaaggaagtagaagaaaaatccatcacattagttgtaagtttccttctaaatgaattgatacggtgtaatcttttaaagaatcatgaaaggtgaatgcgagatctggctgcagtcccatgtccttgccctctgcagtagatttctcctctggaatgcacattcagttttctgcttcaaggatgaccagtgttcagggctcacattcattctcactcctaaattatgtgatgcttcctttctttgtttgacatcttcaaagtgaaaagtgtcattgccagggaagcatgaagatatagtcagtcccaaaaggctgtctggaaaaattacagaaagctcggttcttattggatcaaaaaataaatgtagggagaaaatatgaatatgcatttctacacaaagaattggattttcttaactgtttaaagatcacattgtgtaacattttacagtatggggtgccacaatctggatgtatcattttgaatgcgataactagaaaataggtaacaagaaaattaacttgatgttttcagtataatcaaagcaaaggattattttgactaaattgccaaacccttatgtaagcacagtgcaccaaaatgtatttcttaatagtagtgaagattcaacctaaacttggagaaacaaaacaaatatatcatcgagaaaaagtatagtgttgaactaatgacctttcagaagcatataaatgttattgtttgacattctaaaatcctcttttaagtaattttaaaaatgtaagtaaggatagaaggtatgaggaaaattagctaaaaataatcagtgaagaagataccttgttctccatgaacccagatttaaattttgcatgttttatatcagctctgtcaggctttgattatccacagccagatgacaatgaaataaagtaagttatgaagcatttgccaatgaacactcactgcctccttattcgctttcacttgcctaaggcagcctatagctcaggagaaagcttctgaaaccatatgtatagtctttccttaaactcaggaatatttgttataacagcataaatatttaaacttctcatagacatgcatcagtttgagggtaatcctgtctatatgggataaggagtaaagcgcaggaaatgtactgctctaggcaaggggtccttgctgtgttttgttcgctgtgagtccttcagagtaaagcctctggattttgaagtgctgtgagttcatcatcattagatacttatattcaaacaaaaccctaaaaatgcatttctgaaacaagtatatattgcatttctccacttttcatttaaaatatgctaatatttaaatcacctaccacttcatgagtatcttagataaatttcacatatgtattgtcttttccaagaattaagaattatattataagaacagcacaataaattgtgcctcgtcttttctcaatgaagcttgtccaattatttgagtgcactgtactttgaagttcataatcattaccttcttttttcttttaactttctaaagtgaagacctgattactgccatatgacttgtgcaaatattccactttgcaatatgtgctgcatataaatgtgcggtttgtatagtagggggtaaaatgggcagctttcctgccatctgcgtgctaattaaccagtgtagaacacagtcttgtcataggaaaaagccgtcttcatttctacagggtgcaaattatgttgccaggatcacaaggacagggtcaaagttggctgtcagcaatggttgtgggtttagtttgtgctttgaaaagacctaggaattttaaattaatacatagacttatacttccatatctaatgtatacatctacataaacaagctgtaaacataaaacaaaaaataactggccttttacatactaatacatatttgttctggatcattttctgttggcatctgattttctctaagacttacacaccatgctgttacctctccatggcatgtggtgggggggcgatggtgattaaagtatgacattaagtgtacatagaaacataattaaaataaatatgcattaatggttctctttaaatatagtgacccatgaattaactttttggtatgattaagaatgaaagttttaaaggcatcctttagcattaaaattcaagtcagcaccaatgattctaattagtgggaattctagcggggaaagtagttaagggaaattagttacctattgttttgaactataattttaaaatgtagttatgtttggaaatggattgttagcaaacatggatgtatgcacatctgtaacttgtgctctagactgccaaaaaaatcaataattgaaaatgaaataacacaatattttgcatgttatgtcaacgtaattactctcgtaattaaaacctcaaggagtgagaaggatagtacgtcagtcctgtggccatacatagagatacaatattcgttttcacgtcctttcaaacatgtgctgcaaagatggtagaaaatgaaagaaaagttatcaaatggtagctaaatgatctgcctatattcttaggtgattatgaaaatgttctcactttggaattaaaagtgtattgttttatccttcatcaaagtgagagaataacttcaaataggataagatttattttctatatacctattttctttttgtattttctgcacagatttctattaacgtttgagctttcaaaagcatatttcatgtttggttgtgtattatcaacaaacgtggttagctataattctcagactacctgtaaaagatatctaaggctatttttccttgtgggcagagtggcagtggtatgactacaggagtattgaaagatgtgtatgtctgaaaaatatgaccttttaactagcagggccattatttaagttaaggggatctagaatgtccctgaaaaaaagtaaggagctaatatttcctaagattacacattaagcatttaagccagttgcacctgtaaatatattactttattctgtaagtcccacttaacatatcagctctgctgtgaagttttcccttcttctcaacaccaatttaggtgctcctcagtgttctcacaattggcttcgattccttagcgaggcagaaaccaagtctaattatgttttttatgcactggagttaggtgagcatattaagtacacaaaatctttgtggactgagtgaataaaagaatatacattcattcaactgttgttctaacatacagcaagtccttgagggaattgcatttcagtaagctttgggggagaggccacatcctgaggggaaaatgtccagactttggaattggacagaactgatggaatcctgatactattacttattgcctattaaaaattaaaaaagtcatttaacacctttgaatgttaggattttttttattctaaggaatggtgacaaacatggtatcttgcaaaattgttgggacagctggacacgttacccctaaaatgcctgatgatgccttttcacccacaatagatgtgctacaagtaatagctcttttttaatgaatgagaaagacttccagaagcttatgagggagttatatgtaggattcttggccaagtcatagaaagaaataaaagaaataaataatagatggcagtgattgtggcacctacaagaggcataaagttgtaatattgtgtactcactaatttagcacaacattataggcatgtaacaaatttgttggttcatagtttcattaatttttgtcatgtagtatagctctgtcatataatgtgctgtctgtttaaatgttaagaacagactgtaaaagtagagtttaatttaaaatttgctcaatctgtctgttttgtaccttaagagtcattgaaatattttcccctatagaatgtgaatgttgtcattagaattgtatagatttttaaaatagtttgttgagggggatcacacatggtgctagaacattatttgtcattctagtccttccacccactagattatcagtgatatccaatggctgattttagagtagagaataactgaagagaaaacaattacatattgcctaatggaatgtcactgagatagctgtattaaaactatgggtatttttgttttacttttgcaatttcatgggtatttttatcacaggctcaaaaatactgcctgtgcttagttgtgttctctagtggctcactctcaagtgaaattcaaactattaattattaaaatattctaatttttaaaatttttttccagagaattttaaggcaaattctggctttcacagtaatgataggtaaatctaaataagcatgctgagagagaaagggcattagagtgtacaggtggttggagtggttgaaggagacattcagttccagtgattcatctggaaatttcctgttacagtgaacctccaagttaggcctgctgacagcacgggagcaagtatcttgaaaagatcatagtgagaattagagagaggatatggtgtgaaatctgggcaaattatatctacccacaatattacacattcttttttttaaacggtatgagtttactaggtttaagtgtcacgaaagatgaaatatgcaaaaagtaataaattgagcccacttttaagatggtaataagatcatttaatacatgtgtaaaactgctaaatgatttcgcagaaggattgcttcacctctgagtgaatcataaactcataaacaagcattcaacaggagatcaatgctgttttgtagtgcacacactattgcagcatctgctccaatacaaagataaatccagtgcaaaccatgtgttttactttttgggccagcatccttatcctgctgctcttattacacctaaactatagccttcaacaatctcatttctgattaagtagaaatcagttgcaggtacacatactactaatgtttgtatcaagataaatgagacataagactaaaacacaagctccaaaataagagacattttacattttgcaaaagttgactgtagtaaattattgaaatttggtataggaataaattagacaaagatgaataacttcatattaagacatgaaataagccatttacctatgggaccagtaaattacagattttttaggttttaaatcagatagacacttttgatgactcactttaaaagcataactgacaaaaaaatatgaaaaaataaatgagaggactttctatttgaaatcgtaggcccagagagattattgcttcttttgattaccacattaagtataagacataattctttcttttatttttgatttatttggacggttaagtggtcatgttagcaatgtgacaactataccaataatagcaagttgtaaactgtcaaagggcaactattcatcaagaagtatattttaatataagaccaggcgtctaatatgactttgaaattgttcatgattagattgctagcatattctaggtacccaaatgacatttctcttggacatggatgaactgaaaatcatgaaattcaaagccaggttatatgcagcacttattaatttagctaatttgatgtgtttcttaatctttcagtgagtacagtttcttagcatattactataatacagtctgcttcctaaataactttaggaaataatattaaagagattttttatgtcattatatttattcatatcaagaacatcaagcacttatcctctgcatctaaaaaaaagcaaaaaaaaaagcctatatatcaaattttaaactttattattattatgacattgatacattatagacaacaaaaacaaacaaaaagaaagaaatgtcccaggtaactgtttcacaattacacactgcattttgttagttcatttgaatatttcccaaatggtttattgaaaatagtccataggccaaatattatgctagatgaagatggctatgaaggttaatgagacatggacaattccgtgaggaagggcgcagcatctctcagtatattcagttagatgcttctacacgaattttccaaattatataagctaattttaaaatgttggacagcaattctagaatactctgggttactctgcattttcttaggtgctaaaaaaaaatctcttaatttgtcatcttattggaaaagtcttatataatgtgtcttatctttacctgtcttcctcatgcatttctgaatacttttactctactggtacctgaacacatgtttatctctccaagaagtatcccaattgtttgtttgtttttttcactaagtcgttcatatccttttacccagtcatcaaaatagattattcttctcaattttagagtctgcatataaacaaaacttctattttcattcatatttagggctactagattaacttgtgactcttctaaagatattcacatttacagaggatactttgtgatatcatatctgaactcaagggcatggatctacacataagaaagtaaagaaggaaagtcattaggaagatatcttagggctgaaatttgtgacaatcgcttcagagcagtccatgtttgttccacaaatttgtttaagtaattataaatacctgctctgaataacaaaatgtctttagtttcccatattttccattcttaaacaacaggtttactgttatccgtaatataccttagtatgtatctgtggaagcattctacaaagaacacaaatatgtgagcaagagcaaaatattcactcatctcctgattttgatgggagaaatggtcatagttgagaaccccttctgaaaacacatgtgaatgcacaagtgaacttacaattatttcccaaccacagtaatcaacaagacattcccaagtgtgtttgagttcttccagagctcctacttgtgagtgtcaagtgtagccatcaagtgtaattttctattactttttcctatttaagcacgagcctaaagaattaaccacgtgttgtgctagttgtttcttggtatttttttctttttcttttttagcaatcactgaattttgtcaattttatctcactgttgtgaagaacaaaatatatatagcaaaataaagattaagcgcataaaacaagcctgagagtgattccctacttgcttaagggaacacagatatttctataaatcagaaagtttgttagattgtaatataccaagtctcaagaatgtcaaatttaagagattgttttttagtagaatcagtcctgcctacctacagaattgttgtgttttgggcttccaatgaatttgaaaatgcatttaaatactactgagtattctaatatttttaattgtatttttgttactccattttccccctgaacttgaatcatcatccacagtatcagaatattattctatcagttatctttttctcttcagagtcatattgctgcccgtgttcacaatttatagtttttcttattttaatatctttcttttctttcacactcttttaaagatgattttaaaggacctaggttacttagttcgtatttcttttgatgggaaatacaaacaatctgtaaacatgggattagcacaaagactaacaagtcaaggtcagtttagcttccagcctcaaaacttggatctctagatgatatagtgataatatttcctctaggtccaaaatacgggattaacatctcatatctcctctctccattaaaaagtttatgaattttggacaaacaatggattggtcaactatatgtggtcaagaaacacagtttcagctaagctaaatacattaaattatgtatataattatatattatataattatgcatataacctgtcagtgcccagtaagtgttttctgaataaatggataagcaaatattgtttcaacataataaggaactttgccaggtgctaaggctcacacctgctttcccagctacttggggggctgaggtgggaggataacttgagcccagtagtttgatgctacagtgaaacatgttcataccactgtactccagcctgggcaacagagaaagatcctgagtcaaaaaagaaatgatgatgataataataatcgggaacttaattccaaatctatttaaggcactctattaaggggctcttatcttaatctctttataattttaaggatactttctaaattttgtttgttccatagggagaataaagtatatgtttctaaataattttccatactagatagttacatccttctctgtgttgccatatgatttttacagttttactatagcatttctttaattctgcttattttctcaattgcacttcctgggcaggtctttttgtttaaatgttatgtttacctgccatgtactaagcttggcacataactgctcaacaaatgttttaggaaagaatgagtaaatgaactttaaaaatactgattttttgttcaaactgaataatttaccgtatttctgtttttaaaagacagtagtgaggactatctgttttgaactgcataaaataaaccctattttgttttgatttcagtaaagtcaataaatattcatttgctatcaaggcaaaaatctaagcaacataaagtacaaataatttacatgttgctaaatttgagatgcagacaattaaatattaattttgctaaataatacaaaaattgtgttacatgcactagaattctagacttgtattctgcaggatgagtcttactggctgctgaatattatatttgtctggctacttgcttttgaagaatgtactttaattattgttaaaatactagaaaaagcattttaaggtttttgtcttggtggctgttcttgtgttagctgtggagagtacaacatggacaaaagtaactcaagctgtaggctacaatagacttgattcaaattctggctctattagcaggctgctttgtgatcttggctaatttatttagcatctcagcctcaatttcttgatatataaaatttgaataatgataataatacttcaaagagtagttgtgtgggtccaagatttagtatagcccctggattgtcctaagttctcagtgtaatttagctagtagtgcagtatttattgttaatgttgttcacatattaagctgtattatcaaacatataaacccaacatttttcggtagaaagctagattttccatatgatgaccactgatggcatcataactgaacaataaaatatatgtttctaactagtgtgctagaaaaataattgttaggtgttcttttcatatactgatataaatatatgtaaaagttaaaaatttaagcaattccagttaatagataattatatttaacaatcccagatatattatatttaccttaggctatgttatgctgtatgtttatataaaatatactatattatattttatcctacataaactgtaatcaaaatatatctttattgtatttttctggttttctaaataattatatttgacaggaaattcctgtatatattattccctcaatgcatgcagaaaaatatttatttatttaattattttgtttttctatgctttatttatttaaaacttttattgttaattattatggatgcataatagttgtagatatttatggggtatatatgatattttgatgcaggtatagaatgtgcaatgatcaaatcaaagtacttggggtatccatcatctcaaatatttatcatttatttgtattacaaacatttcacttccactcttttaattattttaaaatatgccatacattattgttaaatatagtcaccttattttggtactgaatactagatcataaccattctccctaactgtattcttacatccaagaatcatccccactttatacccgcctcgccgctactcttcagagcctctggtaaccatcactctactctctatctccatgtattcaattttatttttagctcccacatgtgagtgagaaaatgtgatacgtacctttctctgcctgtcttatttcacttaacataatgtcccccagttccatccatgttgttgcaaatgacaggagttcattcctttttatggctgaataatatttcattgtatatacttaccacattttttatgcattcatggacacttaaattgattcctattgtgaatagtgctgcaatacatatgggagtgcagatatctctttaatatattaagttcctttctttgggatatatactcagcattgggatttctggatcgtatgttagttctattttcagttttttggggaacctccacagtgttctccatagtgactatactaataatagtttacattccaccaatagtatacaagggttaccctttctccacatcctcaccaccatctgttattgtttggcttttggacaaaacctattttaacaatggtaagatgatctcacattgtagttgtgatttttgattctctggttattaatgaggttgagcatttttttcatatacctgttggacatttgtatgtcttatattgagaaatgtctattcagatcttgtatctattttaatcagattatttttacctattgaatagtttgagctccttatatattgtggttattattaccttgtcagatgggtagttgcaaatattttctccccttctgtgggttgtcttatcacttttttgattgcttcctttgctgtacagaagctttttagcttaatgtgatcccatttgttcatttttcctttggttgcctgtgcttttgaagtcttacacaaatcttcatcaatacttacattctaaagtgtttccctgatgtttttttttcagtggtttcatagtttgagttcttacatttaagtctttcatccattttgattcgatttttatatatggcaggagatagagatctagtttcattcttctgcataaggatatccagttttcctagcaccatttggactgaagagattatcctttccccaatgtatgttctcggcactttttcaaaaatgagttgactgtaatttatgggttgtctattctgttccattggtttatgtgtctgtttttatgccagcaccatgctgtttcgattactataactatgtagtatagttaaaagtcaggtaatgtgatcctgtctagttttgttctttttgctcaggatggctttggctagtctaggtcttttgtggttccatataattttttttctatttctgtgaagaatgtcatcagcatttggatggggactgcactgaattgtagattgctttgggtagtatggacatttaaaaaatattggctcttttaacccatgaacgtggaacatctttcattcttttgtgtcctcttcaatttccttcatcaatattttacagttttcattataggcatcttttactactttggttaagtttatttctaggtaacttatttgtagctattgtaaatgagattagtttcttgattttttttgtttgtttgttttttgttttttttcagattgaccactgctggcatatagaaatgctactgatttttgaatgttgatattgtgttctacaactttactgaacttatcagttcaattagttttttggtggtgtctttaggtttgtctaaatataagattatattatctgcaaacaaggttaatttgacttcctcctttccaatttagatactctttatttacttatcttctctaattgccctggcaaggatatccagtactatgtcaaataagtgttgaaagtgggcattcttgttttattccagattttagaagaaaggctttcaatttttcatggagaaaatcatgtagaatatgatcagaaggtgacattggcaaaaatgactggaacaatgtatatattgtgagctgataaatacttattaaattttccttgtctctcctccaaagaaacagagccactttagtaagaatcccaaaatctgccaataaaattacttggattttttccttcctcatgagcaatataattttaaaaagattatatttaaaaaagactaatatcctccctcatgagcaatatatttaaaaaagattttaaacatagtgggtattcagaaggtgttacataactgaaatagactttatcattcaggtcattaaactatctcctaccacattgctgtttttctgaccctaaacagctctgttttgggaatagtgcaaatggttgacactttaggacacttgttatttgttagatactttcacaaaattgagtttgacagtagagagaagaagagattatttaaaagtaattaaatgtaaatgtttggtggtatgatctgttagatcttggaaatgtctaagagttctttgccacctacctatattactaagggcttctttgaggattttgtgatgtgtaatagctgttgtccataggattattcaccagcaaatagtttaagatttgaatgtagatatataatctgatacttaatcagtgaaaataggcaatggctattaatatttaaagctataattgatttttagatttttttgtctgtacagtgacaaactatttgaacagaaaaagttaaaagtcgaaaattgtgagctttgtttaaatagtgccaattatacaaacttttcaccatttccaaataatgattggatatattcacttttctttgtgtgattggcattgtttgagttccagtggtagtcatgcttaaaactgcttgacataatgggctttcttctattggaatattttgtattagtttaaccttgctttgtgggatttacagtttattgaataagaacagaatatgattatttctttttaataaaatatgaaaaataaacatgggaatacattgcttttaagaagtaaatgtaaaatcaaatgactttaaacctagtacagttctctagtgacatttgtaataacttgcctaaggcattaattctaatcactttgtcattatttgcagttttattttaagcaagttttatattaattccccttactgttttagttttaaaagtaatatatgattctcttttaaattatttttatgctgcgacttcaatcttccaataaaacaaaaaaagggttgccttaagatgtagtgaaactgaagccttaattagcgacaggcattatagacaatgcttagaataatttgggcaatcttgaaacagatcttaataatattagttaatagagtgttagagagtttacagtattctcacctaggaattggtccaatggcagctactaggaggacagcagcccagtgaggccctgtatggacctgttcagtatcaatgaaacaaggacaggatcagtaaggagatactcatacactttcatagtcattgctatatatttccacaattctaaatcagaaaactttgtcatatttttaaacttcaaatttccacatttttgaaaggatttagtatgaattttctaattttagcattcgttgttcttctaaatctcatttttatgcaaagagaggcattggtccatatagtaaaattgtccttgcattactgttatatttaatattttgattgattcttttgttgagtattcatgtgatttagttattagactcaaaatgatgcaactttaaaaacccaggaataacattcatgtatgatcaaggaatgaagagcacaaaaatcagtttattaatagctctcctgtggaaacactcatgatgtaaattggactattgaatgtttatttcgttagatatacttgcatatttctttgcttttacttagcttcaagcaatgtcttctacctgtaggtcttctctctctgtatctaagtccttcgtatcttttcaaatccagattttacgtgcgaatatcctataggagatgtttagtgatccccccagctgataaaagttaccttctctgagtttcttatgacacagaatttgtatattttatgccatgtatcagttttctaccttgtatcatagtaatttacatatcttcatcctttctctactttgaatttattgaggacagattctgtgttttacaaatctgcattgggtactcaataaatatttgtcaaataactaaataaatgagctgtgttaaaattaaattggttcccggagtcttagtaaaatatagctgcaaacaaatatttttatttctgtttgtgctttcaaaactgcactaaaattatactaaataaataagaaccctaatattagcactatacccaccagaaaaaaagaataaataaaaaaatacagccagaggagtgagataaacatagaccaagggaagagtttagataagttataacagattgtcagagggagaaatcttcaaattaagttcctgaattgctggtaaatatttgacaactcactctctaaaaaatgtatgcatgtatttaagtttgttatcaacatagtttataaataataaaaatataaaatgtgtaatgataaataataaaatgtacaatatctttattgtaaaatccatatagtgatttaattctcacagaatgtttttcttgctttttacaaaatactggtatctatagtcaatctgtggttgcataggatgaacaagtgtattcccaacatgtatgtttaaacaaacaaatagatgaaagtggtacaaggaatatccacatgaaactcggcattttcaacaataatgtgagaaaatttttagctaatttggataatagctttcaaatagccaaagaatatttcttaaatttgttgtactattcacaatataatgattacagatgtgccaacaatttactttcatcttcattgttaacatttcctccattgtatacttcaatgtagacaatagacaaaacaataaatcaagttctcatttgtagtatttgccaattcacatattgtaaatattctcatcataactagtttcgacataccaatagtatgttactgaatgtggacttcgaaagagattaagaaatagcacaccatcattaacattctctaccacatagatgtaaagatgtaaagaatcttgtgagtattaatagtagtaaaattcttaagaatttatgagtttaaaatataatgttttgtcttgaatccatatacttgcattttaataaaatttatttggaaggaattatgtatactttgatttgtaataatagctgtgtttaacaatgaacttgcaaaattcctgaaaacttacaagggtcaaaacttgtggcgggtgtggtggctcacacctgtaatcccagcactttgggaagccaaggagggcagatcacttgaggtcaagagttcaagaccagcctggccaacataatgaaaccctgtctctactaaaaatacaaaaactagccagacatgctcacttgaacccaggaggtggagattgccatgagccaggatcatgccactgcattccatcctgggcaagaatgagactctgtctcaaaaaaacaaaacaacaaacaaacaaaccttgtacacgtctatttctacagcaaatgggcttcagggtggggaatacattttaaaaatcatttgaaagtcttttcaaagaatgatcttatcttttccccatctgagcaatcagacatttatccagactattcctgcaggaagaagccattgcctgtatacaaagactccaataagctttctggagcttctctcagaagtattatagggagtcaatcaaaagagatgatttttgagaaaagctgccgatatatgagacagaaacaaaaataccaagcaaacaaagaagaaacaaactcacagaaaagagaaataaatcagaactgaggaaaaagatctatggaaatattttcatgacaaaagataatgatattaaaaaaacaataatcatggaacataagcaatcaacactttaattgtgaagaaaagagcactttagaactcaaatatttggccatttatattttaaaaatcaatagaacacttgaaaaataaaccaaaataaatctctcaggaaatgtagccaaactaggtgaaaataggagataaaagattttaaaattagaaggtcatttaggcgatccaacatctcacttacaagatttttataataatcaaatataataaagagattttcacacaaataatacaaaaaagaattacagatttgaaaaggactctccaatatgatgggcccaatccttatgtgctgtatattataagttctaaaataacatgatacattatgtggaaactttagagccactgaatattaaaaatgcccatagggaaaagcaggaataaaattaaaaacaaaactaaatgtgactggaatagcatttgtttttcaactaactgctagaagtcaaactttttttcacttttaaacttctaaagaaaaattattctcaatctagaattttatacctaactgtcataagagtaagagtgtgataaaggtgccctcacatatgtaagatctgaacatgttttcctgcagtgttctttcttaggaatccatcagaggatcttctcaacaaaatcagctaagaatacatgagatccagaaactagaggaacacctctagaagactgttaaagatagtcctggccggatgcagtggctgacgcctgtaatcccagcactttgggagactgaggcgggtggatcacctgaggtcaggagtttcagaccagcctggccaacatggtgaaaccccatctctactaaaaatacaaaaattagccgggcctggtgacaagcgcctgtaatcccagctacttgggaggctgaggcaggagaattacttgaacccgggaggcagaggttgcagtgagccgagatcgcaccactgtactccagcctgggtgacagagcaaaactctgtctcaaaaaaaaaaaaaaaaaaatagtccacagaccacacactcagtctaaataggagcatgagtatgggagaatgggagtatttagaaatatgtgcgaggatttcaaaaaattaaggtttgaaaaccaaaggaaaaatgcagttaactccaggtagagaaaagttgcctaagaggaattataactgcagtcaaattacagtcaatttttattgtttgctaattgtgtatttgtaaatttgcctaaaatttacaccaaaacttatttgttatcccccagtcaatattcacggcacttttgcaggcattcacagacatgtgaaaagcagccaaaaatttgagatactcaacacgcatatgcccaactgaggtcaagccaagcaacactctgccttcttctttctgctctcaaactatatacaagtgtctttttgctgtctgtttagtgtcacattattttacattttcgttataatttcactgttttaaacggcctgcaaatgtagtgtgtagtttctcagtgcaagaaggctatgatgagcctcatggagaaaatgtgggcactaaataagtttcattcaggtatctgttattgcaccggttggccatgacttgaatgttaataattcaataatctatattaaataaggagttttgtatttattggcaaatacataaatatattgacaaataggttgtgatcagaggctcacagaaacctaaccctatattttcacctcaaaacaatggttcattattggataattcaatcataaagcaatggttcatgtggataattcaatgtttgcagccaatgtgtagaacataactattataaataacaagaattgactgtatattacaccatttggcctgacaacaagcaatttctaataataaatataaaatacataaagtagatgttaatatgaccaaagtttgccacatagccatactgggaaaatggtgagaggatggcaaaataggaaataataggcaaagctaaaattaatatcctaaagtataaacatattgtatataattttgaagttaaataagtaggaaaaacaactcagtacttgaaagtggtggcctacagaagcatcctgggagagggggaagagtgaggtaggaaagtgttgcttttcatataaattgtgatattacatgtggttataaatcaggattaaatgtttacttgagagaaattagtattttacaaataaaaataaagttttgataatatagttaattttaaagctcatctacatggttaagtcaactttaaattttaaggtaatgtcttttaatccatggtagagaaaaaaaaaagtctttcagggggtgttttggtgagatttggaaataaattatactaaaaacgatctgtacaatggaaaatgattgtattttatgtcattgatacaaagcacacatttctttatgtctatttttgttttgttgatttgtttacctaaaggtattttaaacatttggtaatgtgaaagcctgactaatcagaccactttctcatcctggaattccaattgacattctcgactgcatgaataaatgattctactgaatttagtcttccattttgtcacatattacaaagcagtgttgcatcttggcaaaaattctgctggtagatatatgtatatatatatatgtacacacacacacatatacacacacacacatatctatatatagagagagatatagatatatacacacacaaagctcaaatattaactaagatgttcttcttgtcaatagtttctaagatagacctaaaactaaatcagttgtgtttcatataatagcagtaacactattggcaatttgtatgcggtcgtttgcagtaagaatggagaataacttggtggaaacttctgaaagctacagttccagagtaacaaaaggaaaaagaggaattcgtctagtaaaaggccgtatggcaaagtgtatgttaaaaaaaaaaaaagtggaaaaggcattattgacttgcagaatgttctaaaaatacctcattcaataagtacatcttgctagttgacacacaattatgttaatgtagtaagagttgaagagtaatttaaatataattagggcttaaaagatacatggcatagagcatggaacttgttttggcgcgtgcgtggagtatttttaatgaaaataaaaaataaaagtaatctgtaaattaaaacctttgtgtattttcaatttcatttgaggttattctcacatgactgataaagatgatgaaacaaatgagtttcatcatgaatttattctcatataaatgacacttttcaacatcctgttttggaaaaaagaatgaaaaacatttcttgattcttaataggacacctatttcatgaacattcatttccatgccaggtcccaagctgcatctataaaacaacaaaataatttattaaataaggggaaaatcagtctaccaactactaatagcaaaacaacaatattttaaaaataacattggctgatacttattttcagtgagtttactcattgttttttagagagttgatttgttctgacataattctaatcaattatagtaagttgtagatagatttagtgtgctctgtaaaaaaatcatctaatctgacctacttttaaataccagttactagtagaccaagtgtaactcctggtgacagctataaattgagtattgtattagttcattttcacactgctataaagagatacccaagactgggtaatttatgaaggaaagaggtttaattgactcacagttccacacagcaggggaggcctcaggaaagttacaaccatggcagaaggtgaaagagaagcaaggcaccttcttcacaaggcagcaggagagagaatagtgaagaaggaacttccaaacgcttactggggagaccacctccatgatgcaatcacctccctccctcaacacgtgggaataacaggttgctccctcaagaggattacaatttaaggtgagatttgggtggggacacagagccaaaccatatcaagtatgaaaactgatccttttctagaagtcccttccaattttaaaaaattatattaggacaatttatttattaactcattgagcaaacacttatttttatttttattttcttttttctttttttcttttttttttttgagacagagtcttgctctgtcgcccaggctggactgcagtggtgcgatctcggctcactgcaacctccgcctcctgggtttaagtgattctcctgcctcagcctcctgagcagctgggactacaggtgtgtgccaccacatccgactaatttttgtatttttagttgacatggggtttcaccatgttggccagggtgttctcaaactcctgacatcaaatgatgccgctgcctaagcctcccaaagtgctgggattacaactgtgagccaccacgcccggccaacacttattgaatacgagttacgattcaagaatctgttaagtgtagaagatataagcaacaggtaaattttaaaaattcataagaaatactatgttaatcttactatgatgaagtattatgagaacctataggaagaaggtatttcctgagtcctaaaggttggctctcaagtagaatagattttgatattttagaacaacatcagtgaaatggttgaaagctggtttattcctatatccttatatacagtctaaatggaaggataagagatatactaacaaattaaaaatcttaacaaaatgccaggaaataaacaacaaatttagatacgaaagataaaggaatgcaaaaaaatactatatgctattctttgtttcatttagcattgtttcataagcatctttccatgaccttaaatataaagcatgaaatttaatggctttctacttgatatgattaggctttgtgtccccacccaaatctcatcttgaattgtaattcccaggtgttgagggagagacctggagggaggttattagatcatgggggtggctttccccaagctcttctcataatagtgagtgagttctcacagaaactgctggttttataaggggctcttctccttctctttctcactatctctccttctctttctcactatctctcctgccaccttgtgaagaaggtgcctcctggttccccttccaccatgattgttcatttcctgaagcctccccagccatgccaaactgtgaatcaattaaacctcctttgtttttaaattacctagtcttgggcactatctttatagcagtgtgagaacagactaatacactactataacatcttattgatgtatgcactctccttttttttccctttttttggggccatttaagttatttataaagttgtactaagataaatagtattgtgatgaataaacatacatatgtatatatatatatattgcatatctttgtgtacatcttaaatttttttcttagaagaaatttataggatgccaattatatcacctaagaatatgagaaaatttaagcctcttcatatgtattgataaattgttttctaataattttgccccaaattatatataaattatactaatatatatgtttgtttgttaattgtctatctttcccagctgaatgtaagtcctgtgagagtgggaacctttagttttatttaaagaggcctagaataattcctgggatatactaggagctccataaatatttatttagttgaatgaatgaaatttcaaaaggaataattttaagccaaactcttcacgtatttagattcaaaatctggctgctctatataaaagaaataattttaaacattgagaaactaaagcagttaacacagatttttttcaagaaaattataacttggtgtgaatccaacaaagtgctaaggtgagaaactttactgaggagaaaatcagctttgaaatacccaaaggactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtactttgtagggacatggatgaaattggaaatcatcattctcagtaaactatcacaagaacaaaaaaccaaacaccacatattctcactcataggtgggaattgaacaatgagaacacatggacacagggaggggaacatcacactctggggactgttgtggggtgaggggaggggggagggatagcattgggagatatacctaatgctagatgacaagttagtgggtgcagcgcaccagcgtggcacatgtatacatatgtaactaacctgcacaatgtgcacatgtgccctaaaacttaaagtataataataagagagagaaaaaaaagaaataaaacgataattaaggtagaatgttaccagtaagagttgttgttacccagcaaagcagactagaataaagggccagaaatgatgctaaagatggagctcagaatttcatgaaccccaattccatacatgtagaggccataaccatctggaatcatgcttccaaccttatccttgctctgttctggtaaaacatgcatgaggaagaatttgttttgaaaaaaagatgtattagaaaaatgccactatacttatttaaaattcactagattttcagagttaggaagaatgagtgttcgctctagtttgcatggatcaactgaggttacttgtctgttgaatattatctttctatcacaaaatggcttttcattgagaaattaatatcttcttgagcaacatttgttctttttcactctgataagtctggaaggaagactagatcttgccttctagattaccattaaatattttcaccttctacctatcccgtaaaggatgatctggataggcagctggtgatagataatgtgaatccaggaatctggagtaaacctgatagaaaatctgtgttatgatgtaacaggaaaaagcaaagacaactggatgttaaggggtgaatttcttaccaagaaacatcagttgtgtcagtcaagaaaaggaaagaaatgttgttgccctcacagagattacactgaggtttgggaaaaataataaatgaacaaactaaaatgtattaaatcactggctgaagaactaaccaaattaaatacagaagtaaataaatttacataaagatataaataatagagagtgtgtcatgtggtaattaatgctaaagaaaagtaaaacagtacagggttgggagcattggtaggttggatgcaatttaaaatagagtagtcaggaaatgcctaatggagaaggagagatttttggaaaactctaaaagaagaaagggaatgaggcaagtaaacacctaagagaaaagtgtttataggcaaaggaaacaataagaccatatgcccaaacctggcagtcaggtgatatcacccagaacagaactctggtcactcccaagttgataaggtagaaccagcagaaaagactgaggaggagaggccagtgaggtggaaagaggccacataagtaaggaatactgaaagccaggtgaaaaatgtgttgcatggcggagaatcaatgcgtctcttgctgctaagtcatgtagaacatggaccaagtattaatcatttggctatgtggcatcattgaagacaaggacaagaacacttgtgaaatcctaattcatactgtaagttcagatgatattagaaagaacagaactggagagagtgagtgagacaattttgagaaattttgctttaaagagaaagagaccccaaggcaggcagatcacaaggtcaggagttcaagaccagcctggccaacatggtgaaaccctgtctctactgaaaatacaaaaaattagccgggcatggtggcgggcacctgtaatcccagctacttgggaggctgaggcaggagaatcatttcgacccgggaggtggaggttgcaatgagtggagattgcgccactgtactccagcctgggcgacagtgtgagactccatctcaaaaaaaaaaaaaaaaaaaaaaaaaagtggaagagaccaatgaagctgtaactgaagacggagacagaggcaagaataaacttttttttttccttttgggaagagaaataaggcatgtttgtatgctaatggaaagatccaatgaataggaaaataattgatgatgccgggaagaggggaagaattctgaagcagagtcccagaataagggaaaggcaatcaaatctagggtacctagggtttctaccattgggtgtcttttcctcacccttcctggactctgtttttgttctagtatttatacaagacactgctattgtagaggcattgcaagaattccattaagcatctttctgtgatttaatcccacttaagcccttgatagtcactgataaagagacttaaaatctccatttttgccagtttgaagattctatacaagatgtaaagttaacttcattttcttgatttgtttattttgtcaacttgtgttggaataattgaactcaatcctactttattttctatgttccatttagacattcttccctattgagagttagttagaacatttgcttccagtgagtcatctgcctacttgagatagttaccacctattgctacatgacaaagacaatgaaaatatagagatctgcatagtaatacaaaatgagagaatttactgcctgtgtgtaatcatatccagaaaagaatgcagagtgaaaatgtttaaaatgagatggtgcatggacagggtgtagtttgttagtctaatttggatattaatctacaacttaaggaatgtgggatttcgaagtttgtttttaattgatattacaatctctcagagtcaagaacaagatgacaactgatacttctgtgtatgggggggatgtgtgcatagacatatgtacatgactacatattctgcatacatttacattcatattaatttacgtacagtatgcacatattttcatgcattcacatatgcgtgcacatacacacatacatatatatttgtatttatgttttgaaggagagactcctgattattcctttgaagtgtgactatgatttggtataattatgatgtttggtttattaccagcttcatttatagaactaaaaggccatggttaattacttcaaatgaataacatattgattaacaaaagctgttttgtgcctttttgagacaccgtttaggtagcctaagacattcacatcctctaagaattagatgatttccctttcttgtgttgtttctagatgctggtaagcaaactgtagctccccagaaatagcctagatacatcatctacttgggaaatactgttctggacaaaaatcattacagttctgattgatgcccagcattttaagcagtcttcttctgaaagagagatgcctcccttttagccctgaataaatataactaagagatggttatttaattcctttgtcataaaaaggttttaagaaatcttgatcttttcacattatgtgaaaattgtttccttaatacatgggtcacaggcattaatataagtgatatgttttccacttttctaaaattccacagaccttgaaactgttctggatattgaggattcaacaattcatttttagtgctcatgacgactgggtgtagtaatttaggatgtggctatttattgaacaggaatgaaagctgacttgggagtataagctatttctcttattatatccagtcaagtattacagtcaagtactacagtgggccccaaggtaactaaaaagtgaaaacttgccctccaggttaagatacatatcctgtagctgcaggtatagaatcattcattctttcattctagagatgtttattgagtttcaatatagattgctttgttttcagagctgtctactcataaaaaataaagatgaaataataagatattcaacaaaaatgtttctgtttctatgttttgataaattttctcttaattaatgcttccacagaaaattgatgaatttacttcaatggaccattgtaattttcaaggatagtataaaattgtagcaaaattaaatgctgtatctattgtatatctatttttcttttctagtcatttatgatactatgtcttataaaagtttcatacaaagatattctcatttgtctgaaataatgagaatgcttctttcctacttgaccataattatctgctcttatttcctaaaataatccatttggaacttttttttatttctctaaaatacctttataattcaaaggaagtctttcagaattggtaactccagtctgacttaaggattggaaagtacattacatcttcttataacttgtaatttggaaatgttatgacattgcaaagcatgcaccgttatcaagagtcataatattgtgttcaaaataaaattaaatatggaaaaatatgcatataaatatataaaaatatgagaaacacttatttttattgattattttcaaatatgtataatatacctataaaaacataaacctctacaagtttgtagagtttccttttccatttcagttgaagaattttttgtccagatgcacaaatacctctgagacaaaggcggaatatgtcataggatccagaaaatcattatgaaaacaaagctcttttctctagtggcatgaggtatatagtatgatgaggggggtctattttgctctttgtacactggtcatttttgcaaaggccatttattaaagcaacagatagggagacatcagttatgtttttggccttctgtttactataaaatgttggaagacttgaaaagccccactaaaatcattgaaaagatcaaagcctaagtccagtgtcacaggagagaatggacactgtcaattgcagtggatgtagaatgttttactacaaaaagcttggaaatagtctttaatttgtatttttttcctatgtaagctgttaggtcagtggctgttttttaaaaaaaattacttttatgtgagctcgatagttgacagtcttctagtgatagacttcttatgcttggatatattgataagctgtaaaagtaccctgaaatttgatatcctttctcatcagcatctgcctatttgtatataaagtttatataatatacatattttcaagaagcacagtttctttaaaacaagcttttcccctgctcgagtgttctaactttttgctgttgcctcagatttcttttctcagattttgtagacctatgttacccttgtaacatttctattgttgaatcactaacagcagataatgaatcaccaccaatgtcaaaggcagagtgttgccctaaagatcaaatttaaatcttggccatgttgttttgagactctgattattttctcttcctccccctcctctccttcatttttatattattattttttgacttggaagtgctcccacatctctctctttgacaaaaagttatattaaagtctagactttgggaaggcaaagagccaatctctttacttttttgaccacaagaatgtgcagtgtcatcttttaaaaataagaattgttttcagtaacctaaatgaatctgtcagataagattttaggaggtgtttagggaagtatttcaattttatttattgttcattacttatgatgaatttagcacttacacacaggaatctttttgtgaaaagcacttaacagatttctttgaattctcccaataatcctgtaagaaatagaaatagagtatttataacctctatctcacaggtgaagctgctgaaaccacacatttatactcttgtgcgatttgctcttggaaagaaatttcttcaagtttggaagattcactattgctactctcttggaggcaaaaaaaaaaaagaaaaagttactaatactctgaatctagtggcctgaactcaaacctccttattgagtgcatttatgccacttagagggacttgatcacacatttctgtttggatccctttcatgtggggtttggactgtggatttgtggattgtggattgacagacatgtggattatggactgactttcccttcctttgagatcctgtgtagctgaagctttttctatgaaatggttcatgggtatgatataaaaggaagtagagctataacattgctgttttgcaaaactcttctaatattgaagttggcatttacactcacgcgtaattctctaaggattcagtccctgtgagtttttctaagctttgtattttatcttttaatctgttttttattgtagaacatgcagaatatttgcagattcaaacactcttaaattaaaggagtggtattcatttcaatgttataattttaaatttggggagcatttttgcctctaataaataagcataaaccatccaattttccagagatgccgcaagtttcattaatagctgcttttcattcattaaggacttattattttggatagacagtttcccatgaacctttcctaatccatttctaattagatcaacccaggcccaggtatgacttcttagcttacagaaggtaatgcctcataactgagggcagatgggccttctggatgtggaacacacaagtattcctttggtgaagggagaaaaataaaaaagatctgtcttagtttgggatgctataacaagataccatagactgggttgcttaaacaacagacatttatttcacacagttctggggactggaaagttggaaatcagggtgctagcatggttgggttctggtgaagaccctcttcctggcttgtaaagtaacactttcttgctatattctcacgtggcaaagcaagagcaagtgagagagggagatctcatatctcttcttataaaggtactaaactcatcatgaaagttccacccttatgatctaattactgcctgttatggactgaatgtttttggttcccccaaattcataagttgaaacctaaacttcagtttgatggtatttggagatgaggtctttgagaagcaaatctgttttggaagtgaagccttcccaaatgggcttagtgctcttataggaagagaccaaagagctagctggctattttttgccatatgagtatacaacaagaagtcagcagtttgtaaccaaggaaaaggccctcaccagaacctggccaggctggcaccctgacatcagactttcagcctctggaactgtgagtaataaattctcttgtttgtaaggcatccaggctcttatactttgttatagcagcccaaactgactttaacatctctccaaagccccatcttcaaataccatcacactgggggttagggattcaacacatgaatatattgaacacacaacttagtccatagcaagacctaaaatatatattaaactaaccattgtccatggtagtggccaattacctggctcccacttggctgcagtctatgctgaggtcctttgtaagcctcttgcatttagaaagaaagtctcttacccatttctctgtgtttttactacaggtctattgccagccctttttctgtttcaatgaagtcaatttttaatgtaaaatgaaatagttttaacgttaaatggtgcttcaaaattgtcaatgcaaagcaatgtataccagatatactttcaatagaaataggaaatttaaaacatagtgcctatgttttaattgcattcattctatcatggccatctttttatcacaaaaacataaggaaagagatgctagtaagtaccaccttttctaagctgagagatcatataatactgttagtcaactaataaatatggcacaattgaaggtgtgtttctaagtcaagatagatacaaagttaggaaaagatatgtagtcattggaagatatccagaatacatcaatctattttctgcactagcctagctcagatgacagtatttaaagacagaaattctttgataggccaataagatggaggaaatgtaccagataaaataaatgagagaatgcaagtgtgacacaagttaataacttcacatataaagatgaatttaatggctgtggcaggtagctactaagtattaagtagtttcaaacaaattaaagattcacttgacctagccatgaagatatatggactatgtgaagggcaatctgtagtcactaatcttaattctaaacatgtcaggaagaagttatctcataatgtgaaaaaacatacaatttactttctggtaatatattatgttcacatatttccaagtattttcaaagatagatagatagatagacagatagatagatagatagatagatagatagatagacagacagacagacagacagacagacagggtttggctctgtgtccccacccaaatctcagtttgaattctacttccttaattcccatatgttgtggcagggacctggtgggagataattgaaccatggaagtgggtctttgccatgctcttctcatgatagtgagatctgatagctttaaaaatgggagtttccctgcacaggctctctttttgcctgctgccatccatgtaaaacttgacttgctcctctttgccttctgccatgattatgaggcctcccagccacgtggaactgttaagtctgttaaatctctttttcttcccagtctcaggtatgtctttatcagcagcataaaaatggactaataaagtaaattggtaccagtagggtggggcattgctgaaaagatatccaaaaatgtggaagcaactgtggaactgggtaagagggagaggttgaacagtttagagggcacagaagaagacaggaaaatgtgggaaaatttggaactccctagaaacttattgaatggctttgacccaaatgctgatggtatggtcaatgaaatacagtctgagatgatctcagatggagatggggaaacttgttgagagctggagcaaaggtcactcttgctatgttttagcaaagagactggcagcatttttcccctgccctagagatttgtggaattttgaacttgagagagatgatttagggtatctgatgaaagaaatttctaagcaacaaagcatttaagaagtgacttgggtgctgttaaaggcattcagttttaaaagggaaacagagcataaaagtttggaaaatttgcagcctgacaatgtgatagaaaaccaagtctcattttctgagaaattcaagccagctgcagaaatttgcataagtgataaacagctgaatgttaatacccaagacaatggagaaaatgtctttagggcgtgtcagagccttttccaacagaccctgccatcagcccagaggtttaggaaggaaaaatggtttcatgggatgggcccagggtcccaatgctgtttgcagtctagggacttggtgccctatgtcccagcgactccagtcatgactacaaggggccaaaatacagctccagctgttgcttcagagggtggaagccccagtcctcagaagcttcatgcgggtgcaccgaagttaagaattggagtttgggaatctctgcctagatggcagatgatgtttggaaatgcctggatgttcaggcagaagtttgctgcaggggcagggctctcatggagaacctgttctagggcagtgtagaagggaaatgtaaggttggagaccccacacagagtccctactggggcacctcctagtggagctgtgagaagggggccactgtcctccagaccccacaatggtagatccactggcagcttgcgctctgcatctggaaaagacacagacactcaatgccagacagtgaaagcagctgagagggaggctataccctgcaaaactgcaggggcagagctacccaagaccgtgggaacccacctcttgcatcagcatgacctggatgtgagacacggtgtcaaaggaaatcattttggagctttaagatttaatggccctgctggatgttggacttgcatggggcctgtagcccctttgttttgaccaatctcccatttggaatgggtgtatttacccaatgcctgcatccccattgtatctaggaagtaactaacttgcttttgattttacaggctcataggcggaggaagggactttccttgtctcagataagactttagactgtcaacttttgagctaatgctgaaatgaattaagactttgggggactgttgagaaggaatgattggttttgaaatgtaaagacatgagatttgggagggacctggggtggaattatatggtttggttctgtgtccccacccaaatcttatcttgaattgtactcccataattcccacgtgtcatgggagggacttggtaggagataattgaatcatggggtgggtctttcccatgctgttcttgtgatagtgaataagtcttacgaaatctgatgttttaaaaatgggagtttccctgcacaagctctctttttgctttccaccataagacttgactttactccaccttgccttctgccatgattgcgaggcctccccagccatatggaactgtaagttcattaaacctctttttcttcccagtctcatgtatgtctttttcagcagtgtgaaaatggactaatatttatgtacattttttctagatatatacttctttatataaatatacatatatatatacttgcacatataagtatatatctaaaaagaatattcaaaaacatagaaaagacatttattcttttcttaattagaccctgtcttctctatcttcttcttttaacctttatatgtgattacaatacaacattttggatattcagaattttaaactccgttcttgtaggcacatctgacttacacaagatctcacaaactttttaagaatcggtcgacattcaaatattttctgcccattctctgcctaatttctcaacttatcactaggcatgccaaccacggggattctaatttcccagccttttctaagctttcttgtgacccagctcattctctgggtaaaactgactagacttcactgggcaaatagttaaaggctgtttaatctatggattgatcagcaacttataaaattacttgattagaaaaggtttgctagatgaactagaaaaggccaagtgaatgaaacagtaattagcaggaactgaaattaaaggaaacagagagagaagaacctggacagagaacaagccatgaaagatcatgatgagcctacatgttaaagaataaaaaatgataaatagcagaatctttgaggtaaagaacagtatatagattcgattgaaaaaatgagctaattgtactgaaagaagtgagtagatccttagagagaaacagaggcacaatgcaaaagaaactatgtgacacccaagacaagaaacaaatctttaatctaagtctgtctctatgttatccccccactttcctgattgaatctgtgtattttgctctcaaatttgcttacgtaaaatatgccccaatagaaccatcaatctgcatcaatttgccatcactggcaaaatggcattatttttgaggaaaaaaaaaatgatcttggtttgaggggatttggacaactattttccagtatattctgttactcacagtgcttgtgttagtcttctaaactaaactttttacattgcaccaatgtaaaaagccatataaaccccccaaccttgtaagtaatttatgaaaacttatgttattcggtaaaaacaaggtaattgcaacccttatatgctgattcctcagagcagggaaacataggaaatagacttggtggcagctttcagtaggaaaggagagaattctgagttgctgggggtacaatgggaaccagtctgggcctgagaaataattatttgggctacagttggatgacctatgagctaccatcatattaccacaacaatcaaaattttgtattatatattgcctattggattgtaatattcatactctacatgatctccttaggttaattttaaaagacaaagttaccttttagagaaaaaaaaaaacagaagttcactctatatgtgaattttacttcttgataattctttacaaaccataattatattctatcataacattttctgcactagcattgaaatgcaattggctgtcgccattgcttgcccctttagcaagttggtgagttttgctctttcccacctgtgtatccaggtgtcccagctcagttccctatggtgagccctgatggtgacagtgatgctgccaaagcaagataactaaaatcttgtctgcaaaccatcttcccattccatggctttggaagggagctgggattatgcttggtccttttccttgtcttcctttcctcaaattcactctcacatttaagaaaacatggtgaaaatgtgcccacataaggcatcttgactcttcaaactttaagatatgttatacattgatgacatatagatgtatttctttatgctttcaggacctttgtaatatgtgactcatttttatgtgatgtctactagggacattacataacatgtgatgtctagagaaagaatgggattcttcaaaaattctgcagtaacaagaatgaaatcttctaaagcttacctgtcaatatgctaggttatgtgtgatcactatactatacgaacattccaaaatcttacagatagcatgaccatttatctgtgtttttataatgttttcccccattagtaatcaacccatgtttgcttttgagtgattagttctcaatattatccacctgctcgtctatgctgtaggctttgtagatcattcccttcttcaaaattatcctgaaatttagtccttggatctatgtacctcagacatttatcaaggcaccccaattctctcactttccagctctttctgttgtctagttatttactcttggaagtctttgcagacttacttttcagcatcaagattgtcttaccatttttgtctctaaagcatcattgaatctgaacatgacacttcaatgctacagttcctaaaattttatttcttcctccatttatgcaatttttcctaaaatactatttctttcacagtcatttccaggaaaataatctaattcaacataaactttatgaataatccatttggatcccacactatgctagttgtaccttaaacacactgtaaaagaccttattggtggtgtccagtagggagaaaagaataattccaagtgaaaccactagggagctcaattagggcacattttcaagtgctaaattctagtatgcatacaatatgctctttataaatatagaaaccatattcttatttatctcttcctatttagccaattgcccatcatggtcctaggattacaaccaccatactatataggatttaatgcttgtctctgtatgtactgataaaatattatccattaacatactttatgttcaattttattacatatttttcttcatcctccatcggtgttgtctacttgggattttaagcttatgtaggatctggccatgtaggatttactaactgcacaatcagctcagtagcctcccacagattctaaataatattctaaaactaacaaaaaagttgtatcgatactttgttgattaaatgaatagtgcgaagttttcctcccaagtgcagtgtgtatttttatacttcttctaagctataagtttcattaacttcaagaacagtagttcccctagtagtgccaatttttccatcaagcaacttaataaggtatagttgtaatgctggctaccattcagatggtgacaggtggcagagaaagcacacaatggaattttccatctgtctcctactttctggccaaagcttaaaggacagagtatgatttgttctataatcttcacttacttcttttcatctacacaccaataaaaataagtatactttagcttatggaggtttacagatcttgaaggtcaaaaccatgtgcttcatctatcttcactttttggaaaaagtacatttgtttattccatatgaaagctgaattctggcttagaatttcaccccttttctatggaaaacatcttaccttccaaaagctttacaataatctgaattcatgtctccatacagagtaataaacataaagaagatggtatacatcctatttattgaattgctgaatgcattaaagacaacatcacttcattttattaatagttttgtaaagtttagattttggtggtattcattatgaaagtaagattataatactaataaggaacataacttatgacagatggagagctgcagctttaaattttgcatatgagggaaaatatatatttttgatggaaatggtgagttttggagtaaaattttagttttgtttttgtttttttgttgtttttttttttcctgagacagagtctcactctgtcacccagactggagtgcaatggtgcggtcttagctcactgcaacctctgcctcccaggttcaagcgattctcctgcctcagcctcccaagtagctgggattacaggcacccgtgaccactcccagctagtttttgtatttttagtagagacagggtttcaccatgttggccaggctgttctcaaactcctgacctcatgatccgcccatctcagcctcccaaagtgctcagattccatgagtgagccactgcacctggcctagtttttatttttttttctatttaatttttcatgattctttttatatagcctgttctgtgccattataatgcagtaaagtttaaaaaccataacagaggcagaaaatatgtagttataaaatgtttctagggaaattgctgtccttttcctctcactgaggtcttgagtggcattcttggataacatctagtaaagactatattttaatatgtttaaatttaagtgactatctgagtgaatgggttaactctattaaatccatttttctcaacaattattaaataatgtaaacaaggcagtatgctatgtgatatgtaataaagtatatgtcttttttaagaagcttataatgtagcatgaaagaattaaaatatagattgtgctgtaatcaaaaggagtgtacaatgaatgcaatgacaatggaacatgtattctctcaaagtcaaaacaagcagaggtcacgtgtgggtcggagcccatacacttgaggaaggcattgtaatattgatggaagtggcatcgctgtagaaagggcagaggatggtccaagttgtgggaacaatatgagtgatgatattgagtatggatagcactgaatttttcaatgatctgtaggtctaaaaatgtttctagaatgaaggatgtgaataaagaaataatgcaaatgaggccagaacagtaaattggagttaaactatgtgtcaatgtttcccaaatctgaatgctcagagtgatcatctggaaagcttattaaatatccagattccttggttttgtctaaggcaactgtattttaacaatctggtttgggcagggctagtataaaaggcaactcggatggtggtaaacatagatgcttccatgtgaaaggttttgagagattttgaacactagggagaagaagaaaaacctgtctttagtttggtaaacaataggaagacactaaaggtattggaaaagattaataagatgttaagagaagagtgcttttaaaagattcctctgatgtggagaaagacaggttgtggcactgaaaatgcaatgtaaaaaaaggaacatataaaatattgcacacattgaattcttcagttttggcaagaagttgggtgtgtgggatcaaggaaaattaagattctggataattcacataagtattctagtttaatcaagggaaccgacgatcattgagacatactatggaaagacaaaagttcaaatgtgtgaactctgacaataccgacatcagaaaataggaaagaatagtctgtaaagaagcagatataaatctagtagaatcagcaggtgagtgcatattgtggaaataggtcatagaatttaggaaacttgcatataactggcaacgtgaactaccacagaacaattgaggaaggagggacttggaaaagttagataatactgttctggaagccagtaatggctctagggataacttttttttgttgtttttgtttttgttttttttgagagagagagcctgaaacagaggatctggaatttatcaagaaatgagtggctagttagtaagcaggggcaatagaaagcatttctcttttgtttaattttgttatacaaaggaatgataggacaagaaattaacaaagtgttagtgagagaaagtataattgaaagaactgtactcaagaagattagtgtgaatgatttgtgtatttgtgtgttggtatgtgtatgtattttaagaacagctttccagtgaagtatagcattcacaaggtagtaagaatattcttcctcagaaacaggagtgagtgaagaaaggaaataaaaatactaggaaagtgtagtaaaatgcattaagcattatggtccttgatgtccagtatagcaatatcttgaatgtatgaggcaagaagaggattcttagataaccctggtattttcagcttgataaccaactgaaaggtaatgctatgatagggagcacagaagagcagttacactgaggagaaagatgatagaaagatgatgtgatttctttgagtggaggggtttttgaggtgtcatgagggcatccataagatgtggtcagaggataattaaatgtatagcacaagagaactaacacgatgcagagacttatttaggaaagtcattttcaaagaagtgagagttgaagctgtggaataagataaaacagaacaaatgatagagtagggaaaaaagggttgggagttcagcaccacctcatcatttttctgacatctgagggggtagatggataaaggttagccaggggggaagaaaaacaggaaggagcaggaatagcgaaaagggaatcctggaaatatgtgagacaaaattgagagacgggagctttcaagatgaaagttttgaattaagaataaaagaaacattaaaaatatataatcttatactttttaatgttcttggctgctttcatgaaagctattttaataaagtaggaaaaagagaaacaaggctaaaataggttgaaggatttcagacaagtaggaaatgtgggagccagtaatatacactatttttgaaatgttgtggaaaaatagaagtcacattcttagaggctaacatataaaaggaggtttttaaatataaaagcaatagaagttaaaatatagcttggaaaacaggatgactgaataggaacagctcctgtctgcagctcccagcgagatcaacacagaaggcgggtgatttctgcatttgcagctaaggtacccacctcatctcattgggactggttagacagtgggtgcagcccaagcttcataagcaaaggagaaataaaatcctttagagacaagcaaatgctgagatattttgtcaccaccaggcctgccttacaagagctcctgaaggaagcactaaatatggaaaggaaaaactgggaccagccactgcaaaaatataccaaattgtaaagaccgttgacactatgaagaaactgcatcaacaaattggcaaaataaccagctagcatcataatgacaggaacaaattcacacataacaatattaactttaaatgtaaatgggctaaatgcacaactagcaaattgtataaagagtcaagacccattggtgtgctgtattaggagacccatctcacatgcaaagacacacataggctcaaaataaagggatggaggaatatttaccaagcaaaaacaaaaaaaagcaggagttgcaatcctagtctctgataaaacagactttaaaccaacaaagataaaaaaaggaagggcattacataatgataaagtatcaatgcaacaggaagagcgaactatcataaatatatatgcacccaatacaggagcaaccagattcataaagcaagttattagagatgtacaaagagccttagactcccacacaataatagtggcaggatcccactgtcaatattagacagatcaatgagacaggaaattaacagcgatattcgggagttgaattcagttctgaaccaagcagacctaatagacatctatagaactctcctccccaaattaacagaatatacattcttctcagcaccacgtcacacttattctaaaattggccacataattggaagtaaaacactcttcagcaaatgaaaaagaacgaaaatcataaaaaacagtctctcagaccacagtgcaatcaaattagaactcaggattaagaaactcactcaacaccacacaactacatggaaactgaacaacctgctcctgaatgactactgggtaaataatgaaattaaggcagaaataaagatgttctttgaaaccaatgagaacaaagacacaatgtactagaatctctgggacacagttaaagcagtgtttagagggaaatttatagcactaaatgcccactggagaaagcgggaaagatctaaaatcgacatcctaccatcacaattaaaagaactagagcagcaaggcaaacaaattcaaaagctagcagaaaacaagaaataactaagatcagagcagaactgaaagagatatagacacgaaaacaccttcaaaaaatcaatgaatccaggagctggttttttgaaaggattgaaaaaatagatagaccactagccagactaataaagaagaaaagaaagaagaatcaaataggcacaataaaaaatgataaaggggatatcactactgatcccatagaaatacaaactaccatcagagaatactgtaaacaactctatgcaaataaactagaaaatctagaagaaatggataaattcctggacacatacaccctcccaagattaaaccaggaagaagtcaaatccctaaatagaccaataacaagttctaaaattgaggcagtaattaatagcctattaaccaaaaaaagcactggaccagacagattcacagccaaattctaccagaggtacaaagagaagctggtaccattccttctgaaactattccaaacattagaaaaacagagactcctccctaactcattttatgaggccagcattatcctgatatcaaaacccggtagagacacaacaaaaaaagaaaatttcaagccaatatccctgatgatcatcagtgcaaaaatcctcaataaaatactggcaaaccaaatccagcagcacatcaaaaagcttacccaccatgatcaagtcagcttcatccctgggatgtgaggctggttcaacatacactaatcaataaacataatccatcacataaacagaaccaatgacaaaaagcacatgattatctcaatagatgcagaaaaggccttcaaaaaaattaaacaccccttcatgctaaaaactctcaataaactaggtattgatggaatgtatctcaaaataatgagctatttatgacaatcccacagccagtatcatattgaatgggcaaaagctgtaagcattccatatgaaaaccagcacaagacagggataccctctctcaccactcctattcaacatagttggaagttctggctggggtaatcaggcaagataaagaaataaatggtattcaaataggaagagagggagtcaaattgcctctgtttgcagatgacatgattgtctatttagaaaaccccatcgtctcagcccaaaatctctttaagctgataagcagcttcagcaaagtctcaggatacaaaatcaatgtgcaaaaatgacaagcattcctatacaccaataatagaaaaacagagagccaaatcatgagagaactctcattcacaattgctacaaagataataaaatacctagaaatacaacttacaaggaatgtaaaggaccacttcaaggagaactataaaccactgctcaaggaaataagagaggatacaaacaaatggaaaaacattccatgctcatgactaggaaaaatcaatatcgtgaaaatggccatactgtccaaagtaatttatagattcaatgctattcccatcaagctaccattgactttcttcacagaattagaaaaaactactttaaatttcatctggaaccaaaaaagagcccatatagccaagacaatcctaagcaaaaagaacaaagctggaggcatcacgctacctgacttcaaactataatataaggcaacagtaaccaaaacagcatgctactggtaccaaaacagatatatagaccagtgaaacagaacagaggcctcagaaataatgccacacatctacaaccatctgatcttcgaaaaacctgacaaaaacaagcaacgggaaaggattccctgtttaataaatggtgttgggaaaactggctagccatatgcacccttgttttttcattctcgtgtttcctataattgagaaaagctttctactggagaaattactataaatccctccactgttagaccctttccttgtaaaatctatttaatatattttttttaaaagtactatcataataaaaatgaaaatgtatatgacagaaaactgaaactggaccccttccttacaccttatacaaaaattaactcaagatggattaaagacctgaacataagacctaaaaccataaaaaccctagaagaaaacctaggcaataccattcaggacataggcatgggcaaagacttcatgactaaaacaccaaaagcaatggcaacaaaagtcaaaattgacaaatggggtctaattaaagagcttatgcacagcaaaagaaactatcaacagagtgaacattcagcctacaaaatgggagaaaatgtttgcaaactatccatctgacaaagagctaatatccacaatctacaaggaagttaaacaaatttacaagaaaaaaacagccccatcaaaaagtggccaaagcatatgaacagacacttctcaaaagaagacatttatacggccaacaaacatatgaaaagaagctcatcatcactggtcattagagaaatgcaaatcaaaaccccaatgagataccatctcatgcaagttagaatggtgatcattaaaaaatcaggaaacaacagatgctggagaggatgtggagaaataggaatgcttttatgctgttggtgggagtgtaaattagttcaaccattgtgaaagacagtatggtgattcctcaaggatccagaaccagaaataccatttgacccagcaatcccattactggatatatacccaaaggattataaatcattctactataaagacacatgcacacatatgtttatgcagcactattcacaataccaaagacttggaaccaacccagatgcccatcaatgctagactggattaagaaaatgtggacgtatacaccatggaatactatgcagccataaaaaaggatgagttcgtgtcctttgcagggacatggattaaactggaaaccattccggcaaactaacacaggaacagaaaactaaacactgcatgttctcactcataagtgggagttgaacaatgagaacgcatggacacagggaggggaacatctcacacgggggcatgtcaggggctggggggctaggggagggatagcattagaagaaatacctaatgcagatgacgggatgatggatgaagtgaaccaccatggcatgtgtacacctgtgtaacatacctgcaggttctgcacatgtatcccagaacttaaagtataattaaaaaaaaaaaaacccaagggcggagtaaaaggagataaaagtgagtaaaagcacagatttgtcataagagatctgttgagaaaggtggaaggacagaagtaggtttcaaaacaatcacgacatgttctgaaacaggaggtaaagaggggaagatgaagaggaagatgttggttggctgggtgtagtgggtcactcctgtaatcccagcactttgggaggcccaggcagatgtaacacttgaggccaggagttggagaccactctgtccaacctaagaaaactccatctctactaaaaacacaaaagttagctgagcatagtagcacatgcctgtagtcctagctacttggcaggctgaggtaagagaataacttgaatctgggaggtggaggttgcagtgagccgagatcatgccacggtactccagcctgggtgacagaacaagaccccgtctcaaagaaaaaggaaagaaaaaaaaaaagaaggaagatgctggaactgggaagtttgaggaatttggcagccaatgtattggaaatgtcatccatatggatcttcaaatcaccaagattgttggtaactatggccttccataaatgtacctatggttttgtagtaattatgtgtggaaaactgtatgattcctcagtatttatttggttttccctgcactttctctgctaccaaacatcagaatcctagatcattggataagctgaagttttcagcaactctaatttgactgtcactacttttcttatctatagtagatgttgtccacaaagtgaccacgttatatacaggaaatattacaatcacatgtcaaattttgttctcaaattattattaatttcccaaaatattatgagtcttttgtatatcttgttgtttataatgacaataatttgagccttttgtttattggaatcttctttattttcatggctatggaggcattcacatcagtttccttgagaaaaatcaactacctagccaatagaaatgatttctttctgtaaaagatatcttttttttttaataatttaattagttctttttttttattatactttaagttttagggtacatgtgcacattgtgcaggttagttacatatgtatacatgtgccatgctggtgcgctgcacccactaactcgtcatctagcattaggtatatctcccaaagctatccctcccccctccccccaccccacaacagtccccagagtgtgatgttccccttcctgtgtccatgtgatctcatttttcaattcccacctatgagtgagaatatgcattgtttggttttttgttcttgcgatagtttactgagaatgatgatttccagtttcatccatgtccctacaaaggacatgaactcatcattttttatggctgcatagtattccatggtgtatatgtaaaagatatcttatctgcaggtacaactgaatggcttgtcaaacagcttaagtcagccgaccaatctaccactattgctgctctttgtatttaaaagttcagccgagatgatatacctaaataatagacattactcaactttccaaaatacaaacgggtatccaccaccactccactaaagtaaatcaggagcattctaacaatttaccatgttgcccctcaaacacaaaaacttaagcaccgtaaggactagaaccttcttacttttgttttctgttgtttccttgacactttacaggatacttaactctaaataaataaataaataaataccttgttgaattaaggataatatatgtagtaaattttggagggtagagaaggaatactaaaatatattttcactagtggaagataatttccattagtttctgagcttaccatggttatctcaaaaatattttcatttgtctagaaattttgctcagtattttttaatccacaactcagccacttatatatattcctagtgcatgttggctccatcctcaaagtatagtttaattgaagttctgtttccttggtgcattaattagagagagataagctggtgcatttttagtttgggaacatgtctctagctatttctcaggtgtttgcgcttggccaaccctagtgacattttcctatgttcttttttcacctaagtgtgttctccatatctcttaaaccagatagtattttgagagacatttaatccatctggtttattactttagctcatacacatcacattttagcacttcagtgtatcgtaaatgttctttgattcaaaagatactcagcagcttagtgaatatttaaagaatcctactctgggagaaataatatttggcaatttatgccaattccataattttagcattttgacttaatttagcatagaatttggaatccacaggagtgttatatatatatttatggtttcattagcttcaaatcttgtagtttagctactacaggttactagactattttcatttgctaagaaaaaaaatgttgattactcttcagcttgaacttatattgcccccagatgcagattaaccagagtaaaaaatatcagtgcttcagtaactgatattcagaaaaataaaattaactttctctgaaattagaagcttttaccaaactggaatatatcattgtgtcaggagttggacgaacattctatagtttaattgttgggactttcagctcagatagctctgagtttgaatctagactttgttaatttaatagatttgttatctttcacatgcatcacatcctttctatacttcagtatcaaatctgtgaaaggggcatattaagagtatgtatgttataaatttgttataaggcaaatatgacatgatacgcataagttgcttaaagtggaaccaagacatggtgcttactgaatgttaactattgataaaatatatataagcttcttaacagagtacctggtatatgctcacaaaagaagtttcagattatgaaatgtagtttcagatgatgaaatgtcatttcttcccagtattttacattcagcacccctcctcaaagcggtttttgtttttagtgtctcaaaactggcatttttctctgttttaaccatagtttctgttattattgcagctaagggaactaataagatagtgtttcaatggtttcggggattcttatttatagtccattcttactgcagttctttcccccacagtgccactaggttgatcatttaaatgcacatgtctgatcaacctcattcttgttcaaaagacattgatgtctctccattgtctattgcatatatcatattggtcatcatgccattcagtatcacccaacttgactcacatcagcatcagtgacctccccaaatcttcttgaaggggccagcaacactgggtctctagacatttctccaaaacaagataattttttacacctgagattatgcccagcctacctccacaactcataactcagttatccctctatctgtgttttatggtctggttgtcttaaaagttttatgacctattttgggaggagttgaaacaaatccgtgtggcctcgacacctctttcatagtgagatgagtttgaggagcaatacaatagatctggacttagaaggcagactttacagcctaacaccacaacctattgggagatggacttttgaaaagttctgtcgattgtttcagcactgattctctcaactaaaaaagggagctatcacccgttttctctccctcacaaggtttttgtggggatgaggcactgttttggttttctattgctaccatatcaatttaccacaaaacgtattggcttcaaacaacataaatgtgcttttcttatggttttataggttggagttccaacacaggtgtcccactgggctacaaccaagatgtttacaggacggtatgcctttttggaggcttacgggagcaatccatttttttgcctttttcaccttcctgaggcctctggcaggtctttgcacataatttctacatttcagaaccagcagggagatagtgttgtgtccttctcatactgccttcactctctgagcactgccaggaaaagttcttcactttaaggcctcatgtgattagattgtgcccacccagaatgcaagggcggggtcatggataacttttggagccaacctaaaagtaacatttgtccacccaccaaaatgtttagtgattgtgccacccctgtgatgtttcttttgaaacagatgaaagttcaaaactctctgtgtgtgagtatatgtttgtgctgagacatttttaaaaattgcttttgcttcgagagcaaagcaggagacattaatgtctctgaaatgatttcacaagaaatgatagtgaagtgaaaaagctattttatttcttttccgcaatttctactcaacgtcataaacttgagaatttaattccactagtagagaataatttggatcaagtcctcagatctatatgatattggtatatcagaatgtgaaaacgcttagggatgtcctcaagtcaagaaagactctcctggaggtgtgcaggaagtgacaggacaatggctcctctttgcatagatgcagcatgtaataagccaagtactgcaagtgttgtgaagagttttttctttatctctcctatatttaacaacaagattgcctagacatagaatataaaatttacatgtggctgatgcaatgattattccagttctctttgtggattaagttatatattgttgggaaactaacataaatatattctgtatccatcagtggactgaattttttcacatcagttttccgctgctatcattcagatgtccttaaattatggactgagttactataccattaattgtatttaattaagtaggaagagtcttctaagatgaattaaaagagtgttagctattgttgaaataatcaatgcatagaacacttaaacgaaaagtgactcttcatatcataccactctttaaaatcgtagccttttctcctttaaactgatgaagaatttcttgtgaatatgtgtaggagagacaaaaaagacaaaaacaaatgagctccagaatacattttagttcattgaccagtatgtcaataaaattttaataagattttctgtcttacaattttggaacttgaatgatagattagggttctgagaccatttttctagtaatcttcttttgtcctcagtttcttcattttgaaatggaatgatcataaaatggttttaagttgccttccacttaaatgtgatgtcttggaaattgaacagaggtggcttatagcgattgtacataaatgccttctactgttaagtggttaattagtatccctgtgtttgttttatgtcttccttcccccccaccgaaccttttcccaaataaacaaatttatttatttatttatttactattgctcatatacttcaaaagtgagttaactaattacttattaattcccaaggatttttaaaaggctctcttaatttatgtctttatgcttcaaacattatcatacattccttagtctgtgctgtactttattattaaccaaaaataaactaccttaagtagtttataattgtgtatgtggagctataattttatatgtgtgactataacttcccctagcagattgagttgtaaaaccatattttataaatcttagtacaatgccactgggcatatatataataagcacattctttggttatacaaggcatgcttcttgtcatacaggcttatgatctaaatctggtggtagactaaggaactgaatctgcttgccgacatcagtgtgctaacacaggataaggaaagggcaaaattacagcaaactttctcctgtgatagacattatataacctcaaagcgtaactatcccatcagagcatcctattctatacacagatgttgggcaatgaagtgaaattaacaggcaagtagcagaaatgttctgaagacaaaatgagttactaaacttcagttattaaatctcaataaatagtgaagaagaactgttggtctggttctttaaaaaggatatatttaaatatataaacaaatgcagagcctactgctacacaatttgctgcaatttgtgagcaactactgtgttactatgtagccacaatacctctttcaatggattagtctaaggtgggaaaagtttgtttcagacactaaatggtagtaccaggatacaaggtttgcctgacagcaaagctcctcctctttcctctgtcgaagtgagtggattctgcaaaacaatggtcattataacgaatcaaaggatatctttggtacttgtgatagaagagagtgggagacaagactgtttttagggagagctatggggggtagtcatatgaatcacattgaattaaatcattaaggcaaatgttttatacatgtcaatttatggtccaggttctctcactaagaagacaggatgaggcttccatttttactagtatgatggattagttaccctgagcacaactcttcttactgaaacaataagatgctggataaaaatatttctaaaaatctgtttaaatgcactttggggccagcacacacacacacgcacaacaaggaatccaaacagtaccacaataaagtgaaagtgggacccatgggagtttagtggacacccagtctagctttcatcctgagggtttatgttgaactcttgtgtcctggagtttcttctttgaaggctgcctgaagcacagagaacagaagttaaaacttagagctggctggccagatgtagggaagctaatatgagatctcaacaaaaagctggattttcaaaggactgtagcctatataaaggtgaatgagaaagaagtcctgtcacagaagaagatagcaaggaaacttttctgtcttgatcttggtactaggataagggggacaggtgtattttgagaattcatgtgttgaacccaatctccaatgtgaggacatttggaagtgaacctttggaaggtgattaggtcatgaggacagagccctcctgaatggaattagtgcccttttaatagaggccccatggagatctttgctgtttccaccatgtgagattgtagcttgaagatggccatttataaatcagaacatgggtactcaccaaacattagatctgctggtgccttgatcagggattttcctgcctcccaaaaggtgaaaaatacatttctgttctttgtaagctgctcagtctgtgatattttgttatagcagcctgaatttaacagaatttttgaagagcccaatcttaaaatccagtaatcccaaataattcaaaggagaataaattaaaaaaataattacaactaggcataccataataaaactatggactccaaatacaaagggaagatttttaaaacatctagaaaataatcacattattaaattaccggtaatttaattgatgtcagacttctcaacagcaacaatgaaaacaataagaccgtaaaatagtaccttcaatctactaaaagataacaattattaacctagaattccaagtgcaggaaaattatcttgctagcatttggtcaaaatgaaagtcttttaaagaagtgagagaattatcaataacatatactcactaaaggaaaatctaaaggaagtgcttcacataaaaggaatatgattgcaactggaaggtaggagacttacagaggtaatgttagtaaagatataggtacatactaagtatatatgagtaaatattgaatgaataaaaattataataatcctaattcataacgatgaaaagagtagactaatgggcaaaaaatggcacatattctaagaagagatggtcagaggtgttgatatctaaggacttggtatcatctgaagaaagataaagattattatttaaatgatggcaaataaagtatgcattctaaaacagctaaagtaatcactaaaagaataaacacaggtaaactttctaaacaaataaaaatgaagaattgaatggggaatttattgaaatctattgttttaaaataggacaatgtacacaaaaaggagagaactagaaaacataaaataagtttgtggaagtagtaatactgaaagcaagtttgtagaaataataatacacataaattgactaaactctccagttaaaagaaaaagatttttggattagattttttaaaagccagccatgttctgtgttaacttaaagtataaggagacagattgaaaactaaaaaatggaaaaatacataccatgtaaattttatccaaaagaaaggtaacatgtctgtattcttagcataaacacttttttattcatcaaaatatttataaagagaagaaaagacatgtcaagcccagaagaagttatttcaacaacataatgagcaccacaacaaaaagattaatttaccaaatatgtaaaaaacttatataacttaaggaaaatactagcactcagtagaagaatggactaaagaagtaagcagacattttacaaaagaggaaatcaaaattattaataattatctctataaatattaaagctctttagaagtaagcaaagtgataattaaatccacattgagaacctattataaaaccaccagattggcaaacgctacaaagttagtcaatattgttggtatgtactactggtgtatgagtgtcagtgaggatgtggtgcaaagggacccttcaatctcctctgataggaattcaaattgatagaaccctttggaaaaatgtttgatattacctaataaatattggtagtttgtacattatactgcctaaaaagtctacttctaaatgtaaaacctatagaaatttttgaacctgcaaagaagatatatataagaacattaccaacacaaagaaatgttaaatgtttgagatgatgaatatgctaattatcctgatttgatcactatatattacatgtattgaaacatcactatgtaccccatgaatatgtataattattatttgtcaattaaaaatgaaatgttaaaaaagaatatacatataacggtaacatttgcaacagcatgtgtgcaggtatgtgctcatgcgtggttcacatagtcacacaaatatacaccaaaaatgagaatctacccagaaatccattaacagtagaatggataaataaatgccatatgcatcattgaaaattgatgaaaaatctacaggtaaatgtatcataccaatccaatatcaaaagcatacttttgagcaaaaagaataaatcataaaataatttctaaactatgaatcatttctgtaatcagcttaacatatgtgtttagcgatacagacataggtgctaaaactacaaagaaaggaaaaggaatcattaatacaaatttcaggatcatccttacctgaaggaggaagatgagatgataaaaggaaaatgggggtggataggcacacatggggacttctaacttactggctatattcttagtcttgatagatattttcattctttaaaaatatatgtgtgtgcatgtataacatgcataacataaatatatgtatgtgtgtaaatatataaagacaaacctaggtgacaattagacattagttaaagtatattccaaatttatcagagtagaacagaagaagatccagttgcttctccttcctcttcacttcagtgtgatggttaaaaacagaattacagtttcggggttcagtcaactacctttgtgattttaggcaagttacttagcatctctgtgcctcagtatccttatctctaaattaaagataatgataatgtctaattcatgaggttgttaaaaggcttaaatgagtttacatttgtaaagcacttaaaacagtgcctgatatagaacgacaactatacgttagttaaataaaatttataaaagcatatccctttgtcttcctaattgtagttctatatttacttctcagaatccataagataacaaagagaggaaaaataccaagtggtacctggattggtttcacactgaatatatagaatgacatggcggagaattgatatttttacaatattgagttttgaagttcatgaacatggtctatccctgtatttatttcaattggtcttttctgccagtaatgtttataaatttcagtgtggaagccttgcacattttccactaattgtatttctagttattgataaatgcagtgctatttaaaatatatcttttatcaaaatgtcatttctaaatgtttgttgttactgaatataaataacatttgcttttgtatgtggcaaattcaccaacccaacttaaagcttttctgtagattctaattgtttacacaggaaatcatgtcttttgcaaatagtgatgatgttatttatctccatatgaagggattaaaaaataaaatagggatggagttatatttttaagtcagtctctgccaaaataaagcacatctagggcaatttgttagtgtggaggctgctttaagtcctccctagtccaataggactctctttcttgtggtgacatatgtgtgtgtaagtgttcaattactactattatttaccttgaaaatcaaaagtaaaccctccctaaaccctgatagcattcattataaaatttgcatggtgaaccatgaatgttatttgaaagaatgcaatagcatacctgttattttcccactatatcttgataactcactctgtgactcagaaattgtcttttctttttgtatcatcttctctataatactcggttgtttatgtgcaatgttctactttttttttttttttttttgaaacagagtcttactctgtcacccaggctggagtgtagttgcataaacctccactccccaggttcaagtgactcttctgcctcagcctcccaagtagctgggattacaggcatgcaccaccatgcctggctaattttgtatttttagtagagacggggtttcacaatgttggccaagatggtctcgttctcttgacctcgtgatccgcccgcctcggcctcccaaagtactgtggggattacaggcgtgagccaccgctcccggctaattttgtatttttagtagagatgggatttcaccatgttggccaggatggtttcgaaatcctgacctcaggtgatccgcctgcctcggcctcccaaagtgctgggattacaggcatgagccaccatgcctggcctaagtgttctactttcaattgaagtaatttgcccaattgagcaaattatcattcctgttttgttatatttagctagctgatggtaaaggacatccctatgagagcaacatctgtcaaagtattgtactttgttttatgaagagactggcttttaggaaatggtgaattgctttcttcttgctttttgtggtgggaggcactagagagtgtaatagagcagtgtagattgatttgtatttttcttttccacttgtgttgggttttgtttcactattatattataaaaaccaaaataatgggagttttccacaaatggaaggatgtgacaaatataggtgtgattcagcccaagataatgatttcgaatatgaagaaatcctacttgaaggacttggaagtcttattacattacttcatcattaaaacgacactaaaatttgatggtagtttcctctaagcactgttttaccatccttaaatattgaagtactagaactctaatatagaaatattagaaacattaaaactagatagtaaaatgctttaacaacagcaacaaaaaagcattacaaaacaatagtataacctaacatatgcttcatctcttcatgaacacctaattattactctaatgtagtcacctctatttatagtcagctttttatcgtgcttaatagcctttctcgttaagtcccctgactgctttagtcttcaccctgaacagaagtctcctaaaattgaggccaggtgatgaattaggccccttggctccgatagtgaactagtagagtccggctgtctaaacagctattcctgttcaattgcattagtgtgtttccctccagggtgataattgctcagaactcattgtggctcatttctttataatgcccataacagtgcttttacaagggaaggaattgcatattttagtgctgtgataaaatgcaagaaggcatgctgctgtaatgtggttggccccatcttgtgtacagctatgaacatttgtatttatgacagccatttcacacttgtatatttgggaaatggtgaaatgttgatgtgctcatataccagaatttgtgaatctttcatattctgctaagaataaaaaatacttatctaatttcaaacatttctttgaacagtgtctacctgggggtgtgagggaagcaaagtagttgtctacctcctcactctgtaaagataatacgcatgttaatttatgctggtagtttgaatgaggcacagctgctggataaccatgtgatccatctatttcgcggaggatgccgcatttttattcaacagccatggagcaatagaaggaaagcttccattttgtacattttttacaaacggaaaataagagaaagggaggctcacctatgaatactaaattagggaaagcctatcaccgtcagtgatcagaatgttcaaacttctttgtgttgctcattgatgcacaaacaaaccacatgaatctctatttgctcaaaccataattgaaaccatcaccccagtcataaccagttataggatgcttgccttaaaatatgctctcacttgtcctttgatttagaaatcccacagtctcttctgtttttcgtttatctacccaagtcacagacattctgtggcgctggtgtctttggggcatcgtttcctttcttagtttgctgctcttcaaaacctttgcaatcataaaggagcagcatcacctttatttgaagctcctctccactgaacaaatagatatgggaaagaaagttgattttagacatccaattaaatcactctcttacaagggaaattactccgtggagtgttaacgtgttagtctattctcagcaagtcagttggcaaaaaggaagccattttatctttgggcactgaggttatcatttgggcaaaaatactctgaaggtagggaaatgttgtcacaacaaaaatccaaaaggtcatcacccacagatacaggtcataaatttttcttaggaaaactgcattggtttatgatgaaggtgatttttctgtcatatatttctgtgaaaaataagatagttaagggagctcttatgtacatatgtgtaattcataaacttattaaagaatgaaaggtacaatctgatcaattttaaatttaagcaaccacatttgccatttcagagcccatagaaaggtaacccaggaaacagatgtaaactggcaatcgttaatgctgttatatatcttcaatgccattaccagaaataaagaaaaagaaaacacaccatcctaaatctgatagttctgtcctagtaacatttctttttcagtagtttagtatgattaagagtagataagtcttggaaatttgaaaaatcttaatttccagtctttctctaatgtttcagcttagacaatttagttaaaatatctgtgcctcagtttcttcatctttgcagcaatttaagagcccgtatcttggcattcttgattagaggaaagatatttctgatacattgtaaacactaataaacagtagcaaatagaatgtgtgtgtgtcaacaggatagagtttatcttcaaaccattttcttctgcagtgtccttcctcctggggtaaacaatgtttcaattagctttctgttgttttttttttttttttttttttttggtaaaatattagatgacaactgatatacaaacaacgtgcaaaagctataacttcttttggaagtgagggagataaatacaatcttatgcctgagatctctgatggttttctcgaaggcgttgtcactgactgggttttgttttttgtttttgtttttatttttttttcactagaggacaagtttctacacctctaatcagactggtcatacaaaaaaaccattccattgtcaaaatggatgaaagcagatggctgaagaattttgagctttttttatttattgtctctgttgtgctgaactaaccaaagggtaaaacattctctgggaatctctagcttcaagccttggttgcccttgcatgcacctttgaaaatgctccactaacagaaactcctaactgatggagccaagttccagatctgtggtttaagatttgcttcagggatcaggttgctcaaacttcctacagctcttaggagctcagagtatgaaattcatctttcaactcacccagaactaatgtatttgccccatattttctgaacaatggctttatcttggagtataccatatttgagacttcttgattataaaattagaaattatttatgtaaataaaaactcaatttttctgaacaatttatgaaagcccatttgaaatacaacataacctaatgcaatttacataagacctaaaaaggtctactctaatttccaggatataagaggaaataacagtccaaaatagagatgggtttgcacttgcattcctgtttcaaaacctagcaaatgcttataaagcactgccttgtggccagcactcctctatgagctggacatatattaattcatttaatttttttcttttctttttttttttttttgagacggggtttcactcttgttgcccaggctggagtacagtggcacgatcttggatcactacaacatttgcctccagggttcaagtgattctcctacctcagcctcccaagtagctgggattacaggcacccgccaccagcccccgggtaattttttgtatttttagtagagacggggtttcaccatgttggccaggctggtctcaaactcccgatctcaggtgattcattgcctcggcctcccaaagtgctgggattacaggtgtgagccaccgtgctggccaattcatttaattcttaaacaggcatatgaagcagatgctattgttttactctttttcaagattaaaaaaaaaaaaaaactgaggtatagacagaggaattaaattggtcagattcacacagttgctgagtggcaaagctgggactggaatccaggcagcatggttccaaagcctgcactcacacaactctgtagatttgtatatttgcattatttagttgtttccagtgtgccctgtgacagcaagaaataaaggatcagaacttaaattatggaggtgatttttattcattaatctgttccttcattcattttttggtagaagtccttgaaccaaaaaaccaaagttaagatcttgtaaaaagatttattttcttagctccttattttagtacatccagggaactgtggaaagcaaaatgataaacgataacttgaaactatgtaatatctaataatataaaactgacaggacttgaagctatatggtgcagagattaagaacataactttggaaccagtcaggccttcagacaagttacttaacctctctgggcactaattttctcaaactataaaatagggaaaataacagttttcaccacataaaattcattcaaagaggaaattaaatagtacgtatgtagcaagtatgaatctctggtaggcagggcctatattcttcactttctacagaacaacttaatttcttcttttaacttttattctcttgactggtggcaaatttaaccttagtcattaggggaagtactctcttccctatagtcttgtcatggttccattaggttacgtagttccaaggcattttgagagcagtggatgttcctccaattatatttatcattggataatttaaattttctcagtcttccataaagtgctttgtaaatccagatgaaagcacagcctctcatccaagctgggtttcctgagcccatctatataaatgttgcatggaggtggttactgaggaggggtttacctcagtacaccactgaggcatccatcattcctgtctgtctgcttcttctggtctactggccttttgttgattctgtaccatatgtggcactctctacttaaaagcccttctcagccattttctgtctcaaattggaataaaattgatggaataaaattggaggtttatatggtggggaaagaatacaagtacatgtgagtaaacagaaagcagagaggggtacagaaaccatgaggatgaggggcctggcatctcattgtttgggtgtggtggtctggtgagtttcagtcccttgatactatctgggagggctgagagttgatttcctgaggaaagaacccaaattaggcaaatgtaagcttgaagctttcgagaaagtcagtttctatgtttatttaaaaagactattaccatcagttctatgggccagtttcaaaatatgataccaaaaaacattactcaaggatttggtataaataggttagtattcagtaagtgcttgctttcattactactagtcttgctgtcattgttattattgataataggtgaagaacacagggaaaaacagaaccaccacaggccagaagacagaagaaaaacctatacctttaaaactaagcccaaggcagagtgggtccactttctgtctctgaaggctactgatgcctagatgactattatggtggttcttggctatctacacccgtgctgcaggtggggtgatctccctggacacctatttttttcacctttcatcattcttcaagcttatatacaaaaatagagtgttatggggccattctgtgaataagacactctaatgccaagggatttctgctttctgacaaagtatacattaaaccaaataatgattaatattctttattgattctaattgattatgactttgttgaagataatgaactcaatgattagtaatgattacacagctagttagaattagaactgcatcgataaatcactctaataacaagcaagtgccttccattataacaattttattatgtccaaaaaatcattttcataatggagattcatttaggtcttcagcaatatatattgagcacctataaaatgtcaagaaccattctatggactaagtatatgtttgtaagccatagagaaaaatctcagccttcaaggagcttacatcctagtggggaagatgagaaatcagtaagataaaaaagtagcatgcatagtgtgttagagggtgttaaatgcaaacgagaaataataaaacagaaatgggaagtttggaatgtgtggtcaaggtgagattgtaattttagacagagtgaccaggataacttttgagtaaatcactgaaagaagtgagagaataaaccacacaggtgtcagggaaaagagatctccaggcagacaggatggaacatgtaaaagcgctgaggcaggagaatgcctgctgtgttcaagaatcagcaaggagacctagtggagggaattgcaggagaggtacaggagagaagggggtggtgagacaaatcaggagactggggccatttgcaggaggggttccttttactctgacatgggaagccactggagaacatttagcagaggggtgacatgattttattatattttaagaggattactctggcttttatcctgtaaatagattgcaagggaacaagggcatggaaaagtctctaatatatgagctattgtagagaaaattttgatatagttgagacccattgaattctaattctataaattctccttttcctgtgctgcagtctgagaattttgagcagtgaaattctaacttctacatttgtacttacatccactcaacactcaataattgtgctgagagtaatatgtgtaagatgcagttcttggccctgtgagaaatactgtgatgaactagagaggactgcccgcaagaaattctcatttcagaagctgtgatataacctgtaaatgttagacttcaagaacatttatagagatggaaaaatagcataaaagattggctacagtgatgtggttattcaggtctctgagaaaaactctgaggccaaaaatgtcatctaaaaagattccagataggagaaataaacagataagctgtgatacaatctcgtcttgttttacttttctttcgttccttgttttcatttttcttttttactctctttctttttactattatgcaagaaaactaagcatgttgacatccattactcacagccttaactgatcactttgccaaatctctaagtttacagatgactacctagtttccattttgaattatcaaggaattaacacttcaacaatgttagttgcacctgatttacatgtttgaatccctcagacctcgagggaagtatcttagtaacaacctaggtgactgtcatagtcattgagatgtagttgaactgtagctgttaaatggaaaacattctaccacattaatagttgaggtttaaatggcaatttgaggccagcatggtacatgacgcccgtaatcctagcactttgggggccaaggtaggtggatcacttgaggtcaggagttcgagactagtctggccaagatggcaaagccccacctcggctaaaagtccaaaaattagcagggcattgtggcgtgcacctgtaatcccagctactcgggaggctgaggcaggagaatttcttgaatccgggaggcagagattgcagtgagccaagatcacgccactgcaacaatccagcctgggtgaaagagcatgattccatctcacacaaaaaaaaaaaaaaaattttgaaatggggacagccttaatatccatgctttgtttttttctcttcaggctgggttgagggtctctcctctgcttgcctgtcacccagtaagtacctatgttagtggaatgtatcaaaattaactgaaaatttgcgtgtgccactctgccatctctttgagggcagagccaggtgttattcacacctgtttatgaccaccacagggcctgacagacgttagttgttccataaatgtttattgcattaaaccgttgaactggctgtgactatggtacttaggcgactttcttatggaaggcaaatagacattgaataatcatttttgaatgccaaatatttatcaaatatcatgcactcataatccaaggatgcatcaaattccattgccgtcctggaagagcccaaagtccagtgggggagagagacttgaaaactcataattgtgacatggggatgtgactaaacaagtttaatctgagatttagacagcacagggaagggctactcatctctcttgaaattgcagcaggattcgctgaaaaagtttaataaagagcttgaagagtggaatttgttttgtcttctaaagaaaagttggaaacattacaggaaatgcacaccagatattgaaagctctagaggtataaaagtaaaaatgctgtcaattcctaaaatagtttagaccttgtttgtgagcatattgggtaagtgggatgagagcttaagccaaaagctaaagggatttatcacatatgagaatgaatttgaatgtatagattagttgaaaagaaatggaaagttatatagaaatggtaggctagaattgtattttagaaaggtcattttggtgacatatggagggtagattagaaaaggaaaagaccaaaaactggaaaaccagttaggttaataacaagcaacgatgggacctcacattgtgtattgctgtggttggaaatgtggactctggatcaagtctacctgggtttgccttctggtctccatgaccttgagcaacttagttaaccacttggtgcttcagttttctcatctgcataaggagaataataaggaaagctctttaagggatattacaagtattaaattaatgaagcatataaagttcatgacaaatagtaaccatttagtaagtgttgcttgttataattaaaaacttattggactatcataaacattctgtgaggaagatgcagtgtttacactcattttatagttataaatactaaggcttctagggtttaagtcactatgatggctaaatactatatttcgtacatttgcatatgaagtacacatacaagcagtcataagacagtgggtaaaataagagtttattatttactaatatctatcaatggatcttgaatttgatagatttattaaaatcatgcagtcatgaagctctcattccctttagatttttgctacaaattcagaagtttagagtataactgaagcaaccacagggcatccgtagaaaacgaggtttgagactatacagcagaaaagtatagactataaatgataacttttgctcattggccttgctctgcggacacaagcttcagtctgcctgactctgtacctatatttctcctgtcaactgaagagatactctgtagactcttagtttcctaacatggccatgttaatacattttacaaagttgcatatcttgtcagaagaaaaaaatcattacatagttaattcctagtcttctgtcatactaacaggccagataaggtctaaggtctaagaacttgtttgtaaaccgtatcatctatgctactataaatgtttgtttgtttgtttaatttaaacagcacgtgacaacaccatctgccagcttagcaaatgtcctatgtccctcatggttcttttaagacaggtagttctttgttacactgttactcagatatgcataatatcacttggttaaaaaaagattcaaatttcagaaccatctgtgctttatcaagcaatctatatgggtgagtttctgatgtgcaaactatggaaaatggcaattttgaagcacctatcagataaattttcaggaatgtgatgaaggagcagataaaaatctgttttccttgtaggaaaaaggaaatagaataccctgtggataagtcctaactacctcttaataggtgttagacttccccagctcatatgggtttaaggcatcacaattcacaaagtaaaagtttattttaattttcataagaacaatttatgtgtgtagcagagggaatgagaagctatttaacattggagaagtgcattaaaaattattcaatatttatttagtagtattttgtttaaactctccttttggatcctgagttccatagcttctagtacgcagatgcctcacctcagcaaccactcctgtattcactcatctcctcttgcctctgtcactgcccagtctgggagatctcctaaaacattacccggatggtatggaaaacaataagccatagttggcaaatatatattaaactttgaaaggttatttttttctttatacagttctaaattttggttcgatttttcagggcaatcataagttacattctaattaaaaataagtctaatatagaaaaaatctatagttggttatttcaaatggccaattgcttctgatgaaattgctctataaaatagatataagacctcctgtatcactaaatcttaattacattgtggaatgtggaaactagcactactcagtagctgtagaaaaagattggacccccagtggggaaaggatgctgaatagcagctaccatagccttatcatttttgcatttttgtgataaattcttgagtagggcagcatctaagtatagtttttaatttttagttgcttttttaaaatctatatctcattcagtgttacctaatatttaataacaatagtgtttgaacttgtctgtgccagctatataaaatggtgaataaaacaccattccaatctttaatatgtttaaaatctaggtataagtcatttacaattgatatctcataatttttataatatatgtgttgatagaaatcactgcataaatttcaccatttatgcagacaggtccacatccaaattatatggacatataagctgtatgtatattatatagctatatacgtggatgtacacatgtagatatagaaataggaatagatctagatatgtacatttacattttcagaagtcattgagacctatagcatttgttttttttcaagtgacttcattcaaatatgttaaattaatagaaagatacatgctttctttatgttagttaaactttacatcatgtctatgtatttattaggttcatgtttgctatccatgtctatttttaacaacggaaacaaactttggaacagtttataatttaaaaattaccctactcttagaaatattagaatatagaaatattattttttatgcttcatttttaatactgttgtataccaaacttgtttaaataagttcaattcaggacacatagcacataccattgttgtaaaatataccaattttaaagtaaatacatacttagaatttttaaaatggatacactgaaacaaatagcctaaaattggcaatttattttgtaataagataacagaagggagtttaggcaattttatgtgccttttatcaaaaagcccagagttattttcctacagaaaaaccaccagtgcaagtaattagtagattgtgctttactgaccaggctgctttctaattctcaccatgatgctactccattctctacgcatttacagggctgtaattacgtatgaggctttagactttgccaggccagcaaggcaatcagcccccttggaacaagttgaaatggaaagcggcaaaacagtataacacctgggtgatgtcacaccagcaaaacccatggacttagtggagctcacctgtagccaggggactggagtctgaaactgacattgtttccttcaaacagaaatgtgaaatgtcattttcagtaaatcaaataaaccccatcaagaagaactgaaaaataaacaaaacccaaaactccgagattaaaaagacaaagtaggaggcaataccattatttctagacttagttatgatttttattctgtctacttgattgttcacacctgaagcaaaatatattttgcataacttaatgtaatattttttgaatccatcataacctgtgacccataatactcatgatgattctttatataaagaagcattctaagaatgtttattgacaaataatttcctataagttttctctaaaatttttggagtataatttatctgttaggtcaaactctatatatgtgactgagatatggctggcttctcacattatttaacccatatttatcactctgctgcccagactggagtgcagtggcatgatcttggctcactttagcctcgacttcttgagctcaactgatcctcccacctgagcctcccaagtagctgggactacaggcacacaccaccacacccggctaattttttgcatttttggtagagatggggtttcgccagcttgcccaggctggtcttgaactcctgagctctagtgattcacccacctcagcctcccaaagtgctgggattacaggcatgagccaccataccaggactgatttaattgaactttttgccatgacattttactacttggctagcctctccctaagaaacgtagctgatttgaaacagaggtagagacaccttcaaggtattaagacattcatacagacctacattactgtaatgttgcttagcatagtgaggtaacataaaattggacaagagagtatgggcttcagttgtcaggtctattcagataaagatatggatgtggatataaacagtgcatggatatagatataaacatgtagatatatagatgcacatacacaattcttagatttaatgatcatatctttaaaatgcaagggaaaggactacctagtcatccttctcaggctttatctttcacttctgtgattagcaaacttgaagaattaacgaagtccaatctagtgataaagagattctataaagatagaaaagacattttaacattcttagaaactttcaactctggcaaaataaaatgttaaatcacaggaagctttgccaacaaactgtctttatgatatattttgaaagggtcagaatggctgtcagaactctgaagaacagtgcagctctagaacctgttactcctgctgagattgtcaagcaaggacaaatggatgtacaggatcctgattatttatctatgacaagaaaattgcttgattactttcagaaagttaacaccgttttcatgaaagatatcaaaaatgctaattgctaccactctttaggcttctatttcttccaatgtgtgggctgttggtaagaatgtatttttcagccaggcacagtggctcatgcctgtaatcccagcactttgggatgccaaggtgggtggatcacctgagttcaggagttcgagaccagcgtggccaataatatggcaaaaccatgtctctaaaaaaaaaaaaaaaaaaaaagagaaagtatttttcctaaacaacatcacaaattatggtctacagaatcacttgaatgctctagataatggtataatacagtggatatattaaaatttttacacagaattttaagaaatgtgttgcttatcacaataaagatacaataaacttctctttagacattgggactaatagtcagtcagttgatccaaaatatttttaaagcagtgatagatacatatctgacatatgttactttaattcaaattataaaatactcttgatatagaattaaggactcatttgtgtatgggataactggttggagctttactatatttggcatgaaaaatatctttaatttattgtctatgaatttttatgtgttgatttcttcacagtggaataagaactttaaaaagacttgtaaaataatttgggaagagaatccttttatatcttaattattgtttttccactcatcctttagaaactcatgttatgcctttatgtagtctttttaatatgcttaaacttcattttcattttttaaaaccttatttttccactcataagtctatcgtgtatgtaataattaaatcatgtaataacaagtaaaattgatatacttgcatttgtgtttacaacaagcatcgtgtaaacatacaattctagtgatgagagccaacacatgcaagcacaacttactgtaggtgtgcatgaaattcaactgatcagagcagaagtatgtgtaaggactctgggaagcccactatctgtaagaacatctcctacatgatatttaactcaagacatcagtataatattcatatttgtaagtagttctgtgctttagagagttcctaagcaaattggaccccttaaagaaatttagcattctatttttttctcccaatagtagtatcagttgcttcagagacaatgtcttaactttttgccattgccaatagaaggaaagtcgttaggagatagaagactgacagcacagcagcaatggaatatcatgctgagcactatgtgaagtagaaaaaaaactctattacttacatatttttattagctggtattttgtgttgttttatcacacataccaatgaatgcactgaaaagaaatgatatgatgagttcatggaactagaaaaatcatacttcaaagcaaaatataatgaaatataaacatatatacacatttgtatatattataacatatatattttatatatatacacatttattctacatattcagtattgtatgtgcatataaattttaataccactgctgaagtgatatcataatgttcaaactttgggctctagacaaatcatctttaccaaataacagccatgtaaccttggtcaagttaatctttctctctgcctcagttttctgatcttaaaaatggagataatatttcctaagttatactgttgcctacttcattaaataagctcatatgtataaaatgcttagagtaatgctattaatattaatagtagtatgtaaaatatgtgcacagatagatagaagaagcatgtataaaatttagcagttgaaatgctttgaattttcatgtttaaggtaccttgacagaacttaccattttgtgcctgtaccagttatctaagctgcattaatagtctgtggtagaacttctaaaactgatagaaaatatcatgtcttattacacttacccatggaaagccacagtcacctctgtcaacaggaaaacaaatattatgactacttcttttcagagcagcatctccgtatctgtgttgaattcaatactagggttacttcaaagggcacaggagacatggtatttaccataccagaaatagcatacctcatgacaaattctaaaacgtccctgcagccatctgaaatgatattctcttgtagttctggtggcaatttctttttcttttctttctttctttctttcttttttttttctttttctttttttttttctggagacatagtttcactcttgtcacctaggctgtggtgcaatggtgcgaactcggctcactgaaacctccgcctcccaagttcaagcgattctcctgcctcagcctcctgagtagcttggattacaggtgcctgccaccacatttggctaatttttatatttttagtagagatagggtttcaccatgttggccaggctggtctcaagctcctgacctcaggtgatccaacggcctcggcctcccaaagtgctggaattacaggtgtgagccaccacatagggcctctagttgcaatttctgagatactgactcccacagagactgccagtacatggtagcgatctcaataacagttctgctttcatttcatctcttgattggcctttagcagtcagagtaagtgaggctgtcatttcatctcccatccttatgaaattgaattttacgaaagagacgtcacctagagtttgagaggtttgattgacaatctccatatagctgccttgctctagtcagagacactgtcctgaaacctctgctgatgctttcacttgaggaaggaaagagcagatgggagggaagggagacagaggagacaccagcatgcaggtcactgtgacatctccttctcctgatgacaacagctcacacgcttccacctgcaatcctattaaatatagtacttgcttgacaggaaacagctgatgatggtaatgacattgttaagtcactgcctcaaatgggtggagggcagctaaaacggagagggcagaactattggagggccattttaccttgttttggattcataaaataaaaatgcaaatgaaacacacaaatatttatcaagacccaaacagaaagctgtctatacattgtttctctgataatgatatatgaggcatatttttggaaactttatcagcttttcagaaaaaaaaaatctgtatttttacctagttgacaaatttcaaattctccagagggcagctttaatatgtttaatatgattctgctgttaaaaaatagcaatcgagttttttctagagaaagtcatttgctatgagaaagcaataccatatgatacatgaacataagaacattgcaagctatttttatttggcttttactgagctctcaatgaatacaaaatcagtactgaacaaatagatgctgctgatgataaacctagcaacttattctactcaatttctaaagttcctgttaatatataggcaacccatcatccctcatctgcttttccatgtattggtaatgttagccacttattgatgtttttgtttgtgtatacttgctaaattaacagtaagagatatgggaatagattggaacatatagatccatggaaagactgtcatttgaacagctacacctgggccttcttgggtgttttgaaaatttctgccctaaaatccatttggctttgtgtccccacccaaatctcttctcaaattgtaatccgcatgtgttaagggagggacctggtgggacatcagagatgattggatcctgggagtggtttcccccatgttgttctcatgatagtgagtgagttttcacagatctgatggatttataagtggcagtttttttctttctctctctctcctgcctccatgtaaaaggtaccttgcttctccttccccttctgccatgattgtaagtttcctggggcctcactggccatgtggaattgtgagccaattaaacctcctttcttatttttttttgagacagagtcttgcttgtcacccaggctggagtgcagtggcacgatctcggctcactgcaagctccacctcccgggttcacgccattctcctgcctcagcctcccaagtagctgggactacaggcgcctgccaccacgcctggctaattttttgtatctttagtagagatggtgtttcaccatgttagccgggatggtcttgatctcctgacctcgtgatccacccgccttggcctcccaaactgctgggattacaggcgtgagccaccatacccggcctaaacctcctttctttacaaattacccagtctcagatggtatctttgtagcagtgtgaaaatggactaataaagtggattggtaccagcagaatacgaagctgctataaagataacctgaaaatgtggaattgggtaacagacagaggttggaacagtttagaggtcttgtaagaagacaggaagatgtggagaaatttgaaacttcctagagacttgttgaatggttttgaccaaaatgctgatagtgatatggacaatgaagtccaggctgaggtggtcacagatggagatgaggaacttattgggaactggagtaaaggtcactcgtgctatattttagcaaagagattggcagcatttttcccctgccctaaagatctatggaaatttgaacttgagagagatgatttagggtatctggcggaagaaatttctagcagtgaagcattcaagaggtgacttgggtgccgttcaagcattcagttttatgcagtcacaaagagatggtttggaattggaacttacatttaaaagggaagcagagcataaaaattcaaaaatttgcagcctgataatgcagtatgaaggaaaacccattttctggggagaaattcagaaatttgcataagtaacaaggagccaagtgttaatcgctaagacaatggggaaaatgtctccaggccatgtcagaggtctttacgcagccctcccatcacaggcccagaggcctaggaggaaaaattgtattcatgggctggtcccagggctctgctgctctgtgcagcctcagcacttggtgtcctgcatcccagctgttccagctccagccatggctaaaagggaccaacgtacagctcaggcctttgcttcagagtgttcaaaacccaagctttggtggcttccacatggtgttgagcttgtgggtactcagaagataagagttgagctttgagaaactgtgcctcaatttcagagaatgtatggaaatgcccagatatccatgcagaggtgtgctgcagagatggagccatcatggagaacttctgttagggcagtgcagaaaggaactgtgaagtttgagcccccacacagagtacccactggcccactgcctagtggagccatgagaagagggctactgttctccagaccccacatggtagaaccatcaacagcttgcaccatgcacctggaaaagccacaggcgctcaatgccagcttgtgaaagcagctatggcaactgtaccctgtagtgcacaggggtagagcttcccaaggccttgggagcccacccctcgccctggatgtgaggcatggagtcaaaaaatatcatctcagagctttacaattaaattacagccctactgggttttgaacttgcattgggcctgtggccactttgttttggcacatttctcgcatttggaatggaaacatttacccaatgcctgttcccccactgtatcttggaagtaactaacttgtttttgattttacaggctcataggtggaaggaaattgccttgtctctcagatgagattttagacttggacttttgggttaatgctggaatgagttaagactttggggcactgttgggaagtcatgatctgttttgaaatatgaaagggacatgagatttggaagaggtggaatgatatgttttggttttgtgtccccacccaaatctcatctccaattgtaatctccatgtgtggagggaaggacttggtggggtcgattggatcctgggggcagtttcccccatgctgttctcatgatagttagtgagttctcacaagacctgatggttttataagtggtagtttttcctgctatctctctcctgctgccatgtaagacatgccttgctttcccttcactttctaccatgattataagtttcctgaggcctcccagacatgcagaattgtgagttaattaaacctccattctctataaattacccagtctcaggtagtatctttatagcagtgtgaaaatggactaatacaccatttcagatattagcatatatcatagtgtaaaactaattctgtcagatgacatgaatatgtctgattcatctcatcattgatttgggtttccacacctcactagaactaaaacagtgtatcacattgctcaatacctatgatactctataactgcttgtagaagtgtgtgatttaaaagcccatggccattcctcttccaaacattaggtatttttttctgtgttatgaatatgtaaccaatttgtgtgttagcttgaccttgtatcagttgagactcctttgtgaagatattggaaattcaaggttaaatggacgcattatattttccaactgttacctgtcatgtactttgagtgaatcatgaaaactacctagaacagctgtcattttgatatgttctggttcttctgagaagttagatttccactgagtaaaattataggctctgtggagaaatcaaaacagtgctccatctaccaggaaggcctgcactgtgatcttttcagctcatttcacatgagtatagggagactttaaacttaataaatgagaatcagactacaaaggtataaaattattttatagtacaactccagataaatgtcatttttgtgcctctgcagtattattattctattaactgcattgatagtagaaactttcagttcatgtttttatcagaaatgttctgttcttactgtgaactagtctgtactgtgaattgcataatttgtagtaatagagtaatagtaataatcatggttattttataaggtcatcatagtgattataggaatttgcaaaccatggagttatatgtaaaaatagttattagtgtgtcttttcaaacttttatttcatctcaagaacaaagaacctattatatttactggcttattgaattagcaaagtatttggtagtaaagcagaagccctaaaaattgtgaaaacaataccataaggttcccctgtgttcagttgctaatgatatgtggttgaagtcatggccatggaagttaaaataacagctctggagttatgatcttggacatgttatgtattctctctcatcatcaatgtgattccctcatctgtgcaataaagataatggtagataatccttgtaaacgcatgatttaaaagtaagcattaacttaaaaacatattatttattgtagtgtacagaatataataactactcaatatatattaataattattatcacagaatgcggacacactattcaaaaaaaaggtgggagatttgtgttatgataaaaaaattaagctaaaaatctaaacactaaaaaaaccctattactgaaaatcaagtaactctttgcgattaggcatacacacacactcacatacacatttataaaacttggcatgtggacacacacaacaaggatcaggaattcacatgacttgttaagctcaattaaacaaaaaacaaacaatatttttgtgctctagagttaactttgtgttactttttagaagaattttctgttttttaaacctcatataatatgctagtcatcagcttgtcttttgatagcatgagtattaactatgaaatggttataaattgctatgcagaatgaacagctgtgagaaataataaatgattctgttatcacaactagagtattagatggcatatttagaattatatataaatgggattattatacaaaatagtggaaaagtcttaaaattaactatttgacttctatgggggcttttacataaacttactgatttaacttcagaaaaatgtgactctgtgtttcaaaaaggtatattaagaaatgccatgtatgatatttcagtaatacaaattatgagaaaatgcacttcttgtctctatttggtttctttgaacttatgccaaatcttctccaatattttcttggaaagctttattgtgatgaactatgtggagacagttttaaaaataaatgttgattttcatcatatgtgaaaggtggaaagagaggaggtggaaacagaggaattataatgtttgaagcctattcttttaccatagtaccacaacagatttaatatatggggtgttaaatcaggcaggaaaacatttctcaagaaagaccccctccaaatacttgaggttatttaggaatatttgtcatggtattatttgcatttgtaaccaatagaataagaaacatttgaacatctctaactgaaatagtctggcaagaacacaaatatagaatgataatgcactaaaacatgatttcaaatttgtattgaaatataaaataattaataatagcatccattttaagatgcaatccaggcatcttaataactaatgtatgtacattatcactctaattttcatgaaaatcttaggacttatgtattataacatccccatattgtagatgaagaaactgggattcatagagattagtgggccgcctgtagtcacatagtggttagaattcaaacatgattttccaattctaaaacttgaagtctgaaccaccatgatatgctgacttctcgtgtaatcagagcaattagggccaagtctctttttggtggtgtttcgttgtggtggcggtggtgatttatttccttaatttttttggttttgttttttgtttttctttttaaagaaaaaccattatatggaaaaaggcagacaattcttagttctactaaattaggataaattattatttttagtaatacctaacaattttattttcttccccttggtgaacacacacacacacacacacacacacacacatacacaccatcctaacaagtatgtacacatatatacacatgcatttgagatactttagttattcaaatgtaactaaaactctttaagtaaagctctgtggtttgtcctttatctttgctcctattttacatgtataatcattgcagactcaacttcaagtttatcctcttcattttatatgtgaatccgatctcttggtaagataaaacaaaattatatctagtatatctcttgcatataatgtttaaaagccagcacatatgttctcattgatcttgtccactacgaacaacacagagaatcttaaaaggagaacactatcaataatatttgtagagttttgctttgtgatattgtgatattttaggcaatcttgtaaagagcacagcagctcaacaatattataaagacctagaatatctttaaagtctttacaactttcttggtcattggcttaaaattagagaaaccaacatgggcatcctttctgactctggagcagacaggcccagagcgtgctcaagactacagtttacttaggactacaaacgaattaagcaataggaatggagatgagctctagtgtggcaacatccagcaaagggcagagtaaacctagacatcaaggttaacgcaaaattagcagctttaccaaagtgagcagacaacaaggaaacagaaatactgtactgagaagttgggcacaggggaaacctgaatccaaggcaaaatcacagggcaagggtttcctgctgaaggaacaaaattttacatgaatcaaggacgtagtattcaaactttctacatctcatttaatgttgttttaagatctctgtggggcaggaaacaaagagtggatgctactggaaactagaaattagccatacttgactggaatgtaaaaacaaacaaacgaatgttagcagcaacttttattgacaaaagtatgaccaacacatggccattctgtaggttaggctggaagtttatctaaactttaatggtacctacagatgaaataagactttggactcaacctagaaactgttaggccccttttaatttccatcttggattttccctagtagtatgtgtctgtgtgtcgtgtgtgtgtgtgtgtgtgtgtgtgtgtgtatctgtgtgtgtgtgtgtctgtgtaagatgctataacaggctaattttacttgttaggtaagttatattcccctgcaaacaactgaaatgaaaatcatttctttgttgattcctggaattgtattaacttttgacaagtttgttagttccttgaagtccactttgtcaatgcaaatagactttggaggggagcactctacttggcctaacactgaaatctgagtctgtcttctctctttcttcaaaaacttgagagttgagtcaatctgaaagctcagattcttgaagggacctggagacacttaagggggaagaggtacagagaggagaacagggatatccatagataagtttaatttccatttataatttagcactagaaacataatttggttgtttacagcctttaataacacaccttaaaaaaaaaactctgtttcatcatcatagtttcaaaagcccattttttctctcaaaatctacatataagttttattttatattatttgtttcaatatcaggttaagttttaaggacataaaaataatattatagtaatatttggaagaaaatttgattaagaaatattagttatgaacaaaatgcaatttcttaaggagaccaattacaggtcttaccagttgaggaaaactacctggaaaaatgtcattttggccttttaaaaaatatgttcaagtgcatgtaattttcttgttattaaagttgaatagcaatagatgcctaaccagtacaaaggcttcccttttgccttgcaaacatttgaagcaaacctgtttcagactaaatcctctcctatgaagaggtaaagcttagtttaacaaagtatgaacttaattgggcccagttttctcatgtgtaaattgaggagtatggagtaaaaagtcaataaatttatttatcttgaagacattttacagatgcttctgatgaacatttattgtcatggaaagtaagacaatttgtccttaatagcacttatcacaaaggttttgaaaactttttcagcttaagcatactctgctatattaacaattaccattaaaattaacatttactatggtgcaacgaaaagggtaatcttcatgttttccagctcatataatagcttatatacatatatatatacatacacacacgtacatacacacacaaacacacatatacatagctcatatatatatatatatatatatatatatatatatatatatgctattatatgagctggaaaacatgaaatatatatatagcacaaagaattaataaaacctgttatataatatttgggatttagcaaccagaattgacccaacatttctattttggggagtttgtcctatggctatattaacacacatacagaagattctataatgcacttatggatgttatagccaaaaactggaaatgaattaaagatttattaaaatgcaatgccttaataaggatataatgaggtagatctattaatgcagcatgtgctaatgtataaaaacctcatgacacatcactaagtgagaaacacaaggtgaaaacacacaactacattgcaatccattttgtaaataaaaataatttgaaaaatttttacacatacatgacagatatatgcctatatgctccatctacatacaatattttactgaacagctatgcagttagcagtagctccccaaattcacacaaattgcctttggggaaagttaatgtgactggatggttttctctacgtttattaagagttttggccaggtgcagtggctcacacctgtactctcagcactttgggaggccgacgtgggccgatcatgaggtcaggaaatcgagaccatcctggctaacacggtgaaaccccgtctctactaaaaagacaaaaaattagccaggtgtggtggcgggcacctgtagtcccagctacttgggaggctgaggcaggagaatggcgtgaacctgggaggcagagcttgcagtgagccgagatcacaccactgcactccatccagcctggacaacaaagcaagattccatctcaaaaaaaaaaaaaaaaaaagagttgtaaataaaatttgtgtcttacttatggtttgaggccagtgtaacctttataacagtgtcagaaaaagagagaaaaagaaattgaactgtaggtcagtttatagatacaaaaatcccaaataaaattttattttgtttaaattttataagtaaaatttaatccaaactaaaaatgtgctaaaaatgatatgccatcccaagtagggattttactagatataaaaggataatgacaaaaggatattgatcgaatactcaatctaatccatcacattcattgtataaaagaaaaaaaataatgtgattatctcaatagatgcagaaataataactgataaagattagtcactattgatgttacaaataaaaacttcataaagatagtaatggaagggaagataattctttgtggtagcaaagaattgaaagcaaccaaattatgcgttaataatgttgtgatctgtgcaagccaaacacaaggaaccaaaatttatatacaggaaaataggcaagcatgaaagggatgtacaccataagacttcttatgtgaaaataacacataaacagcagcatgtattttgctaggccaaatacatacatttctatgtcagatgattacaaggaccaaaagtaaatacattaaagaggtccccatgggcaaaatcagattaacactgagatgggttaaaagagggaaaaactaacctaaactaaacaaaaaaggagctttgtcttaaccaatgatgatataatgtcatgaactgacaagtatgatcagagagattctatgaagtagcatatattatataatcagcatggtctctactatataaccaacaaaaacaaaatctatttgtttttggactaagtgtggagtaaatagaaaaggtaagggcatagcaaaggggccatgcacagaagcccaaattcctgttctactacttacctcttctgtaacttcaagataatcacttagcacaccacagcttggattccttaatctgcaaaatgggacaatcctatttacctcccttggttttgtgtagaatcaatgtgataatacatgcctggagaaaagcataaagccccagcatacagtaggtgttctaacaaatatgtgctctctccatccctgcactcccaggtccactatacaggcccctcatagttaatagtcttcctgtgggaaggaattcataggaaagactgcagctactcctacacatattataacccttacacttactgaacttttcagacaatcttgcatttttcaggcctatcttaaattacagaacatatgataatgctacttatgatccctaatagggctaatcaaaaaggggaaaaaggcagaaatattatatgcaaagaattacagattagcttgttcagtctgcacaaacttgtaagtaagaaacaattggttgtgccataacaagaacccaataaatgttgacataatttcacttcagttttacagacttagttattacattatcatctctatattttttataattaataggactgctattttctttcataattggtgcatttattgagatatttcccactgttagactgatgtgtttcatcctctatacgtttgccctgctgtgtccccacagttatgatgctccaaatttatagagtttagatgtttcttgctgttggtttacattcctattcactatttattcataaaataaggcggagagggttctatgttgaaatgaacttttacacagaaaattagcaatcatgttctcagaacaactacttagtttttgataccattcacagattctaacttcgcatatgtaatactgcctaatgtcacaaatgggtctcatttctacaaaacgttaactatatgagaaagttgaaggaatggctcatcagaagacaattcaggtttataaagcttaagtgatattccagtcctatgacagtctgtgtttattaaggagtaagaatattgcattccactattgagactctgatgagtatcatggctttagcacagggtataacaaatcaaggttcttttgtttttttaattatggcgaagatgcaatgagaattacgatttgactaagttggactgtgactgctacaaccattacatggtgcccagtgtgccttagaaaatagaggtgtcatgaatttattttctctttcaatgcctgatgggaaaacgtgctactcagctaaagaactgcagtaggaataatgatcattcaagatgtcttcaaactgagctacagatatttaatttaaaagcacattgcctgttttgagagtcagtatttccttctgaaaagaaatatcattaaagcatagtgatgttaggaacttagggattttaaaatcatcattttccttgaaaacctggctgaataaaatattgaatcttggtatggagcatcaagtccttttacaatgtttttctctgaacagagagtttattatcatcccccctgagggcaggcaggaagaataaagccaacattctgctttactttgttggatctgatgagatcttgctagcttcctagatctcactttgggatgtaaaatggtacttccggactacccactaatctcagtttgttgttatttttggttagttggttggttttgtttttctcctctcactgcttagatttttatatgtcttaattatagttgtgaacacagatgaaaatagtataatttaaatcgacttaagtgtcttgcttttataacagtgatgcttgatttttgtgtttgttttccattgttctaattttcttttagggcccttcttttacctggtagccaggtatgacaaaacatcatatttgatctataatacaacactattagaactagaaggaccctacacacctcgtcaaagtccttcatttcacagacgagggccagcacccagagaagggaaatgacttgcgtaggccactgcggctacttagtggcagactcacgttcagaaatctttgtcttgctaaagggttcttgctacaactcttgctaaagatttctttttcctccacatcaaacttcctttgttctattctcaacttatataatgacgtttgaacagatctagcaacaaactctttatgtggacttccctgacttgctggttgatgacttcaaatgtttgacagtgcacatgacaatataatttatcctatgactgcaaagatgacatcttgtgaatactgcttgattcctccacaaaatcatccctgaaaggcttgtaggtgtctatagatccacagattccatagtgttcctttgaaataactgaaaatgtcattctcgctgttagttaaagacaaatgccagatatggtaacacagttataagtgctaattatgttattaataattttatccttttttcctctcaccactgtgctgtttctcacatgctgatctgtccatcctgttttgctattctaggtttgtgtgctggagaggcaaatatttgacttccttggatatcagtgggcacctatcctggcaaattttgtacatattattatcgtcattcttggtttgtttggaactattcaatatagacctcgttacataacaggagtaagtacattttctgccttttaaaaatcttattgaactagagaatgatgtgcaaactccaaatgccttgaaaacttatgtgtataatctatcttaaagatgtggatactctcttttaagtaccatgtgtttattttcatagtttcagattccatcaacagtaattgaaaatgtcaggtttaaggcacttgatagtgagtgtgatcagactgaattctcataatttgtactttcagcgaatagtctcataattacaagccaaactgtgtttctatgtttctacattataaagtcatgctttctggtttgacagattttaatggaaattttttctcattttaaataatcatattttatacattgaataaagagtttaaaatcaataggaatgaacatatactattgatgtgaaaatattaaccacattagggctaatatttggcgtatgagaaagccagaataatctggacagttgcctctgtgttctccataattctctttttggcttgaaggaagtattttgcattcccactcaagttaaacttacttaacataaaagtgaaatccaactgtgtttcagttactatgggaaccataactcagggttgcttttttttaaacttttgtatgtgcctcagatctcagctactgctcttcattaatgtacatttttttctttttagtttcatcattttttctatttcttctatttttgacaaaggaaatgtctataggcatttatttaaaattgtaaagcaggtttgtagtaaaagcatgtatataagatagtaccgtgaaagctctgccttgttcaacacaaaccagcagcccttctcatgttttatgaaagcgtcctcattaaagatgcccccccatgacctgttctctccatcatctagaacccagataaagctcattggtacagccaggcaatgtggtggtggctggaaccaaggaagaatgagaagcccacagtcctcgcctccaggtgcatgcccagcctccagtgcatgtcactgcagaggctaggtagccatctaaatcttgtaaaagtgggaggagttctgttgcagggtgaagttttttaatgcacaagatatgatagtattgtccattttcttttatgaatcgtaatttgatacagtgtagggcgggttgtacagtggttgagagtgagtcctctgaagtcataatatcaagattggaatcttcgatctgccaaattctgtgtgactttagataacttcacctcaccaatctttaattttcttatctttaaaatgaaagtagtcattacattaactcataatgatttaattaattgatatatattagccattatatgaaaaaaatttaacttaccattctttttttattagactttgaggttccttcatggttttattcttataaataatggttgctctgaatatcattatgtaaatatttcatctttatttctgataaagttcttgggataaaatctagatgtgacccaaaatatttgaactatttaaaaactcagaggttaattttgaggactaaaggggatgttctatgaaaagtccctagcaccgtgcttgatatttaaaaagcccccaataaatattagctataatatttttgtttttaattattattatttaaaaataatactaacctgtgtaacatagcaataggctgaaaggaaatttaaaatagagcaaggtgttctagatgttggatgaactatttctgtcccttttatcctaagatgctacaatgcaaaaaaaaaaaatttgggctttctatgtatcaaattattatctcatccttttgaataaagacgtaccacagatctttcactactggctactttctctggcatgggataagagttatgatgccaagggaaaacacctttaacattgttagaagttttgttttctgaggctattagacacaacctgaactctttttaaggtcttaacaatgaatttcagagccttgatttcatcttgactggtaacatcactgtgcatttggatttttccctgagacaatgtctttggaaatcttttgccggctggagatgatgtaaatgataaacttttttttccaactcagcaagtcctgggttagaaatatatcctctaaattctgcttgaaaatctttctttagctcatttctctcttacaatatcatgctgtctgtggctaaaagataacaaatagcactgtcatcttttttttgcttggaaatccccttaaccagacccataaactcataggcatattttctatctttccagttattgaagacaatagctaagataattgttctggcagtaaattccatgagtcttcttttctccagtcctcaaaaacaatttcctctctccactcagagtctccttgctgccctcctggtgtcatttgcctccttatctcaaaaccagtactgtgtgttttaggtttaagtatcactgactttctggtaccaatatctgttcaggtatctatgtctgtgtaacttctgtgcaacaaactacagttgacccttgaacagtgtgaggattaagggcaccaaaccccccacacagccaaaaatctgcttataactttctactcctcaaaaacttaactccaatagcctactattggttgaaaaccttactgataaacagttgattaacacatatttaatatgttttatgtgttatatgctgtattcttgcaatagtgcaagctaaagaaaagaaaatgttattaaaggaaatcataaggaaaatatatttattattgattaaatggaaaaggatcattgtaaaggtcttcatcctctagcaatgtagacctttataatttttatatttgccatattttctctgtaatatttttacattataaaatagcttgacataaaatataaaataatttgatacaaaaataagaaagcatttctcgacttcatgactgaagattaacattttgcgtatttcctttgtgtacatacaaatgaaacatgtctgtgtatgctatatatccaagtatgtcttaattttaaattgaacattatatcaaacaatttaaaaattaacatgactatttcattgtttctttaagcctttaatgttatacattatgctattttcatatttttctattatattaaataattccctataatcatttccaacaaaaatactctcgtctttttttgtgaatcattccttaggagaaatacctaggtataatcaaataatatgaacaattttaaggcttttactatataattaataataacctatccaaaattattttactgaattatcctcttaccagtgtacagcagagttgatttcactgcactcttgctaaccctgtgtattatctgttctcatagttgttaatttgatagaagaaaaaatgttattttcatttttaattgtatttctaatcgtagtgagttagaatttttcgtatgttcattacccatttttgttttctgtttggaaaattgtgtgtgtgtgtgtgtgtgtgtgtgtgtgtgcgcgcgcgtgtgtgtgtgtgtgtgtgagataagtttcgttcttgctgcccaggctggagtgcaatggtacggtctccgctcactgcaaactccacctcccaggttcaagcaattctcctgcctcagcctcccaagtagctgggactacaggcgtgtgccatcatgcccggctcatttttgtattttttcagtagagacgaggtttcaccatgttagccaggctggtctcgaactcctgacctcatgatccgcccaccttggcctcccaaagtgctgagattacaggtgtaagccattgtgcccggccagggatttgtcttttggtcttctttgctaattttttaccctgcagtcttagtgtttatcttaatttatgtagataatttaataaagacatttacctttaaaacatcataaagcttccttttgatacttagtatgtctatcttattacagttaactctctttcaacttgtgatattttctgctgcttttaagattatgaaattcaaataccattttgaaaaagataagtcttcattatccttatgtctaattttaccaaaacaaaaaggcaggttttctgatattgagactgagggcatttgctatatttgaagagcttcaaattattgatgggacattttatttaattgatcttgcctcccacacaaaaaagtatgtggacattcttcaaaccattgagcttgtagcaacaaataaatgagagtattggtaatgatttttgttttcttcattcatcttctttttcatagtagcaaagaaaaaaagattaaaaacttaaaacagataattggaacaagaactcattagtgccatagagagcttctgtcactttgcagaatatagtatgctgaaggaaaatgaaatagatgttttcaggtccaagcaaaggaaacctgaagccagaattcatagaaagaatcaatcttgtatctcaatcacatcaaatcccagaaaataattcataaataaatatatacaatggctcccaggaaagcattattttacatcataaatggaattatataatgcatcatcatttggggaagtagaatgtgatctgagatatccagtgtttataagttaatgataaaataatgttaaggagctgcactggcgctaaggagctgctttagattatctaaaataatctgaggaatatgtaggttcctatccattaaagccatagcaactttctcagtgatattgccaaaaacaaatgttgctgtgtaacatgccaaaaataaattatttctccccccctctccctttcttccttccttctttcctttcttccaaactcagtctccaaactagaaaaaaaaagtttcaaaatagctgaaaatctattactcagattttatagaggatagtatactaaaataacagtaatatttgtaagaataatttcttgtttcttaccaattccatcactgattctcctgtatatctacctttcttcataaattctataaccctcacattaacttgacacaacttttgttcaaactcatatggaaaggaaatagtagagttaggaggttgacacaggttctcctgacaaccagtctgtccttgtaaccaccacagtgaactgcctcttagaggcacagttcagagacccaaatctgtctgataaatgaacaaaggtgctgttaagttgtgggcaaatttaaaattcattacagcatttgtgatttccagaggatttagattttaagttgtggtctgcctctcccatatcaaggattatgtttttaactccttagttaatggagaaataacctcatgtttcaagagtttagaacagaaaactcttagtgatggatattttattcatgcgggaaaacaataacacaaactatctttaatctctagtaacagtgaattagaatggcatgttattctttttctatagcacccagctttttgatggtgattttacatatatgcatatgtacacattcatctatacaatataagttatatctaatatccattataattatatgttaaataaggacaaatgatctatttctacatttgctatttgtaaagagtttcaaataattgatgggagaatttatttctatgtaattgaataaaatactcaaaacatattggaaatacaaaagacctaggaaacaccaatatagacatacatacatacatatcattatgcctaatgaagaatctttctatgacaccaagttagactacaataactaattctaaaatcaaatgaaggagaaatattgggattggtttcctgttttgttactgaaaaagcaagagatgaaattaatgtgtttaaagctgatttgatgaagcaagtcatcaaatgatggttagaaagagaagccaatacacatgaatcttcatttcttgtgttctaagaattgtaaactctaagactgtcataataaccctgcttactcttccaaaataataaaaaagtaaatatttcttttagtctgcattttaaagttttgaatggtattttctgattaatgctgaacactgaacttctgttcaccaatttaggccactttttgttttactacattttttttaacgtgatacatatggtagttggtggctgttggtttctagattgatgtacatcctccttctccccagtgaggcaaggtcagcttcagacaaagtgtcacctgctttgacttccttaactttgctttttctagagccaacatggtaaaggatccccatggcatcctggccaaagcatggggccacagggtgactggagcaccagagacaaagacaggattcattttgtaaaaagattacgacacagcaacttgagaaatctatagacaccttagtggttctgtataagtaaagaatcgcatactcaatttgcatgggggaaaaatcctctaaatttctagaatttactatttgctgataattgccgtgatttgatttttaattgtccatggagctcaggtctccatagagactatcaccaacaacaataaatcaggagcactgtctccattttccaggtcatatgtttttctaaaactaataaatgttacctccctaaaaatttttgcactcctacaagtcatttctaagaagtcattaatctatgttcaagtagttgttttgccacctttattcaatttttctaggagaaaaaaatatctgaaaggaaacttattgcagctaaagcattaacaaatgcatgctttctgtgttgaggacagaaaatcaatgtagattagagatgaagagacttgagatactagtaaattaacaatacttctaatgactttagagtagttgtgaaaataagtcttttcccataagcctggaagggagggagaaaacaaaaaaaaacatcattacaagtttaatggatttagcctgtagtcctaaaataaatgtaataatgcaacattgcaaatgcaatttattctcaaaagaatgtgttcccttggggaaatgtggaccatttattctacaagaagatactttgtgccctcattttggtgttagactatgactaaagatttataggatgtggtacatataaataattacatttgacagtctagattcacttttttaaatcatctaataatttttgaaaatgaattttgaagaaaagatatattgtgatatgtttaagtattagtttctttttctaaaataaaaaaatcagattatgtagtttttttaatcaaaaagtaaaattgggcttataataaaataaaacttcctttccatactcttctccagctgttcctcatctctttatagttcttctggggttacctcagaaatgtgtgtgtgtgtgtgtgtgtgtgtgtgtgtgtgtgtgtgtgcgtctgtgttgctaattgttgatttttcagctttagacagtgtctaataacgacctgccccaaatcatttggtctaatttgtttttgaattatacgttgtttttacaggttttctttcccctctgaagtttctgattgctttttttttttttgtaagaaacaaaacaggccttgcttaagtgtatcctaaatacatttccaattcatgtgcattctattgcttgatattcattctgttttaattcttgaaatccactgctttactatttgaattatccagtccgtttatatttgaccatcactatctgtagctttttgtttttaatgcaatgttcttcttccctggagatttctcttagtactcttgtcattttactccgatgtcaactgtttgttctcaagccctattatacatctatctctcccttcttctgatttgattcatgctttcttaaattccatctattatctctttgatattctacaaacaacttcctgaaaagcatgtttgtgagagaaactttctgagttttatctgtctcatgacagagaatgactttattctacctttacacttgagtactagtttggccaggtgcagaattcagggttgaaaatcatttttttcttagaacactgaagtaattgttcacaatctaagaagcagtgttactgatggccagtctgatatcaatctgtaaataactttcaaagaactgcttgagatattcattttattattgttttggcatttcaaaatggcgtgtctaaatgtgaacctatttaaaaattgtgtagtcttttttttattatttaaacacttatagaagactttgttgtggctcagaaaatcatattcaatgtatggcaattttgaatgaaaagagtagcctcaaggtctctctgaccttccttcatcctctgtctctagatcctctctttcccaaagcaccaggagtccctttctctgaagttcacttgtctaactgaggtaagttcttccaaaagaaatgcaattgtcttgaaacccctccgcaggaatctcatcaagcagccagggaagattaatcactggagaggagattaaatgtcatccgcatacccagacagcctatcacttattcttctggaggctgctctgagaagctttatctgcataatacgacaacctttgttcatcttgtggttcttccttttttctctcccttaacttttctccacctcccctgaaagccctcaagcccctattcctttatggtataaaaactcaaccatctggctcctcctttgagttttatattttctgtgagtctcatgagcttaaataatgagtatgccttgtctcctgtttatctattgtcagtttatttcagcagactcagttgtcaaaccttcagagggaaagtttgaacctccctacaccttcaattctggaatttgcatgcatcattttgatgattcttgatgcttttcaacatttgcctttgctatgctatccccaggtaatttcatttaacagttattttatattatagtttttaatttatttatgaaaaatctccttgttttccccagagaaataaactcctggctgattctaaaagtggtagagggttattgctgttttccagcccactttacacactgacctttggtcatatgtttcttacccaagtctccagagcatgcaaaattctccctagcagtccagcatttttttgtctctttctcctccatacatattatagactggcaattgcttcattctgcttattaatcaatatccatctctttgtcttcctcttcaggcaattggttgaaatctctttgttgctaatgttttattactaatagttgtaggactatatttgttgtatgctcagtttgcctttttgaaccaaaagtgtaacaataactattagattgcattaagtatgttttactttggtgtaatttcctttttaacaatgagagctgagcagatgacttttttttttttttgagacagagtgagactctatggggaaggcaaccccataggtttcagcctcattttacccagctcctgttcaagatggatttgctctggtttaaaggccttttacattgatacattgatacttatcaaaagttcaattaagaaaaatgatatttatggagaattgcttacaagataagaggttcatgcattctgccagaccctaatgtatcctaggcagactctcatccctatactgtgtcagtttaatgttggcagtgtgttttaatttatttttttactactgtaatgtattttattaatgttattaaactacattgactgattttataagaaacacactcatgacacttatttatttattaggaagatttagttgaaagtattgctttaaataggtgcacaagaaaaacaatctaccccttgtctcaatcctgaaactagtgatactttccttgtgcattaggttgatctaatggcaatagcaaaaatctcagtcaacttcctgaatttaaatgagaagactttttagcagtctgcttactgtgttatagctattagtattcagtaaatggtctttactatatttaagtagtttccttcaattattaagaatagctaataatattttattacatatctttgaagctgtatgctaatatctctttaaaatttttggatgcattgaattagattaataagtgttctgatattaatttaactttccattactagactataccttatttgtttgtaatatgttattcttttttttgattgctatattcaacttttactatttttaattacttttttgcatccttattaaaaatgcaattaatttatagctttttacttgtaatatttttaaaattatgcggccttaagaaaataaattggggaaacttttttctgtggtatagaataattcaaataggattggaactacaaatgttcttagaactaatctatgaaaccatctagtcctgatactttcatgaatggtagctatctaattatctttccaatcttttctacaataattgatcttttcaaattttccacttcttgaatgattttggtgatataaatttcatcagagcatatattttctagagcatttgtttcatgttattgtcatagttttatttcaaattctattgctctttttagaatttctttgatattactgggttggtcttttttctgcatacccttttttgctcatttcatgtattaatatctcgtaagagaaaagtgacgacagataatatcaaaacacctcatttctgcttttttctattttctctcattccaagataatgggaagaggcaagtaggcaccatttccaggatatttgctaatttttatggcaatgagtgtagcaaactgataatgtgaatcaatgaattgtttttagtttagagtttcttagtataatgtcttagtcttttttgtgttgctatagcacactacctgagattggatgatttgcttatttatttattttaaaaaatgtttattttagctcaacgtactagaggctgggaagtccatgatagggtggctgtgtctggttagctactggtgagaacccagttctgtgtcataaatggcggagaagtagaaggggaactgggagcatgtgagaggagcaaaataggaggggcagcctcactttataacaatctgctctagtagtaactcatccagtacccagcgagtgagaacttacttattcccttgagaattaacccagttccgtaagagcagcattgatccctctcaatgacctaatcaccttggatagacccaacctaccaatatccattcatagcacacagtctgtttgtcaaataataattataaacaattatttttaaaggttttgactgcaaaagggtttcagcttcatgttaattctgaaattgattaaagactttcattgaccacaccagcaaaactgacactgcataaagaaagtctttggtagctgtaattactacaaaaccccttttgtataatattctttatagtatttatttccaaataaatctttccttgcaagtatataagcaatactctgaagctgacccttcagaggttttatgaattgttttatttgccagatgctttgtgattgcccagctgactctttaaggaaatagttgtcattttcctggtcatctctgtgttgtatttgtagatgtcttgtcagtggtttttggaaatgttgactcatctgggaactccatgcccagtaagatgttatctacaccccacagctaaacttctgtttgactagacctgtcattttctgaaacacagcggaatccatttttttcttcatatttttttcttttaaagataccagttatgtttatggaattttgtaaaagaaatgtttggctgcaagtattaagctcattttatctacaattcatttttatgggagtgtcatgcacttaaaatttaatatgtgtgtacacaaagatttcccttggaagtgaagcgactaccatattatagtacagtaaaattggaattatgagatgtcttattttaattctcttcttgttttgaaaggttagtgtttgatggggagtttctgtgcttacatttacacttaaagttacattttcagagtagtttgtacctaagaatttatcatggagcaaaactataatttggcatagttttcattctatcttctaaaacctttgtgtcgttttccttctccttgttcttttcttcttcttactattatcattctatttttcttcttttaatgcaataaatttagtcaaaggcatgagaagctctgtgaacacgttgagaggtttgtagcatagtgttgtttagctgacaatttagtaaaactaagacaaacagccccatagctgcaggttagtctagaataatggcttgaacctgctttttattattgcttatttatatcatatagaataaatgctgacactggctgctgtgaggagaagaaactcaccgattaggaaggagattaaaaaacataagccagtttgcaaaatcctaattttatttaaggagaaattagtatcatttgtaatctctgctatgccctactactattgatgcattagggttgaaagtgaatggatttcaataagccagacagaacatttctttcagatatcggatatcaaaacaattctcagggcacaatataattgttttctgaactaaaacatctataatgctcctggaaatgttttcaaaaattgtatttcttttaaccaactcaacttcccaatctgaactcccctttactcttctccataaaatactaaaaataaatgagacttcagggaacatatgccaatttgtcaatctggtgataccttttttcttgtaaccattgctacatccttcattatagtaaaaaagactatctcaatgaataacatcactgtttatgtataaagaacagcataattctatttttaaaattataaatttaaaaaattgtaactcttctcttttctttaaataatgtataattcctccacaattgcattctctttcacattcaccaccttggatgcaaatttcttcatggttaagcctctactcagctttcacttctccttgtatattagagtataatgaacacagtttttctatgctagtttgctttgagttataataggatatgtacagaataaaagtataaaattgaggtttataaagcaagaaatgatggcctaaatggagttgctagaggaaaaaattctcagttatgttttatttcaaaacatctttgatgaccttattcgatagttatggaaattattttacataactgcttctaatattttccccatcttatcattttatgtagctaggtatatgcaaataaatgtccaagcagaaatcattataatttcatttacaagaatgtttatgagttcagatattcttttgaaacatgcaataatttcataaaatgaggtatgtaaaacttatatacttaaagattgcattgaaaaccagattatagatgttggagaatggtgtacaaaacattcttgaaagataaaagaacatagactccatacaaggaaccacatcaaaattcctattatttccatgttttcaagtgtgatctgtggataagttatggggcagtgaagtagttttaaattaatttcaaattttcccagagatattaggagcaattaaaatcaaggaaataggaattgtttaggataaaagcattcaattaagacccagaacctttactgggcttcttgatgtgcctgcttctttagtgttgtacatcacacacggacacacataaaaaaagtagtgcctatttaggcacaaagtccttcagcatgtgttttggactagatcagtcaaaccagcactaagacactgaagcagcttccttctctcagatgcctgtacagtctgcagaaccatgagcattttctctctcataaatgatacacagctttcactatacaacgattaaaaccagataataagaattaccatgatgactagtatgtcataaaattatgaaaactgttatacatactgttgatccttgaacaacataggggttagggatgctgacccacacacagtcaaaaatctgcatataagttttgactcccccaaatcttaactactaatagtctattatttattggaagccttactgataacataaacaatggattaattaaaacatttcatttctgatatgtgttatatactgtattcttacaacaaatcaagctagagaaaagaaaatattaagaaaataataagaacagaaaacatatttactattatgtaaaagtggatcattataaagatctttatgttcatcatcttcatgttgagtaggctgaagaaaagaagggttggtcttggtgtctcaggagtggcagaggcagaaaaggtggaaactggcccccctgccccgtgtggctctcaggtgggctgcagcaccatactgctcttccttcctctccctggatcataccacccttctagtcagttctgatggagaacctggttaccttggttgctggtgaaggattcacatgcttattattgttcttttccttgagagcctcagaactgagctgtttccgagtcggccatcttggccccgccccctgtcagtaatttttaaagccatggctttctccgtgtttttatgtggaacaaaatcgggcatttggcaagaaaccaccagttgttcataatttaaatcatttcttctctaaaaccctcaaaatttcataagaagttgaggtcccagaatctgaggctaaaaacctgactctatcaatgaaatgtgttaatgcatctgcttttatacaagtcagataaactctttactttggtttcttcttcacatcagttatcagttgtgagtatggaatgaaaggttaatataaaatattgagcatgtgtcttgcataagtagactctcaaatgttatctattatgttaataactttcacttctttgtctatttcaacatgatccttggccatgttttactgaaactcaatagcaataacacctcatctaggagtcaaaatatttctgaactaagagataaaaaaaattactgaaatatttttctgaatagggtttcaatactcttttagcagaacttttttttaatgttttttatgtattgccttctcacaaatctctataaccatgttttgtgtagcaatatacctgttttcttctttatctctttctatttttaatgtttccattatgattttcaactttcatggttcagcagaaaaaagtccactactttttcaaaccttacttgttgtcatgattcgaattactaggaatgaaacattttcaatctgacactgaaaatcaagataaatatcatgtgtggtgagaaactgctgcgctaaagatgttccaaaatgtccattgttcactatttccataatttacctgtcaacagctctatttatttgggattatttttgtgggttattgtctacactcaggcatagatgataatgccacacacattcatctgggataaacagaactataaataatatataattttaaatatagaatgataaagatcccagaaaagcagtttcttgccttctgtgaactcagcagataatgcatgaattggtaatgcttggaaggagagaagaccccccgtgtctattatcagtggggatgctatcattaaaccactttagaacagcacagcaaatggtttcatgtaagggctgctacaggacttgagtgaagccctcagagaacagtgtgattttagcctgcctagggctaatgatgtatcaaggatctctccacagtaaccatgtgtggcagcttgtggataggctttgtccttagtaaagaaataatcttacatttaatgactaagcattttaatccacttaaatgtttttagatcaaattgattcttgaggcatgggaattcactgccctggcaggcagaaagagacactgatgctctgttacatctggaaaatgcctgtagggagtctactgctactcagagaatccaaggcttctttctgaaggacaagaagagaaagaagcagcagccacagcagcagaaacagcagcagtgtaagagatatcagaatatcagtgcttagaagacacatatgaggaaactgcagaaacaaaattgtaataaacataatttctaaaattcactttggaaatcacttagatttatacgaattgcctatcacttctaatttggagactgaaactgatagaaactcaggacttttagaatgttactggactctagagtttgtttttccactgagatatatttttcctacattttctccaaatcggatcattgctctaaatagaaaaatgattttttttaaagagtggtattaccaaatgtagcctttccttgacgattcatgatgtaaattgttgttattgcaataaggaagataaaaacatttatttgacatgataaaaaaatgttgtttctatgtcttaaaaataacatcgtcatagatattagtatgcatatatgcaaaattccatgatttttcttcaaatttttcccctgaagtatacattaccccttcttttctagttctacttctgttttctattatcctatatttttctattctgaataagtacaaaagttaattagactgaatttaattgttcactgaatgttgcctacgaaaatgtatggaaatgttcaatttaaaagtgtaacttaacaatgaagattacaacaatgaagtgttgtactttgtcgaataatctatttcacatttctttcccagtatgtgcgatgtttcacattatttcacatggtagagaggattcaaaacttgttctgttgttactgtgtgtatgactggcatatctcaaatcagctttccagaggcagagttgggtgacccagcatcacctggaaatgtcaccaacaaatgttggcaggatggttgagagagagaatatttaaaattctttccaacccccaattcctctttacatggttgatctgtgtccccacccaaatctcatcttgaattgtaataatccccatgtgtcaagtgggggggccaggtggagataattgaatcatggaggtcatttcccctatactgtcctcatagtagtgaataagtctcaaagatttcatggttttaaaaatgggagtattcctgcacaagctgtctctttgcctgctgccacccatgtaacacatgacttgctcctcattgtcttctgtcatgattgtgagacctccccagccatgtggaactgtgagtcaattaaacctcttcccagtattaattacccagtctcaggtgtgtctttactagcagcctgacaatagactaatatagtaaattggtaccagtaaagtgggatgctgctgtagagataccagaaaatgtggaagtgactttggaacagggtaacgggcagagtttggaacagttcagaagtctcagaagaagataagaaaatgtgggaatgtttggaacttccttgagacttgttgaatggctttgatcaaagtactgacagttttatggaccataaggtccaggccgaggtggtctcagatggagaggaggagcttgttgggaactggagcaaaggtaactcttgttatgctttagcaaagacaccactggcattttgcccctgccctagagatctgtgaaacttttaaattgaaagagatgatttagggtatctggcagaagaaatttctaggtgtcaaagtgttcaagagaaagaagagcataaaaatttgaaaaatttgcagcctgatattgcagtgggaaagaaaaacccattttctgggtataaattcaagcctgctgcagaaatttgcataagtaacaaggagccaaatgctaatcaccaagacaaagcagaaaatgtctccagggcatgtcagagaactttgcagcagcccctcccatcacagggtcagaggcctcagaggcaaaaatggtttcctggcccagtccagggcccctctcctgtgtgccacctagggacttgctgccctacatcctagtcactctagctgtggctaaaaggggccaaggtacagctcgggccatggcttcagagggtgcaagccccaagccttggcagcttccatggggtgttgagcctacgggtgcacagaagtaaagaattgaggttcaggaactgctgcctagatttcagaggatgtatggaaatgcctggatgtccaggtagaggtgtcctgcaggcgcagaaccctcgtggggaacctctgctagggcagtgcagaagggaaatgtgtggtggaagcccctacattgtccccactggggcactgcctagtggagctgtgagaagaaggccaccatcctccagaccccacaatggtagacccactgacagcttgcactgtgtacctggaaaagctgcagacactcaacaccagcccctgaaagcggctaggagggctgctgtaccctgcaaagccacagggtcagagctgcccaagaatgagaacccacctattgtatcagtatgacctggatgtgagatatggagtcaaaggaaatcattttggagctttcagatttgactgcctcattggatttcagacttgcatggggcctgtagccccttcattttggccaatttctttcatttggaatgggcatatttacccaatgcccataagcccattttacctaacttgcttttgattttacaggctcataggcagaagggacttgcattgcctcagatgagactttggactgtggacttttgagttaatgctgaaatgagttaacactttggggcaatgttggttttgaaatatgagaacctgagttttgggaggggctggggtggaatgatatggtttagctgtgtcccgacccaaatctcaccttgaattgtaataatcccccatgtcaagggtggggccaggcagagataactgaatcatgggggccacttcccccatactgttctggtggtagtgaataagtctcacaagatctgacgtttttataatgggagttcccctgcacaagctctcttgcctgctgtcatgtaagaggtgactttgctcctccttcaccttctgacttgattatgaggcctcccggccatgtgaaactgtgagtcagttaaacctctttcctttataaattactcactcacaggtatgtctttattagctgtgtgagaacagactaatagagtaatctgattcttagatttctaggtatcaaatggtttttacaagtattgaaagttttcctccatgacacagactatccattttaagtattacaataaagactttcttgttaatcattcctcagttataatattgtttttataatttttgagtatgctaatatgtcaaaatgggtaatgttttttaaatttttttatctggaggatggtcattttatttaaactaagctatcctatctttgatttttgcatattaagtttcttatattatcttcaggtgaaaactaattaaagcaaaacagaaataaataattatctgccatgttccaggcactttggtatgtaaaaggtatgcaatatataaaatattatcttcaaagggttcacacaacaaataaatagtaagcttgtgtacattattggaaaaaaaaacttagaagaaacatccatgtctgactcatgaattaatgaagacactgtagagaagataaaatttgggctgaaaccaagaatacatggtatattcccaggcagaaaacaatctaagaaaggtatcaaaatatgtagaggcaaagcagcaagaaagagcataccatatttagaagacttcccaggcttctgcacagagtttatgaatgagagcagcaggaatttggaccttttatgtagacatattttggcctgtgaagcaggcatctttggtctgattcaataatttaaaattagatggggtatgtatgtgcatctttcaggagagaggatctattattttgaacactattagagaactttaagatgcacaaaatataaaaaacaacttgtgaagattacagacaaccattggtagtttttaaaatacagaatgatatgattaattttaaatagattttaaacagaaaatcttccatgaaatgaccatatatgcaaagtgacccccaaaattggaaggagccaagaaaccaaagaacatggcaaacaaatccagtttgttggtgatgggtgatttattggggaacttatgtaaagcatagtcttcggcagcagcaaaacaggtagatctctacactgttactcttcagaaccaaggcttactacagggaaagagtttatgtggtctatagagacaagtaaacagaacccttgagaacaggcaagaatgctatgtgtgtcaaaggccgtaatttgtgcaataacattaaggttgctttgatctaaagacagtatttatagtcagtacgtggtcttccactaaggacagtaaatgaatagaagtaaggaagcattgctgggactggcattaatcagaactcaacaaggtgggttagcacccaagatggagttacttttgtctctacagggaagttatatgatcagatataataatcaatctggagacaatataaagggttaataaaaggggagaagcacctgagtctgaaagaaaaattatcagacctgcagtattcccagttaaagatgaagaggacttgaactggtggggcagtaattaaaatggagacaagagagtggattcaagggatatagagatgagtgaatctgaatgatttgttcatgattgcaagggaaaagtatcaaatggaactcaaatattgggcttgggtaaccaaatgagtgaaaatgccatttactgtagtgggtgatgaaaggcaaaccaagttttggcatggagatgatggctttagtttagaaattgcttaatttaaggtgcctattgataacaggttgaaactgccaatcaagcaggaatgtataggaatctggaactcaggaaagtaatattgaatggatactagagacacggtagatttgtttagtcatcagtatttagatcagagtcaggaatagtaaataataattaactcatttccaccttcccatccatgcccatagtgagctttattcattgactgaaacttcttactgagcctaaattttatctggattcttaatattgctctgcatttattaatccgttttcagtcatataatttgacatttgatttaatcctttcctatatgcttgatatagaccataactgaaggcaagaatatgtggtataagaagaagaaaagcatacatatagaggcctagtcaaaaatataaaatgagtgcagaaaaaaacacaaaggagacttaagaagtatagttagagtagaaaaacggctgaaagagtagtgtcatgaaaattaaggaatcatgcatttcagaaataagcgagtagtggtcaatagtagatcaactactcagagagatccacttccttataaaagtctataattggccaggcgtggtggctcatgcctgtaatcccagcactttgggaggccaaggtggggggatcatgaggtcagaagatagagaccattctggccaacatggtgaaaccccatctctactaaaatacaaaaaattagccaggcgtggtggtgtgtgcctgtagtcctggctagtcaggaggctgaggcaggggactcacttaaacccaggaggtggagactgtagtgagccaagatcatgccactgcactccagcctggcgacagaacaagacttgcctccaaaaaaaaaagtctgtaattgccttcaaactaagatataatggataacacaacttacataatgtcaggaattgtagaaagagaaacaagattgctgtaggttaatatggaatccgagatgatgaaggattttggtacacatttaaaaaaattagctacgaaagaatgaaaaatgggtagtggtagctagagggaatgaaaggtatactttgaagaagagtttttcatttttaagattaaaaaattaatctatttaaatatttagagagatattcccatcaataaaaaatgtttacaagtgacgtgattggaactgagctttaagatttctggtattacagtggagaatgtatttgggtagagagatacttaatgtgaggaggccacctcggaggcaatcaaacaagggacaatgaggaaccaaattaggctgtggtcttgagaatgtaaagaagataaattcaaataatatttatggtatctttggcaggacttcacgacttactggatttagagtgtttgaaaaggatatatgttgttgataattctgattttggtggtaggggacagtggctctaattaatacaaggatgccttccttggaggggaagtttgacaaggaaataaataaaatctaatgaataagacacccaaatggagatgttcaaaagtttaggaatgtgagactagagatcaggattaaaaataaaatctgagatactcccggggtcatactttaagccacagtcgtggcaaaagggtggtagactgctgatcttgatacttcattttcactttctatcttatgttcttagctttgctcatcttttagacattttcttgctgttaggcacttatttctggtccatttggttttaattttcaatatactcattgccattttagcaacctcctggccctgctgctgcaaacccatgttctgtacaaataaagctctgctgtctctcattattgtctccctttcttatttcctaattctttcttttcttctttccttcctttcagttatctttggccctctgttttatatttaatttctcccaattgtccttactcttcaagttactagtagatgattcttgtcatcaccctcaccctcacctctccactaactccagattagtttattggatgtttataatcagaatctgcaaggatttgctgaggaaaagcattttgaaatagattattaaatgttttggggattggtatctttttagccttctaatatggtaagttgcttcttgttactaaagagttgataggtaagaaatttaggaaggaggacctttgaaaaataaatgtctgctccatggtgatttccaagttttagttttcataggtccaagaaataccagggaacactgcaatagcctttataacttcaaaaagaaaggtaaagaatgttgtatttttactcctgagtgaatatatatatatctgatatacattagaaaggcagtgtgaatgcaataatcttttcccatctaaaaagcaaaatatggatcttaacttcttatgcataaactagaaatttctggaattttaatgtgttcaagtgttatttcaatccaagcaactgatgattaaagaaaaacaaaatctgtcatgactcagtacttctattgatcaatacagcaagctgcctttgaagtttatatgctgaggtcttaaaagtgcaaatgaaataggtaccagatcactctaatacccagctaagacatatatattcattttcctctcttcttaagtagcatgataaaaaactatttgaagtatacaataaaaaattctgtgcagtgttgccctgctaattgctgtttgagtttgtggatcagaagacaagtcaatcttaatggccattattcagaactgtatgtgacaattctgcttataaggaaagtaacatatatttctatgcaagtaagctaaacaatattaaggcacaatacaatcagccaatatttgctaacctttcattaagaaaacgagcttaaattgaaagctaaatcagtaataatgattattagtgttgcaacttgcatttattacatgcctaacaagtgtcaagagttttacctaaatcatgcctattcttatgttaaatgagttctgttaccacagtgaggaaaaggcccgctcgggaaggtctaacatagaggacctctacaagaaaattgtttttctgacataaatttagtatatatcatagtcaatatgaatgaaattatttctctgataaaaaattatatatgggataggctaaagggcaaatgagttaggtctggctatgcttattttgagatagccaacagatattttaacaattcactagtaaaatgttctggctaaataaaagtgaaaatagataaaatttcttgaacaacatggttgggtcaggatatgtaattaatatgcttatggttaaattatagtttattgtgtatttcttattccacacggtactatcttaagaaacctctggggaggagtggtaggtaggtgaatgggattggatgctattaatggttgtttaacagtttgaaggtttgatgagctcaggttgaaatatttatatttacgagagaagaaaccattaatccatcctgaaaaaatagcttacaatcaataaccatgtgtatcctgtggttgtcactgatggaagtggaaagcttttaatatacataaaggttgacaattacaattgaatttcttgttctttattacatgatccataggaaaatattctcttaaagcaatgtaaattactatatcttggaattatttattaaaatatgacagctttgttgtacttttaaaaaatgaaagcaagagctagcaatctattccaaaataagcatttctcagaaatgttgcaatagtgtttgaaaaattttacaagttttatttggaactaaatatattctttctaattatcagaatttatcatttcaatatataaaatgtgaagtatgataaaaatgtattattaatcctaagtgaaaactgaaagcaactaattccccataactttctttaaaaaaaattttttttattttactttaagttctcagatacatgtgtagaacgtgtaggtttgttacataggtatacatgtaccatggtggtttgctgcacctatcaacctgtcatctaggttttaagccccgcatgcattaggtatttgttctaatgctctccctccctttgccccccaccccgcagcaggccccagtgcctgatgttcccctccctgtaaccatgtgttctcatttttcaacttccacttacgagtgagaacatgcggagtttagttttctgttcctgtgttggtttgctgagaatgatggcttccagcttcatccatgtccctgaaaaggacattaactcattctcttaccattgtattacttggtagaagatttatcaaactccacgactattagttaatttttatatgcctgaagaacaatattatttattttatctgctaaagataagccaagtttacatgagatataaatgtaatcaaaattaatatttagcaaacagatataaacatttaaagctgaaatatttcctgagtagttatttatctgagttgcttttgttttgttttgtttttcttaacagtaaagattgaagtaaaagatgaaggcttattgtgctttagaaagagattcagatccaattatttaatctcggcactttcttgcctactgtatcaaattaaatctatcttctcctcttaagtatattcacccattttatggtgctagttggtacctatttcatttcccttcttaagtatatttacccattttatggtactggttggcacctatttcatttggacatctaaacccattcatagttgggatggtggaaaaatgaatccaagtcccaaatctttcaataaggaaaggatccactaaagttttcctttcaaataccaaaggatttaaaatggtacagttaaacccattgtaacaacacagtctacaatttggagttttaaaagtaaagattattacagaatgataatacctatcgacttggaaaataaaagagactacagaaacaaaccgagaacaggcatccattctattttacctttgaaatttgactcttttgttttgatctggtttgtttctggaaaggagaagtgtattaaatctgaaagatcctgaagctcactcacatactagtgtaacttatagaaagtgcagtggacagggaatttgggagtcctcaaatccaaaccactaattttagatgagttattggaagcttagaaagggtaaatcattccctcaatgctttaaaattggtgtaaaagactcaagcctggaactaattatttgatgttttttcagtcacaacatgctatttgaaggaaatcacaccaaaagcattttctaaattgaaatttttgggggataatttattaacttgagttaatagcaggtctatatctgaaatcaagttgatattctcatgaaaaaatgtaattagaactgtatgttgtagacatttcccttaatgtattagggttttaaatagataaaacctactaatttttaaatttcatgaagacttctatctataatattgacagcttaatttagcatattatttaaataatttattattacttgcaatgtatgtctttatttgtgtcttgattttcaaccaagaaccttacattgtatggcctcaggcaagagaggttttctgggtgtctttgtcatctcaattgtaagtggattgattttgacaatgtgatcctgtagattcatttcagtcacaacagtctgtcagtgcctgggatttttactgggctttttaaatgacactcactagtcatcctagttttattgattttaccccagaatgttaatcaaatggtatcccttctttctaactttcttgctctttttttcttctttcccttctctctccttcacctttaccttttgccagtcttctcaccttcattctcactcttgggacttaagacctcaaacaatagtaaaagaggtaaaattacttagttcagcttatttccatacataggtcagacttgaaatacctgtgtttcacagaaactaagttctttcagataaatggagcttggtgggaatagatgtcccgaaatgtttatcataaaagcacacaactgatgaaatactaaaatgagatcaaaccacgaagaaaaatgaagaaaaatgcattgaaaagcacatagctgttttagtattgttaacatgggaatagaagatgatatatatagttatgttagtactttcatttatgtagatttttttttgtaattttatttttattatttgtgcagctgcattataagtgccttgtattgccatgcctgcatagaatggtattgctgacacatcattagtaataagagattttcattccttaagacaaagactttaatgatctttctgaaatcatagttagaaagttaatatttgaaatgcattacatgttttaacaaacagaatgtgggctacagatttttttttctttttttatgtatctacagctcacagaaaaactaaatgtacctccctgggttgtgatttgttaggatgaactaaaaaatattactgtcccttggaggacgttaggaacctacaatgaatttgaaacataccatgcacttcttacaggataagtagattcattcagaaattaactgaaagccgaaagtagctgttctgccaaatatgacccgaatctccactgaagtcagaggtgatgttagtgaataattatgatcttgattcttagattgccagcgaattcctctcacaattagtttgaccagatatgttcagaatcccaggccctgaaagctagaagtgatactaacaatgagattagcagcaaaaggaaggcagcgtggtaaggtggaagcacactgatctgagagttaaaagctttggtcccggtgttggtttcacagtgtttgcaactaaaaatctgtgaacaaaatcactcattaataaagaaacaaaactaattttgttcattcctaactaaagttgtttgaagactttcaaatttccttccgtaagtaaaattctgggtctaaagccacaattttcaaagtttgaacacctgatttcccttttcatcaacttattaggagagattttaatatgtagagcaaagaacagtgaagatactcagtgaaagcagaaagaggggacaaaggcccacacttccactgtgacccccatcctcagtccagagcagggtcttcagagcaagtctgcagagttggacaatactgagaagccctaattttggacaagataaaatattagcaattataaacagataagactactatatcccatttgaaaatacacaaggaggaaaatgccacaaactctccgcatttaataggattatggacccagcaaagtttccccacttgtacaaaccaccctgtggccatgcgctcacatgcttccattgtgtggatatgcttctgggccaccctgaaaatatttatatatccactgccaccatggaaaaatcatagatttgcttttcacgttttaaaaataggaaatttcaaataagtcagtttctaaagattacatctactacgtttacttatgtgaaaacaaatgtaagcaggaagcaaaacgcaaatagggaggaacatgaccaggatggagttaataacgtgagaggcacgtttgcttattgaatttgcattcacatgctcagtagagcccattcttaattggtatcgttagtgattataaagtcacaacatgttcactagtgtcttaagagacctggttgcagaaaagagaccattgcctgtctgatgaatctattcctttcactttgttttcctgtttataaaaaatatgtattttttagctttcaaaggttaaacgtatgtggtataaaaatgcaagcaacacagataaagcaaaaatgtactctcctttactcccaataactactagtaagtagtggttaacaggattgaccactgttaacctctaattctaacccctgtcaacctccagttgtaaactttggggagagagaaagaggtatataaatagagaaaacctatgcaaacataaaatcacacactttttatttgcatacatgggagtatttagcatcgctttctctttttaactcaatgctatgctatggtcatccttccttctgtgtcagtgtgagtgaaaaaaacacaaactttacaccacaacaatcagcattgaagacttctgtgacttaatgtgcagagatttctccccaccagcaagcaagaagtctattctgctgcagacaccagctagctgtcttccaattcagttctgacactctacctggagatagcgtcagatcccacaggttgagactcagtcccagaaaactgcacccccttcagacaccagttgcatgtccaggcctctggaacttctgacagacctgctttcagttgggttctcataacccctctttgggttagattaacctgctaggacagttcagggaaatacttacatttaccagtttattataaaaagaatattacaaagaatacagatgaagagatgcaaaaggcagggtgtgggggaaggagcacagagcttcggtgccctcgctgagtgtgctgctctctgggaatcttcatgagttcagctgcctagaggctcttcataccgtgtcctcttcggtcttttatggagacttcattggctagttacgattgaagcaatgaacaattatgcataaatgtgattggacaaaagggtgtgatctaatgctaatagactgagtgggggaaacccagcaaggcctgtgcagattctttttggcttttcaatgcagcattccttcctcccagttatggggccagacctatattcagaaaagttaagtcagagaatacctatggtcagctccaagacagaaaagcgggaggaaattagagtcacgccttgggcaggtgcaaggaggatgggagaagatcagagagggattctgctttctgaggcctaaagtgccccaacattataacaaaagcctgtattaagggttatgggagtcataagctaggaaccatgggaaaaaaaaccatttatacatataatatcacagtcagtatgtatgaaaattttgtaagaaaaacctgcatagctgactaaactctttagtaaacagaaaaattttccttcagttagtgcatcaaatcaagcaggatagcaaatgttcttaatcatacttctccaataaagtaggttaagatttctcatatatttacaaaaatgaaatgtaaccagtccttgaacactcttaaactagtaggtggaaacatctttttttttattccaatcattgccttcgtgctgtgtctgatatctattgcctgtcccttaaaagcatctcaggcaggtctcatagattctcatgcattttcagatattaatattctcattagttcagtttaaaacttcagtcacttatccaatttaccatgtatcattcccatcgactttcctccccagtacaggtgcctaggctgggaatagggcatgacctgcttttctatgctttcactacacttctgccctcttccttgctattctgggatttcttcttctccagtgtattggtgaccttagaggaaagatggggtaaaagaggtaaactcctcttacttaattggtggtattgtgattttctcactattgattcttgaaatttctccaattgtacactctgggtggccggtttccccatgctggctctttgacagagtatctgttgtttccttaaaggatctttcaatagcctcatgatggcaaaatcaattttcaatgcagaaaatctaccctagctcggtgtcttttaaccttttatctccttcctcaacttcaagggcactaaggcccatcagcaagtttgctacaaaaatgccctattgaataagttgccgggctctctttgtgattatctcagatctctgcaagggattctcttgacattcccgggggtagaagattgggaaaagggcacaaactaggttaaggctgaaggtccacacctttcagtttttgcttatacaggccagaatgggagggctaggatgaaaatttagggagcacgggtggattggctgccagaggccaccctctttttagaatatgaagtgctttctgcttgtctttgtttcctagcagtcaattctagacaactggaaaattcttcctcaacatccattacatacacagaaactaaagaaagtcacagagagatttaccttaccttttaaatcagaataaattattaatggaaaatgagcaaaccattcaggactttgggtttagcactttgtgtttggtcctctaaactaatttccactaaacattactcctataagttttgcaagataaaaatgtttagacgttttcttggattggaaaatgtgctctgaggtgcagagggcttatttggaagtgctctgaaagacacaccagcaaagaagctagaggagttaagatccaggaaagggcagagggagcagctgcaatgatgttgcaaataaagcctgggctcctcctacaaaggagctcaggagcaggcatagcccttcagagttgtgccaaattgagacaatctagaggctggggcctttctatccataccttatcagccagtcagtagctgaatcctgtcccctgaaaagggttcagcctacgatgaggaagttctcttaggacaagggcaatgcccagtgagactgctgtgagccctcaacagctaatatttccagcagctggggtggtgcctctgcctaaagaggatatacagaaagcaccactgcaatatccattacagaaaatatgaattcattctaatattctactaggataagttgtttctgtttgaacatacgttaaccaaggattctatctcataagtgcctggtgcctagtatcaatattcaatttaaataaagaggccttgcttcagttcttctaagtgtaaaaatctctaatgtgtaattgttaatatactaattatgtaagttttttatataataaatgattgatttttggccagaagtagtaatgtgcattacacattcttttcattatattattattaatgatgattcctagaacttatattccaggaagaactgtatttctcttgtagatgatgaagtaggtacatccacatttgtaagatctttggtgcatcccagatcaacaagtcttgcatcttgggtttgtaaactaatcgataaagccatccaaccctcccagacacatggccacaaagtgacaagaatccagagataaaggtaccgattttttctaaaaggatattacaaaaagcaaatgagcaggtattacttctagatataaatagttacaatgtcagagaaggtagtgaatgcactttaaaaaaagagcaatttttttaggatagtggcacaaaaagaaaatctcataaagctgcagaaacttacaattttggaagcaattgacatgtgtaaaattattcatggatcaaaagttgctaagagcctaaactcttttctagtttctagagaatcaacatattgaagacatgacttaaattgtaaggacttagcagatgaatagaattggcaaaggattaattttccaaagtgtcgaatctccagatataaattacactgcactggcactttgttcaccaaatgcattggagaaaagatattatcctgctaggtgtccttgcttttgcctcagaaatgaacatttagagtaatgtctaatcctttttatattgatattatagtaagaaatggaaaaatgtgcaggatatattatcattaactcttatttgcttatatctcttcttattcaaaacattttattttcctattaaaataaaaacatttttagaaactcagagaattgatgggtcaagttaaaatgttcttatgacaagatgggtgaatctttttcctagtacgctgcacctaagaggctcagtatcaagaaagaaaaatcaacaaagaggatttggttcatgagtaaaaaatacaataaggaggaataacatctagtgttcagtagcacagtagggtgactagagttaacttttttttgtatatttgaaaataagtggaaagtagaatgtttctaatacaaataaatgatacatgtttaaggtaatgtatatcttgactaccctgatttgatcattacacatttgtacgcttgcagcttgttttaaaatatcacatgtatcccataaatgtgcacacctattatgtatccataacaattaaaaatttaagaaagaaaaatcaacatagtcataaatactcattaaatttcttagctctcataactacatgtatgtctgcatgacacagaaatgaacatcaacacatagacacagatgattgatggatccatggttaggatcagtgtaatcagtgtaaattaagcaaactgtatgatataaccgcatttctcattactatatgcaataatttgcctagtcacagtttatacactgagtgtccaagagtcactagtttaattaagtaattttatgatctgatattcacaaactttataaaaataaatgaaagttgaaaagagggacattgatgagatttgtaaaagtcataagatacagttaagaaaagggaaagctaagaggaatttcaagtaatacttcttaatgcaattgtgatatcctggaagagtttctaaaagttggtagcaaatgtgctattagagagaataaagttcaataaggtgactcattctactcagcaccttctggaacttgaagattcaggtggactgggaaagcatcattatatatttattctctctaatagcacatctagaattcagcaccttctggattcaaagattcaggtggactgggaaagcatcattatatattaaatgtgttgtgttgctttatttttctctattggtagctatggaaggttaaaagcaccttcagtccattaggagtgggactctaattgaaacaaatttaagaaagccaggcacggttgcatgtgcttatagtcccagctgctctggaggataaggtgggagaatctctagcttaggggattaaggccagcatgggcaacataacatctctttaaaaaataaaataaaataaggagactactgctgggctcttgagatggtagatgtcaggagtgtttcctacaactagagaaggtgaactcaagttagcattgttccaaagcttgtcagaaccctggactgtggtcttttctcaagttttaattgtaattttcatatcaatgcatcaagtacctcttaaggttccaccatattgcaagtcattgaatcaaagtctgtgtctggagtgtgcagtgtaggaaagaatattctctttgcttttaaaaacattttggagggactagtttagacatttggtactgattcagtgtttctaaataacttccttagagtatattaaagacaggatgggaaagatgtctagtattgtgtaaagcagggtgctctcattgttttgaacacataagattgtctatatcacaatcattggcactcctgtgaactttactagggtgattgagttaggttacaataaaaatcattcttcattaacttatatactattttaacataaactggaaaggaaaggaaatctggttaattttcttaagttataggcccctaaaatgtacatatttcttagtgctcagggaaatactagagcaaaatattctttcatttattttgatcatcagactactaggttattcacatcttgtgaaacttttagttgaagaattttctaaaattctgctcatgcttgtattcaatatatttataataactccaccaaatatgcctaatttgtagacccatttgttgtaatacttgtaaatagtttttttacttttcctgtaactttcttggctaatgaagtttgctggttggatttgttctgatcatccttaaatccttccatgctgacagttttaattaaaagaaaaatttccaatcatttctctaatgccagagaaatgctaagtataaatcatttctattcagaatttcaataccatgtcttctgctaaagcctcatgaaatagttttggcatgtgtggaatatttcatagattgtataataaatgtgagcaatactttacttcttttaaaaaatgctattagaggacctaaacagattacaaatgtagtattcttgatgttttgctattttagtctcattatgggtttaattaggtcttctaattttgaaattttgtcaaactttgtcacactttgcctcagctactgattttttttttaaatcttgtttggggagttttatgtctgttggtgacatttactcaaaatcatcttcagagagatgaaacaaatggtggattttcattttagcagcatttttatcatctcccaataaattattcttgataattattaaagtaaggatggcctcttgacagacttttgggtgttaattgccctggaaaaatatcttagctttattatgtatccctcttctatcatttaacttaaaaaaaattttccctgtactcttgccatttgttttctttacttcaacttatctgtctttgtcttaaatctcctcagtttaactgagaatctgaataccccatgaaagaattatgcatttctggacctgatgaggaagttatgctgacactaagatgacagaatcataacactaagtacagaaacaagagtgcagccattcaggggaacacatagtttagttctctttgatcaaagccagaccctaaaattaaaaggccaaccattgcctctcattttcagaccccaagaaaaagagattccaaagtctgctgagtaaacaagtctgggtgttatgcttaaccaagaggcacaagtgaacatttctccctttagaatttattcttatttattttaattatatgtatttaacacagaattataatcagaatgctttgcttctttactttcagcagtggtggattatccaggtggtttctgggctataggtcctatttaggcctatgtgccccactgagataggatgcaaagataaagttgcggtctctcctaccagtccctagaaggaagtaataagcctcagtaaacccattttacaaataggaaaactatagtccagagaatttatgtgacttgctggaaattatgaaaataatacatacaagagcacatatttaaattagtttctaacttcaagctcacttctatttccaatagtagcccattattttagcatgttccatttcgacattcaaatttggagaaaacgcaaatgctggtttcatacctagttgttctccaaagacatagggacacattttatcagctaacagattaagagaagtctagctacctgtgcattcagtaacagagcatttcaagactttaaaaacatgtagagaacctctatcatatgtcactggtgatggggtgatttttattagttgtttgtttatgcttcccgaagtatggcaatctaattatgccattatctttgctacaaatgttttcattacttagaaaatcattctgctctttttgaatctcaggtacttttatttgcttttcatgacctccagtaactgcgagtgctaaaatgttattatacatgctgggaaaataaatatgtccattcattttaaatttcctgccctttaatttcattgaatttgtcccctcaatcttttattatgcatcaggatataagggcagagcaaattcatttttattctgccctttgttattttgaaaaaccaatgtcaactctttttaatttccattattctggattgttaattctatacttttcacatttaattttacaagtctaattagtatcatccagatcatcaggcagagaaattagtagccataaattaagccacagttttaaaaatgggtttaaaaaaatacgttgaaagatgacttgatctaatatgttacactttcactgtgggatttgtggaagagccatctggcttgtggtcctcctgcccttgaattgaaatctgggttaattgaggcaaagctgagcttgctcttttgtgaaatatgtggaaggctactgctcttttaattgagaaaatcatcaatactgtcttgacatttggatatattcccattttgtttaaaatgtcagctatttgctctcatatttagttgtctcttgccctataaggtttttaatttaaatttccacccaaaatggcatccatctctaatgttgtaagaaatgcactattttcattgcagtcttgttccaaaattcaagagcccaactcaaatgaagaaattttaaagatatgtttcttctttgaaatatctttaaaataagagataaaaagcatttgaataatgacattttgcaacactccaagagttctgaaggataaggtttataattagaatgaagtttttttctaacctgagagagcctactccctttatcccccaatacatatttcaatgtatccaatcatttattcatttccttgtccatctcttacaatagattgtgagttctttgaaggcaaactgcctattatttgtttatcagtaaatctatagcccctagcccaatttatgggctcaataaatgtttgttatgagaataaatacttagccagcatggcaagaatgtagcaaaagtagatgaccttttgatttaaaatgtttcatccatgatattcaatgaataccttgaagtataatgactgccttatccattgttagaagtgttgaacttgaagctgtgaagactttttgggtgcttgtgggttctcaagcagctaattgcttcttttataaaccataattactttaaaaccaaggatgagaaatgaggacattaaaggaagcttcagctaggaattactttaatctgtaattatcccggtgtgtctccctgcctctcctggactgtgagccacataagagcaggcagcgtataggatttcatctcaaaggctgtagcacctaccacaggacctaacacaaataagtgttttataattcaatatttcttgggcatttcatgaagtcaaaaatggttggaataagtattttcactgaaataatctaaccgtggcaatcctgcctgccttccttttagcacctttgcatctgttttcccattgattactttaaaatccccattccccctttattctttccctaagaaactcatacagctgccttgctacttatataaacttttggataaatagcagtgcttaagcatcacacactggggcctgtcatggggtggggactaggggaagaataccattaggagaaatacctaatgtagatgacaggttgatgggtgcagcaaaccaccatgtcacgtgtataccaatgtaacaaacctgcacgttctgcacatgtatcccagaacttaaagtataataaaaattaaaaaagagttttgctaagtcataaataaagcattctatttgcaaggtaagtggctaatggaaggaacctcttttatattcctagtatcataattttacatagtgatacctttctgcaagctcccagtgctttggcagctgttatttatgcttacaacaaacatccagtgaagagccaggatataccatgtcatattgctttcatactataaaagaataacctgagctctggatggctaagtgattcacaggcttgcagttcatccctggactttgggggccctccttgcaaattccttggtgcagccatttagaggcaataaaaacattggcatggctgctcagaaaatactatgctgaagtcttataaacaaatcacttaatatggttattatccatatggacttaatattttaacaactattacttgaaatggaaataagcagaatatgtaggaataccataagtacattttccttctaaattctgactttaatatatatttctataagtaattctgtaatctttagtaaatgaagttctgcaatactcgaaacatagccagatatctaatgataaaatagttttgcatatagagccacaaaataattccaaccaaaagataagaacaaagacatattgcactaaaaaactttgtaaaccagatttagtagaatatacctttttgcttattaagatgaaaatgtttatttaataagaaaattatagagcattacacttgaaggtgatgatttaaaaaataactctagccttaattagtaagtatcaatgactggctaaaaagataataaaatagattataactttttttcaaataattagatttataggaagttgaagaactagtccaaagatgccctgtacccttcacccagttttccctaatcgttatattctatttaactatagcgcaatatccaaaatgagaaattgacattggcaaaatgtgttgtgtagttctatgccattttatcaagatgcagaatgattccaccatgataaaaatatttgtgctaccaccttatagttatacccaccctcatcatccctaccatcctttaaactctagcaatcattaatttattcttcatatctataactgtgtcatttctagactattattgaaacaatttgtttaaatattcacccaatatttaattaaatattgtaggacatttcagttggttctaatttgaggctgttacaaatgaagttgctgtgaacaattatgtagagatttttgtgtgagcatagttcctatttctcaggaataaagactcagcagtgtaattggcatatcatatggtcagtaggcttttctttgagttgtgttatttaagaaactgccaaattactttcccaagtggctgtacaattttacatcctcaccagctctgaatgagagagccagtttctccacatcctcaccagcatttggtatgggcatatatttattttaattttagctgttccaataattatgtagtgatatctcattgtagccttaatttgcatttccctaatggctagtgatactgaaaatgtttttcatgtgcttatttgccatctgcatatcctcttcagtgaaatgtcttcataacttttcctcatttctgaattgtattgtctggttttatattattaacttttggattgtttaaatataataaatataagttagctgccaggtatgtggtttacaaatattttctcccattctgaagcttatcttttcatacttttagtagggactttcacagaataaaagtaatcgattttgattaaatccagtttatcagtttttttgtcttatgaattacgtttttggtgtcatctaagaacactgccaactactcattctcaaacattctgtcctacaaaatcttagaaaagttttataaatttggaaaagttttaaagttggtttagctgtttttcatttaaatctcatccattttgaattaatttttgcataagatatacagtttaggtcaaggctcatttactgcatgtggatatttaattgttcccatagtatttgttgaaaagactactctttccccccacttaatcacttttgtacctttctcaaaaattaggcatgttcgtgtggggcatttctgggtttattagtatgttccatttttctatatgtcagtctctctgccgaaaccacactatcttgattacaatggctatatattaaaacttaatattggtacagtaatttctctcactttcttcttttgaaagattgatttagctgtttcaattcttttaattttttctttttttttttttttttttctgagacggagtctcgctctgtcacccaggctggagttcagtggcacaatctcggctcactgcaagctccacctcctgggtacatgccattctcctgcctcagcctcccgaggagctgggactacaggcgcctgccaccacactcggctaattttgtttttgtatttttaatggtgacggggttacaccgtgttagccaggatggtctcgatctcctgacctcgtgatccacccgcctcagcctcccaaagtgctgggattacaggcatgagtcactgcaccaggccttcttctaactttctgtaaaaattgtacagtaattttatctatatttgtaaacagtcttggtgggatttaaatggcaatttctttaaaactgtatcccaatttgaggataattggcatctttactacgatgagtcttttaatccatgaacatggtatgtctcttcattcatttagatcatctttgatttctttcataagtgttttgtagtttttaccatacaaattctatacatttttctagatttatacctaagtatctgaggcctttttttagcaattgtaaatgttattctatttttaatttctgtgcttattgctagtatataggaataaaatataatgatgtcatagtctgtgatcttaactcatttaatatttctaatttttttgtgaatttcttctgaattcagtatagaaaattataagtagattcaactgaattcctttttttctgatctgtcttttaattacttttcttgcatgattgtgctggctagaaattctagtactgtgtttaataggagcagtgggaccaaacattcttgctttatttacagtcttatggggaaagcattcagtcttttaccattaagtagaattttagttggtatgttttggaagttttttttttatcacattgaggaaattcacctatatttgtatttttctgagattcttaaatcatgaattagtgctgaattttttcaaatgttttttctacatcaaatgatataatcatgcaatttttttcttccttagcctattattattaaatgaacttttcatcccttgaataaacactacttggtcatagtgtatttaatatgtatacattgctgaatttccttggttaatattttgttaaggatttttgcatctatgatcatgacagatatttctatgtaattctcttcttgtcttgtacaactttacatatataaatttaacaatttaaatacaaggggccaattctttaaaggcataaagagccaattcatgaaaaatgaaattaatgatttgaatagcctcatcactcttaaataaatttaatttattatttaaaagcttccataaggaaattttcaggctcagacaattgcactggagaattgcaccaaaggttcaatgtagatttaacactgattctacaaaatttcttccagaaaatagaagaggagaaaacactttgcaattcatattatattgctagtggggatgtaaaatggttcaaatactatggaaaacagtttagcagtttcttttaatgacatactctgtgacccagcaataccacttctaggtatttacccaagagatgttgaaaaaacatgtccacagaaagtcttatatatgaatgtcaaaagcagacttacaactcataataactaaaaaaacaggaaaaaaattgtaatacccatcaactgatgaatgagtaaacaggttagatgtattcataaaaaataatacaataaaagacaataagctactggcacatgcaataatattggtcaatatcagaaacattatgtggagtgatagaagccagatactgtatattttacggttccatctatatgaagttctagcaaagggaaaactaagctatattgacataatcagaacagtggtcttctcaggttatggtgattattaggggtgttagaaatgttttatgtcctaatgtgggtgctgattatatgggtttatataattgttaaaacccaatagcacccttaaaatttatgcattttatcacttgtaaattatacttcaatgtaaaaagcaatacttttactagcatatgtctcaatgtttttattttattttgatgattaatatgtggaattgaattctcttttaagaaagttttattgaattagagtttatatatttttggttacagtctttgattttattctttggtgactcctgtttctgtgtgtgtgtatgtatatgatattttttcaaatttttttacttcttttgttatttttattttatcctttatacctttctatttttgtttgtttatataaattttaattccttctgaaggattttttttttcgtctaaccatcaaatttctgagcttttctgttctttcaaagctcttttttttttcatttattttagctcattttaaagtattagaatgcactttttacttttgtggccacttttttatggtgattttactttcatctttatctttctagtttttaaaaaaatataattttcaggacttttagtaagagattcctgtggtgaatgcagagatgaaccaaaatgtctttcacagcttcctcactccagggttgcctcccctcctgttaccatgaacacctcaaattatagcctttctgtgtagccatgtctctgcctctcagagctaagcccaattcaaaaggttatctcctcaattctatttttcaagacaatgcttcatctttagatttgcagttacaggactttgccagatctgctctctggatgcatttcctctactatttactcacccttacctccagggttctagctctgctcatttttgttttacttctagcagtgttccttcagggtactgctctatacttctagatagttctgagatcctggagatagacttgccagataaaatatagatgcctggtataattagattttctggtaaacaataattgtttaatgtaaatatgtcacatacaatatttttgtttcttaacttgagtaattctaccaggagggcataggtaaccatagcagtgttcatctttccccattcttccctctcccagctccccttagtgaccttagccacttagtttttgtacccatatatgattttcctatgtttttgacctttccaagaaactgagatccagcgttctgatcaatgtgagattcttgccaataggagtgagttttatttacaattgagcagttctgttgctcatgaggttcctcagactatttttttttttcattttctgtcactttcattgcttggctgtattagtggtttggccacacccacccatattctgagttttttatagaacattcctagtcaacaaatttttctggaaacatatttttcttttcttgccatagttgacatgtgtagtttctaaaggaattttggagggattaaaaactacatagctacatctcaagtgtgagccagaagtagtaggagccatagcttttaaaattatatcttctattttttctttgtgtataggaacaaaactgatttgatatatgtatcatctttcattgttgaactcttaattagctctaatcatttgtctgccaattctcatgtaaataatcatataatctataaataataaaagtataatttctttcttcccaactttttaatttgcttttcatattttcttttgctacctaaggcatctaatagaatagtgaagagaagaggtgatagcaaacattttagtcttgtgtctatttactcaattttataatggggataataatagtatctactaaacagagttgttagagaattgaaagaggcaatcataaaattatgtaagcagcatttagtacacattgaactagtaataaatgatagccattatttttttaaatgtcaataaaattattttgtgttatacttatagaggtataaagtggttgaaataaattaaagaccttgggaaatagcaattagaatatgtatgtggatgcactcacaaataagcatattactctgggccacattacattaagaagaaaatatgatcggaattaagagtagatatgtagtaatttcttgaatgaatcatggttttccatattctctttaaaaataaagaggctagtcacattcaaatttcaagtatttagataaacattcagaataagtactttgtaaaacattggattatcatcgcttcctttacagtggtggaaactttatagttgtaagtgtacacagggaattaaagaacaggaaaggaacaaaacaatctaaatggaaagaaagatccagctgcagaagccagaagtgaaagcatggatatattatttagtaacagcctggatgtactatactgcaggtaccagctttatagagatcatcgtacagatattattaatatattactggacatttggaatataaacctttaaaacctgtgtgatgtttaaatatctgtgatgtatttgtttattttacaaatagagtattttctatattgatcctggcttataaattttcacatataatttagccctgttcttgcttatttcttattctactactacagtttatgcttatggtgattcatcaaagtgttctgtggaatctcattttgtgttggagaaattcaggggtctttctctttgctataatctgtagtgatttccacacatgtatcagctaccctgggatacagactctgagatggagatttacatgcagcaagcttactgagctgtgctctcaagaacaaaatcaggattgagcagacaaaatattgtaaaagcaaagcagttgcaacacaagcactatttggtgttatagggctctctaaagccatgggggcctttcatatatgcccaaaactgagcatatacatccaaaattacaggaatggtaagcaggcgtttgtactccccgtggagctgtcattggatgtaggctacctaaaggaaggggacatgccattgaatgaagaaacttcctttggccaggtatttaaaaataagccatactggaagaataagagcttaatcctaaaggggagatgtgactggcacaccacaggattctcttttgtccataatttacactccgtggacccacttgcttcagataataatgtcatcccttctggaaacaacccctccacattagtggttggtttcttttccaaggtgaatatacaagattagagagtaaaaccacagccccactgctgcagatggttgtgagaaaactgacacatattgtctctgtcctctactatccttccaatctttattctccaaacactcatctagcacctctaccagtctggccagcttacctagtgggatgatccagaccctcaatcccaaggggtctatgccactgttcagcatgcctgtcaagttgtggcaactgctctgatgcactgccatcaaaacttggtaaagaattagcaagcgatgcctcattatctcatctgggtgccaaacatattcttttctggacccaatgatgatcaggatctattacttctgccaggagagtgacttcttttctttgttcctgatctcttagatcaaagaatttaaagtaactgggtggcagctatggtttaaatgtaatggaattctggctttattccctaatggaagcacttttctcagcaatgtaggacccccagatccacagagcctaatttgtggaaatgagaaacacaaattcccccaagattgtcgctgggagtgatgagcagaactactcctgggtccactgctccacccctggatccacacattctacctattggagacatagcaccatgtaaccatcattcatataagacaattactgcatcacagagaagacacctacacttgcacagtatcatctccaagttagcacctcatctgcatcttcaaaagccagattggtctgtcagactggcagcatctaggtgctatgtgaccaatgggtatctgctgacttccctcctttctttactataaagtatgtctctagtagcaatacagtattttctaagatcgtatgttgttggaacaaacattctatatggcctcagtgactggttcttctaaagcttataagcagaaaaggtaatccatactcagaatatttccaattttgcccagatgaatctttccgacttcaaggatgcaagggatccaatgtaatcatctgttactgactggctgttggtcttatcaagaagtagcaccattttggggattgagcattgctctgttgctggcagattagttattcagctgtggctaaatgtgccatcccaattcaccatcagtgtgcatattaagagtttcagtgttactgaatgccaagaactattatcacaccatctatttcaagtggtgaggtcctcattgccagctatcatgaagtgatctagtgtctcttttcctggacaacttctgattttaatggttgtttgttcagtacctcggtaatagactctgagatggagatttgcatacaagcaatttattagagtgtgtttccaggaacaattgtaatggaatgagagaagcatgactggtcagaaggaaaagatttgctgcaattcagtagcaatagaagctgatcccatgtagagcactgaagctgggctagtctttcatgaatgtccagaattgagacaaggacctggtagccttgtacctccacatcaaccagtcatgacatgaaggctgcacctgaaggagtgcataaccatgagacaccttactttggctaagggtaattcctgagcaagaacttgactgtgagctgtcaacaaataatatttccagcagctggaggaataattagcatctcagtcctaaaggaacacatgggatgttcccttacagtagaggtccccaaccccggggctatggactggtactggtctgtggcttgttagaaattgggccacacagcaacaggtgaacggcaggcaagagaacattactgcctgagttcctgagctctgcctcctgtcagatcagcagtagcattagattctcacaggagcgccaaccctattgtgaattgtgcatgcaagagatctaggttgcgtgctccttatgagaatctaagtaatggctgatgatctgaggcggaacagtttcatcccgaaaccatccccacacccatctgtccatggaaaaattatcttccacgaaattggtccctggtgccaaaaaggttgggaccgctgccctacagcatctactacaatctgagttctagaatgcgttaattgaattatgcttctttcaagtacatatttggcaccccaaagttttataggaaagataagtttgtactgaaataaactgatgatactttttttcaatttagagttaggatctactgtaaaacaaaaatcggccgggcacagtggctcacgcctataatcccagcactttgggaggatgaggcaggcgtatcacgaggtcaggagatcgagaccatcctggctaacacggtgaaaccctgtctctactaaatatacaaaaaaaaaaaaaaaaaaaaaaaaaaaaaaaaaactagctgggcgtggtggcggatgcctgtagtcccaactacacgggaggccgaggcaggagaatggcgtgaacctgcgaggcagaccttgcagtgagccaagatcatgccactgcactccagcctgggtgacagagcgagactccgtctcaaaaaaaaaaaaaaaaaaaaaatcatttccctgtgaagatgacactattaaagtaccaataataaatagggctcaggattttacaagttgtttggctgaattttcatcattcctcacatttgcttaccttgtaacaccttgtggccctgcatttgcaagatgtgtctctgctgagacttacgttctatagacaaagagcaggaaaaacactaagaagcctcatacatagaaattcaatccaaaaccatgacctcattagtagagtattctaaatacctgtgcatagaattatgaatttgataaagatacaatggttatttctggagccaaatgataaaacttgatttttatgctgatttagacaaaactcaattttacccttgagtaggagaaaacatttttcagaggaagatagtttttaaacttttcagcattgaatcatatgtttaagctgtgaattagtaaatttggccctagggtgatttaaaaaactaaacaatctaaagattggaagaagctaatatatatagttttaaagacaaaatggataaggatataggcttaccttctgaatcaaggccttagtttttaagtgcaaactttgaactgcaaataaaatacctgtcaacgaagtatgttcttgaaaatccacttggcatttttctcaagttcatgcatatatatgtgtgtgtgtgtatatacacacacacacacacacagagagagagagagagaaagagaaagagagagagtgtatatattcttcatggatagtgaaacataactatccattgttggtgcttgcagagcactcttacttggccttctttcatcttttggaatgattactacacacgacactctaattcaaagagtattttagtactaaatgtttatttaaatttgtacatttttggcattattttaacatatcctctaaggccctatctactgacaccctatctactgaatttgatcaacacatttgatcaagtagcataagtcttgcaaataatgtgtctacttgatggccattagagggccttatttttttttctcatgatatattcgttaagaaattataactacaccctttattaaagaattcttgtataatgatacaaaaagtaatcccagtgctgatacttttgtttgatgtcactctacaatcattatttccaataaaaatgattgactgtctaagtggctgacataaggaatgagacattctgtttgttgctatcaccactgttggacttgcccatgggcactgcagctaagacttgttatatgagaaaagtatacttctccagaaaaaaataacaataaaatccctttgcactcatccaggaatgttagtttcaaaagtagatagaactagaaatatcagtagatttcagattatacaggtaggttcacaatggagttaagacttaaactcaggtctccaaacttctatatatgtcttcctattaaataactaatttaaataaatattattaacaattgaattctagaaatctgcctagaaaaattaatatatttaaatgtctcaggattcaaaagaaaatgcatataccaaaagtcagtgtgaaagattctattaaatccagtccactcaatatagaatatatgtatagcacttggccctcgtggcaaattacttgacactaataaatcttttctttttaatcaaaaacctcaatattaacatattcatttcctgttgctaaataacaaagtaccacaaacccagaggcttaaattaacaaccatttactatctcacagttctaggggccatcattctgcctaccacacttaaaatagggaataaaaaataaatgaacttaggctgggtgcagtgtctcatgcctgtaatcacaaactgggaagccaaagcggggggatcacctgaggtcaggagttggagaccagcctggccaacatgatgaaaaccaatctctactaaaaatacaaaaattagctgggcgtggtggtgggtgctggtaatcccagctactcaggaggctgaggcagaagaatcacttgaacctgggaggcggaggttgcagtgagctgagatcacaccactgcactccggcctaggtgacagagtgagactcagtctctaaataaataaataaataaataaatacataaataaataaaataaacttaagaaaaatgccaagcagattttcaagaacacactttgttggtattttatttgtagttcaaagcttgcacttaagaactaaggctttaattcagaaggtaagcctatacctttatcctttttgtccttaaaagctagaaatgaaatcaaaaggatattttattggatactatgaccatattcagattacaaagtcatagccaaaatatgcataacttaaaactgaattatgctttttgttaaagcaagtacttttaacagttttttattttaaattgaccattttaaaaaaaagtttttatattccatgataatttactttagctcttctgagagcaagctttcctgctatccatgtttccgtcttatgtggtatgcatttaaatacagatatttcattaattaaaagtctcgatgattttaagtatttctctgtaacactgaatcaatatttagatttgagcacatggttctctcttcaggagattttatttctctgcacttctcagtgtaccagaacccttgagcccaaaataccagtatactaatgtaatgttcaatgtataatataatgtatacatgtgataggtaacatccaaagggttctccttgcctgctccccagacagagtcgatttatccggacaggagaatagagagtttaattcatgcaatgctggctgaacacaagactggagttttgttattactcaaatcagtcccttcgaaaatttggagactaaggtttcttaaagaaagataatttggtgggtagggggccagggagtgcagactactgattggtcaggctgtagctgtcatttgcactgagtcagtcggttcctggtggggggcactagaagaccagataagccagtttatagatctgggtggcaccagctgatccaaccagtgcagagtctgaaaaatacttcaaacatgaatcttaggttttataatactaatgttatctattagagcaatttgggagattagtgatcttgcggcatctagctgcatgactcctcgccagaacttctaatttgtggctaatttgttaattttacaaaggcagtctggtccctaggcaagaagggggtttgttttggaaaagggctattgtcatctttatttcaaagttaaactgtaaaatgagttcctcccaaagttagttgagcccacgctcaggaatgaacagcttggaagttagaagcaagatggagtcagttaggtcagatctttttcactgtcataactttctcactgttatgatttttgcaaaggtggtttcactgaaaattcactagatatagaaagagtgagcttttgctcttgacggtatccaaccaagacaggtatttagaagacaggtatcacacgaaatattggtaaatgcctatcctgtcacttgtgtaggcagaaaaaaaatatgcacccagtaaaaatttagatagaaatcttttttatataaaagcaaattgggaagttgtattgtagcaatttaaaatgtttagaaaaatgttatgactcagcctacacttataatctaataccatacaaaagactcaaaaggaatgaggatttcttaatgtgtttgcctaaaacaagattttatatatagagagagattgattgacctgtatctgtatttggatacttttaaaccaaacacaatgaacagatctttttaaggttctactgattgatgtctcatatttcccaattaagataatttacatattttagaagctgtttacatgattcttagaattgctttgaatttgaaatgaaggctgggggataggacagctgaaatgagattaaagcatctctgatgagaggaaaccacttatttttccaactctaaaagggaagaatagtagactatgcttattcaaaaaaatttacaactaccacacatctaccataccttagtaaatgataattatataaattttgaaaatattattaactttctatttttgggtctttaaaagttcctgatttccttattctaatattcttaacattctctacaatattttttcgtctttctcaaaacacagatgtatgatatttccaatgagacatctaatattacatgtatttttcctctttactggttaagttgaaacttgctgattggttggaacacactttatctatttttttgtttgcttctttgtcttatctttctgtttttcatgccattcctcatagactaagatctaaaatctaatatttacttagggaaaactatgattgctaaattaattctctatttagttgaatttgtatcatcttactgaagcaaagggttgggtgtttctctagaaaacaagagactcataaaaatataaaataccaataattcacttttacatattaaagaaaagcaaaatgaaacagaaaagcaaaatgaaacagaaaagctgtatataggttgtagtggcagatacctctattcttctgttaacagaatcctaatttgctccaggagtttagaggaacagcaaagctctcaggcaggtcaaatcatcgtgcagttccaagggatgcattacaattgattaagcagccataatcatcccaaacttttttgccagtggtttaatttggggtaggcttgttacaaatttcagctaatgagatgtaagaaatctcatgtgtgcctctctaggaagagttttccttcctggaagaacagagtgttatacaaggaaaggagcttttttctcctgcctagtgcctttctatgtgtctaatgtgttactttgtggggatttgaaagaaaatcccagaagtatagatctagagctctgatagcattgagccattttgtcaacagtagcccatttccagactttatatatgagaaatttttttaaacatagtatttaaaccacgtgtaatttagtattttcttatgtgtagccaaaagtacttctaactgaaatagtttgtttttttttgtttgttttttttttgagacggagtcttgctctgtcactaggctggagtgcagtggctagatcttggcttactgcaacctctgcctcctgggttcaagcaattcccctgcttcagcctcccaagtagctgggactacaggcatgcaccccacacccggctaattttttgtattttaatagagacagggtttcaccatgttggccaggatggtctcgatcttctgacattgtgatccacctgcctcggcctcccaaagtgctgggattacaggagtgagccacagcacctggcctgtttttcattttttaatgaatcttaccaaagtaattatgatactaatagattggaaccctgcttttgttgatagtcactggagagctgttagatcttaaaaatatatgtgcttctaaaatgggggaaaatacaaagctgcaaagctttaattcatattaatcatttatgatgtaccatcaataaatttatttaaatttgaaacttcactctccaaatgagcatttgcaatacaaaaaaatactcgctgggtgtggtggctcacgcctgtaatcccatcacattgggaggccaagatgggcagatcccttgagcttaggagtgcgagaccagcctggataagatggcaagaccctgtctctacgaaactacaaaataataataataattagccaggcatggctgtacacacctgtagtcccagctgctcaacaggctgaggtaagaggaccactctagcctaggagttggagggtgcattgagccgagattgctccactgcactccagcctgggtaagggagtgagaccctgtctcaaaaaaccaaaccaaataaaaaaacaacaataaataaacttaagcacctagtttagaattctgtaagagaaatgcaaaccgagtgatcactgcctccttgatttgtccacattatctaaaattgctgagcaattaattggatcagccacatgatattcagaagctccctataggtgactatagaatatacagactcctggggaactctagttaccctgttgagcaggttgagcagacagactatttttgatacattagcaagcctatctttttgaaaagaaattgtgtactatatatgtttttctgagcaaaacacttcccaatagtctcacaggtaatagtttacagatgtgctgggatgttgagctcctcatgaggaacaaggggtggctagagtccttgggttagtcactttcagctgctgcaagctatcttttttgtttacattggtgtaccttacgcatagtatcattgtctatgagtgctatgaattttttcatgaagcacagtagaaaaactataattaaatatatggttaataatgcttctgtttaaaattaattacttatcacaaggggaaaggactcaacacttttagctatcccaggatacatcagttaataagaatcacagatgccttcgaagtggtcaaaatggtcataaaaatctaagaacatagctaaaagtgatgctctccactcacttttctgggccaaatacagcagtattcatttatagtgttaaaatttgtcaaaaagtcatagtgaagaatatttggtatgaaaactaaaatgacagatattaaacaattagtaatttaaactctctcccaatttttaagggagcaatgataggtgataagtgtagagctgctacttggttattagaattttaatatttttgatgatatcatgtaattcattattctaactaaaaagtattacaccgtcatactgatgatgattatcacttgcttttctccttctttgctttcaaagtttgttgcaataaaaagttatttgattaggtatatttttctaggcgcttaactcattttgacaattttttcacaagtttggaaatattcagaactctaaatttatttatttctgcatcctagaactttattctaaaaacaaacaaaaaaagtcttatattgttagaatgttggaaatacactgagaatttgcagagatgcttatgaaacaacagtacctcatttcctgtcatagaccttcacagtaattacatcagccaaataaccaaaaaaaaattttctatttgcatgccatttaaagattagcaatggactgattctgaagtagtgatgtaattgcctaaaaggagtgaatcaattttgaaattaattacactactccacaagtatttagatattacactcttcagcattatattttagtgacagagaggttaggtggggagagattttggtgggtgtactagtttcccatggctgctgtaacaaattaccacagatcattacaaacttggtggtttaaaactgcagaaattggccggacccagtggctcacgggctgggtgcagtggctcatgcctgtaatcccagcattgtgggaggccaaggcgggcggatcacgacatcaagagattgagaccatactggccaacatggtgaaaccctatctgtactaaaaatacaaaaagtagccgggcgtggtggcgcgcacctgtagtcccagctactcacccgggaggctgaggcaggagaatcgcttgaacccaggaggcagaagttgcagtgagccgagatcgcaccactgcactccagcctggcaacagaatgagactccatctcaaacaaacaaacaacaacaacaacaaaaactgcagaaatttattcttctggagtccacaagtttgaaatctgtagcaatgagcagaaatcagagagacttcagagtctctgggggaaaattcgatccttgcctcttccaggttctgttagctgtgggattacctggtttgtggccacattagtccagtctttaagtccacatcttcaaccccctctctgctctatcctcatcatcaatttctttttgtgtgtgaaataggcatctacctccttctcataaggatacaggtggttacattggacctacgcagataatccaaaataatctcttcatctcaaaatctttaacttaattacatctgcaaagactttttggatatttatttattttttgctataatagtaacattcacaggtcctagggattagcatgtgaatatcttcgagagagccatttcccagcctactattgtgcgtgtggaaggtcgggggaggccaggaagagggccttaaagcaatagaataaagagagtatcagacgtattatatgaaaatcttcaaatttacatgaccctaattttttaaaaactgtattataatacatcttgactatgttctttcaatacctaggtaatcagaaccagagacaattttattttattttattttttagtgttattgggctaatccaagaaacttcaacatagggaaagccccttttattagaattctaaaactgagacttccaaaaccaaatagatcaataaatatgactcatattatttgctgactggccaaaattaagtttatattttgatgccacttctaaaaacaagtagtgatgaatatgtgacaatgagacagaagttgctgttttcaacagtttgctggagattattttcttattattcatcattttgagatctatgaattacacatctacatcttaaagccttgttataaggacaaatatacatgaacaaaaatcactatatgattattttttaaaaaaactcatccctaggccttttctttttttagctttcattttaggttcatgggtgcacgtaaaggtttcttaatagataaacttgtgtcatgggggtttgttgtacatattatttcatcacctaggtattaagcccagtacccaatagttattttttctgctcctctccctcctcccatcctctcccccaccaagtagaccccagtgcctgctgtttccttctttgtattcataagttttcatcatttagctcccacttagaggtgagaacatgctgtatttgatgttctgttcctgtgttagtttgctaaggataagcatgtaaaagtatagtttggtatttttcaccagtttttatgttttgttaacgttcaagtttctaatttatttacatacatgcagggtaatgtttctatataacttaatttataattgtaggtgtttaaagacgcttcagtggcatgctcccagccttaggactataggaatgtaaatatcttggcatgaaatgttttgcaccagtaaaggcaagcaattaatcatatacaggtgttttcatgctgaatgagtattattttttcaatcaaagggaattatttttcactttttacttcaagaaaattgaatacctttggtatactgtttttatttggagcttcataaaacttaaaagtcatgtttatatgttcattaaaataatgcctgttggatgttctaacattgatagtctgtcttaagaatagtgtttaagcaaaatattttcaggcatgatttccaaaagagtttatatgtcttactaaactaaaccgttttttgcaaaatggaaatttctgggaattgatcataatataagcaagaaaatgacaaaaagctaagtaatattgaaataaataatagtagttgaataactcacagtaaatgattgaactgacacatatgttatagaatacttagtgagactttttaatcaactgaaaaaaatcaggtaacagaatatagagcaagattcccatttcatttaaacacatattaaaccatatattcataggaaaaagaatggaaacctgtacactaaaatgatacagatgattacattaaatatggcattttctcaatttccctttttgatgctcaaaattttaaatattttctagaataagaaatttctataaagggggaaaacaaatcttattttaaaatgaattaaacttaatcattaaaacatctatgcaaatataaaatcacaagaaagcttgatcatatgacagcagcactgataaaaaatgagaaggtagaaatctgacttcctctatgatctgcagcataatctatgattagaattggatttctgtcacactctggctgataaccttatcagaacttttatccctgacaaactagaagttataataatagtgtgtttttatgtaggtgtttttcttaagggacaggtttatataggttgatttagatgtaacaggatttgtgaattagaacacaagatttacatcgtaatgtagactgccattggtcctaaaggaaataagttgctttatttgggccacttttgctcttcatttatcataacaataggaaaagaataagaccatggtgagaatgcctaaacattaaatgctactgctattggagatgagaaaactaagctgaaaatataattaactttgtacaaacggtaaatattgtcctactattttgaccagggatgtttgttttatgagtatacatttatatctattaaaacaccttggccaggcacggtggctcacgcctgtaatcccagcactttgggaggccaaggcaggcggatcacgaggtcagaagatcgagaccatcttggctgacatggtgaaaccccgtgtctactaaaaaaaaaaaatacaaaaaaattagccaggcgtggtggtgggcacctgtagtcccagctactcaggaggctgaggcaggagaatggagtgaacctgggaggcagagcttgcagtgagccgagattgccccactgcactccagtctgggtgacagagtgagactccatctcaaaaaaaaaaaaaacaaaacacctttattattaatattaaaacacctcattgttaaaaattctaaacctttttcttgcttaaacaagtctttttttgttgttttttcttttattttcaatacagggtcttgctctgtcacccaggctgaagcacagtgggatgatcttggctcactgcaacctccaactccagggttcaagagatcttcccacctcagcctcctgagtagctgggattacaggaacatgccaccatgcccagcacattttttgtattttttgtagggacggggtttcatcctattctaggctggtcttgaactcctgggctaaggatttgcccacttcagcctccaaaagtactgggattacaaggatgagccaccacacctgcccagaagatgttttattattattattattattattattattattatactttaagttttagggtacatgtgcacaatgtgccagttagttacatatgtatacatgtgccatgttggtgtgctgcacccattaactcatcatttagcattagctatatctcctaatgctatcccttccccctccccccaccccacaacagtccccagagtgtgatgttccccttcctgtgttcatgtgttctcattgttcaattcccatctatgagtgagaacatgcggtctttggttttttgtccttgtgatagtttactgagaatgatggtttccagcttcatccatgtccctacaaaggacatgaactcatcattttttatggctgcatagtattcatggtgtatatgtgccacattttcttaatccaatctatcattgttggacatttgggttggttccaagtctttgctattgtgaatagtgccgaaataaacatacgtgtgcatgtgtctttatagcagcatgatttatagtcctttgggtatatacccagtaatgggatggctgggtcaaatggtatttctagttctagatcccagaggaatcgccacactgacttccacaatggttgaactagtttacagtcccaccaactgtgtaaaagtgttcctatttctccacatcctctccagcacctgttgtttcctgactttttaatgattgccattctaactggtgtgagatggtatctcattgtggttttgatttgtatttctctgatggtcagtgatgatgagcatgttttcatgtgtcttttggctgcataaatgtcttcttttgagaagtgtctgttgatatccttcgcccactttttgatggggttgtttgtttttttcttgtaaatttgtttgagttcattgtagattctggatattagccctttgtcagaagagtagtttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtcgttgcacatgcctatgtcctgaatggtattgcctaggttttcttctaaagtttttatggttttaggtctaaggtttaagtctttaatccatcttaaattaatttttgtataaggtataaggaaggcatccagtttcagctttctccatatggctagccagttttcccagcaccatttattaaatagggaatcctttccccattgcttgtttttctcaggtttgtcaaagatcagatagttgtagatatgcagcattatttctgagggctctgttctgtcacattgatctatatctctgttttggtaccagtaccatgctgttttggttactgtagccttgtagtatagtttgaagtcaggtagcgtgatgcctccagctttgttcttttggcttaggattcacttggtgatgcgggctcttttttggttccatatgaattttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttttagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgcacatttattttgtatcctgagactttgctgaagttgcttatgagcttaaggagattttgggctgagacaatggggttttctagatatacaatgatgtcatctgcaaacagggacaatttgacttcctcttttcctaactgaataccctttatttccttctactgcctgattgccctggccagaacttccaacactatgttgaataggagtggtgagagaggacatccctgtcttgtgccagttttcaaagggaacgcttccagtttttgcccattcagtatgatattggctgtggttttgtcatagatagcccttattattttgagatacgtcccatcaatacctaatttattgagagtttttagcatgaagggttgttgaattttgtcaaaggccttttctgcatctattgagataatcatgtgggttttgtctttggttctgtttatatgctagtttacatttattgatttgcgtgtattgaaccagccttgcatcccagggatgaagtccacttgatcttggtggacaagctttttgatgggctactggattcagtttgccagtattttattgatgatttttgcatcaatgttcatcaaggatattggtctaaaattctcttttttggttgtgtctctgccagtctttggtatcaggatgatgctggcctcataaaatgagttagggaggattccctctttttctgttgtttggaattgtttcagaaggaattagtacgagttcctccttatacctctggtagaatttggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctctcttttcttctttattagtcttgctagcggtctatcaattttgttgatcctttcaaaaaaccagctcctggattcattaattttttgaagggttttttatgtctctatttccttcagttgtgttctgattttagttatttctgccttctgctagcttttgaatgtgtttgctcttgcttttctagttcttttaattgtgatgttagtgtgtcaattttggatctttcctgctttctcttctgggcatttagggctataaatttccctctacacactgctttgaatgtgtcctagagattgtggtatgttgtgtctttgttctcgttggtttcaaagagcatctttatttctgccttcatttcgttatgtacccagtagtcattcaggagcaggttgttcagtttccatgtagttgagcagttttgagtgagtttcttaatcctgagttctagtttgattgcactgtggtttgagagacagttttttataatttctgttcttttacatttgctgaggagagctttacttgcaactatgtggtcaattttggaataggtgtggtgtggtgctgaaaaaaatgtatattctgttgatttagggtggagagttctgtagatgtctattaggtccgcttggtgcagagctgagttcaattcctgggtatccctgtcaactttccgtctcattgatctgtctaatgttgacagtggggtgttaaagtctcccattgttattgtgtgggagtctaagtctctttgtaggtcactcaggacttgctttatgaatctgggtgctcctgtattgggtgcatatatatttaggacaattagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacaatgatgggtcttgactctttatcctatttgccagtctgtgccttttaattggagcatttagtccatttacatttaaagttaatattgttatgtgtgaatttgatcctgtcattatgatgttagctggtgattttgcacattagttgatgcagtttcttcctagtctcaatggtctttacattttggcatgattttgcagcagctggtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgttgaatattggcccccactctcttctggcttgtagagtttctgctgagagatcagctgttagtctgatgggcttccctttgtgggtaacccgacctttctctctggctgcctttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcagtttcaggtacaccaatcagacacagatttggtcttttcacatagtcccatatttcttggaggctttgttcgtttccttttattcttttttctctaaacttcccttctcacttcatttcattcatttcatcttccgtcactgataccctttcttccagttgatcgcatcagctcctgaggcttctgcattcttcacgtagttctcgagccttggctttcagctccatcagctcctttaagcacttctctgtattggttattctagttatacattcatctaaatttttttccaagttttcagcttctttgcctttggtttgaatttcctcctgtagctcggagcagtttgatcatctgaagccttcttctctgcactcgtcaaagtcattctccgtccagctttgttccgttgctggtgaggaactgcgttcctttggaggaggagaggcgctctgctttttagagtttccagtttttctgctctgttttttcaccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcatagttagcagcagcattgtctgcagaaccgtggattttcgtgatccgcgaatgctgctgtctgcttgttcctctggaagttttgtctcagagttgtacccggctgtgtgaggtgtcagtctgcccccactggggggtgcctctcaggctgctcgggggtcaggggtcaggggcccacttgaggaggcagtctgcccgttctcagatctccagctgcgtgctgggagaaccactgctctcctcaaagctgtcagacagggacatttaagtctgcagaggttactgctgtctttttgtttgtctgtgtcctgcccccagaggtggagcctacagaggcaggcaggcctccttgagctgtggtgggctgcacccagtttgagcttcctggctgctttgtttacctaatcaagcctgggcaatggcgggtgcccctcccccagcctcgctgctgccttgcagtttgatctcagactgctgtgctagcaatcagcgagactgagccaagatggccaaataggaacagctccggtctacagctcccagcatgagcgacgcagaagatgggtgatttctgcatttccatctgaggtactgggttcatctcactagggagtgccagacagtgggcacaggtcagtgggtgcagtgcaccttgcatgagccgaagcagggcgaggcattgcctcactggggaagctcaaggggtcagggagttccctttcctagtcaaagaaaggggtgacagacaacacctggaaaatcgggtcactcccaccccaatactgtgcttttccgacgggcttaaaaaacggtgcaccaggagattatatcccacacctggctcggagggtcctatgcccagggagtctcgctgattgctagcagttgtttttaagacaagatttgttagtacaatgttccttaggagtgattctaacgtagtttattagaactgattatattattgttgtaggaaaaaaccgggttcttatcagaggaccaggataatttagacacgtggacatattgtagggtgagtagggcagggtttattgggtgcaaaggaaaaaagggaaacaggaaccctcagcaaagcaagagagtcctgttagctggtttaccccctcacagattgaatcccaggttaccacacaggaagaggagagccagcctgctcccccctacaaaggcgggaacttcccgaggctccaccccattctcccagtgcacaggccggttgggtattctccagggacccctttttacttggctgcctcattattacattaaaattagcagcatgatatctgtgatattggtgagctgatactagttttgcatcctagtagaaacaatcacacctaaaaacattcctatagattgcattaattgtcaatcattaatacatatagataatattaggagagttactcagttatattctgtaatatttccctgtagcttctgttgcagtcacttgcatccagctggtatttaataaaagtgaactcattcatgactcacctccttttctaattaagttcttagtcttatactaccttggtctacctttctaattattgtataacccatgacatataatagggccatgtctctgagcctgaccaatattttggcctttcatgattaacagccttaactaatttttatcttatatagctaatttgatttcatcattggagccacaaataccacagggaagccatgatgattcaattacttttttcagctgatagttttaaccatttccctggattctcaagttaagttaatctctcagatggttcacctggtgcttcagaaatcaattcttaaaagtgaattttatcatacaatagaatttttctctcatcacagacaatatctcaaagtttctgtctgaaacataaaatataagattttcttcacaagaaaaaatgaggctaaaacaaaattagttttatagcagaaaactacaagttaggtggtatctagcaattgtgatactttattatattaggtcatctctccagggcagaacatcttttccaattatactcaaactgcatcattgtcaattatatcacatcaactagttgtagcaacagggaagaagtttgtactgatctttatactcttaaataactatgctgagtaattttaagagcagggtttattgacaaaaatcataggccgaattacaaggcagtacaaaatctccatcaatgtttaggcaactaggcaaaatccaattacaggatatttgatatagataagtgccagctactaaaatgagaaaaaaaatgtagaaaagaataaaaaaagaaaataggattaagataggaggtataagaaagataaatgagagaaaattaatgaggaaagttaaatgagataaattagataaagtcctgcctttggatagtgatgcacaagtagcaattaccctctgtagcactagggtggatttctatgttcattaaaggggttacaccagtgtttttggcaaatctgtaatgaaggatagtgcattgtgagactaactggattgtaatgaaatatacaattaagtgaaaatagtgaaagtaaatgcaaggatatgaaaggaacatttgctatattctttatgtacatatccttctgaattactctggaaaaaagaggataaaaaattatattctactccaaagtaattgccaataaatactgtcaagaggcaactcatagctgcgcatggtggcacatgcctgtagtcctagctattcaagagactgaggcaggaggatcactagagtccaggaattcaaggctgcagtgagctatgatagcaccactgcactccagccttggcaacagagtgagacgccttctctaaaaagtaaataaataaataaaaatatttttaaaaaagtaactcataaaacaagacatagaaaatgctttataattatgtgttgcactaagttagaaataataaattgtattttagatcaaatgaaggttggtttcatgaaatagcattcgtctatacataatggcgttaatatatcaaaaacccttaatctagtgaataatatgttgcattaagtaaacaagtctagtttgcaagttcaatatgatggaacaatgttttatatcagttaatatgagaagtttgagaggctgaggcaggcagatagcttgagcccaggagtttgagaccaacatggtgaaactctctctacaaaaaatacaacaaattagccaggcatggtgatgcatgcctgtagttccagctacccaagaggctgaagtggaaggattacctgaaccagtgcagttgaggctgcagtgatccaaggccactgccttccagccggggtggcagagtgagatcctgtctcaaaaaaaccaaaaaaaaaaaaaaaagaaaagaagaagaaatcatgtgggaagtatattttgtaatatcctaataaataaatctttgaggattactgctattttatttatttatttatctatttattcattcgtttattttgagatgaagtcttgcgctgtcacccaggctggagtgaagtggtgcgatcttggctcactgcaacctctgcctcctgggttcaagtgattctcttgcctcaagcctccctagtagctgggattacaggcgtctgccaccatgcctggctaattttgtatttttagtagagatggggttttgccacgttggcccactggtctcaaactgctgacctcaggtgatccacccacctcggcctcccaaagtgctgatattacaggcctgagccaccgcgcccgaccctactgcttattattttaacaagaagagatgatgatgtgacataatcatcataataaaatgacaacatatagtgaaaattcaagtattgtgtactttcaaacagttgatcattccattcccatacaagccatggagtttgctactactaagaagcctattttatatttaagtaaacttaattgtaatgggtcatatcacttgaagatagtcaaagagcatccaagtgacagagccagatgttaggttctgtgttctcattctctatatgctatttatttgcatgtaatccattacctttcatatgctttcataaaattattaattttggtggctaaaacataaatgtttcaacttgatttttaaccaaactaggtataatttacatttatacatacacataaatgtaagtaactaagtataaatgaagattccaaatttttattatattttcaacatataatactgaagtagtgactattccatatataccatgtgaatacagataaacatggttagcatttaataagcataaaatataattttagttatgaaattaaaaagcttcagcattgacatttttaaatactatattggaaagaatgcttgccgacgacaaattttcaggagagtttgatatgtgtaatacagtgtctttcattagctcatcagccattgctgaagtcctagtatcctgctactttgacttttagtaaatagtgtttatttagctctccattataaataatatggggaaaatatgtcattgtgcacaaaggaagtgataaaacattataatcagtcatgcgttttctatctcttgtaatcagttaagtcattgaaacaaacttaaatgtctccttagatctctgttctataactgaagttcctctcttgctacagcctgcttagccccctaattctgtctctagacccagccctcaactcatagagcttctcaaattccatattttgtcttggatcatttagtttgccctaacattatactctattgagcaacgcacacattaagcagttagatgaaaccaactcctttagaaaacagttttgagttatcatttattgttacataaactcttcacgtagagctctcactcctcatactacatgaatgatcatagtaaatctgataaaaaccgggtctgagagggaagaatgggttctgaatctgaaaataatgattttctccatattgctacttattcattgacttacaaaacattgtcttaataactattttgtgcaaagtactaagttaggaacctaggaatataaacaaaaattaagaagtagtatttttaaggagattaccactgtgcattggagaaaatatgcaaataatcagatataagacatttcatatgaaattaggagaaacaaagtttgttgcagcactaagcagggctcagccaattctggttcggaatcatgagggaggtgatatttgaattaaccttttaaaaaaaatgataggtggtaagaagagaaagtaaaagtattcaagaatacaaggataatatacaaagaggcacaggccgggcgtggtggctcaatcctgtaatcccagcactttgggaggccgagacgggcagatcacaaggtcaggagatcgagaccatcctggctaacacggtgaaaccccgtctctactaaaaatacaaaaaaattagccgggcatagtggcaggcgcctgtagtcccagctactggggaggctgaggcaggagaatggcttgaacctgggaggaggagctctcagtgagccgagatcgcgccactgcactccagcctgggcgacagagcgagactccgtctcaaaaaaaaaagaggcacagaggtgggaaataactttccatctacatggaacagcaaataatatatgtgtctggaatcaaggatgactccagagatcaactgaaacacatggctcaaaaggtaacaaggtgcaagatcatgatcatgatcatggaggttcttgaagcataaattaaagatgttggaactcacctagaaaggttgggagccattggcatttgtttagaagggaagtgacatgatatcctcttgtttcactttttcagaattcacacctgctctttcctttgtttacaggatcctcccatgaaagcccttccaaccccgcatgcttttaagtccattcgttttaagcttgattcatctcttctggaaggtgtttcttaacctcttttgttaagctttgcagactctttttcccaggacaggttatgtactcctctcattttcctgtcttgtgctcagactttatatatttttatgattcttgtataataatgatctatttttaaaaagtcactctcatttgatttgagttcaggaggaattcatcattggtctttgcattctcagtgtcttgctagcatgttgccttctggatgcttcatacattttaactgactgaatgatcagaactatgtcttagtaagaaaatctatcatcattatagaaggtacactagagagaaaatagaataaatttagggacactagttagatggtcactgtaatgggagatagtgaaatgataaaataagaaggtgaatggagaaatgaaaaggagacaccaaagagagaaagctgattggaatgggacagaggcagaaagactgatttgattatccttgacaacttggggaaaggttgatcattgtcctacacggagatggttttgctaaggaaactgtgagtcttcttttggtgggttgtatcagacatatatgttagagcactgaattttttagatgtctagaaactataattattcacttttaaaacaataatgtggattactattttttttgtcttaaaacctaaaaatttatccttaagcaggtttgagctgtaatcctatgagtccataacagtaagaaaaaaaaaaaaaaaaaactcaacagtccagtctggccaacatgacaaaaccccatccctactaaaaatacaaaaactagctgggtgtggtggtgcgcacctgtagtcccagctattcgggaggctgagggtggagaatcacttcaacctgaaagaaagaggttacagtgagccgagatcatgccactgcactccagcctgggcaacagagtgcgactttgtcattaaaaaaaaaaaaggaaagaaggaaaaaaaaatctcaacagagataaacgtacatctaatcctgttccttagagagaagcaatatttaacctttcccactaatcttatattagggtgtgcgaaagttcgttttatttgaatcatactcaactgattccaaattaattatacgttatttctctcttgcttctctacagtatgctgtctggctagtcctctgggttacgtggaatgtgtttgttatctgcttctatttggaggctggggacctctcaaaggtaatttacatctaatttgcctgagtcatcagtagggtgttaacaagtctcttcctaagtaaggcagagtctcatcctgttctgcttgcttagctgcacctcaatgaaagtaaattgaaaggtgtcttgatttatatttctgcatttttatcattaaaaatatgtctggtgagtcacaaaaatgtactttttcttaagcaaaactaagtgaactgttgcttattatagtgaccaggcagtgcactttaaaacattaaccactgaatgatttctgaagcaaaatgtgaatttttttcagagaaaaaaatcttgaagatttctgaaatcacttagtttgcttataactctgctaaacattgtccttattgattttaaataacagtgcaataattgaaacagttaatgggctttggttgaatgaaattgttactagaggtatataatatgttatagaaatgaatacaatcaaccctttattctaaataggctaggaaaactaaatacttgcttttttcatttagtttttttgtgctctgtatgtgtgcatcttgctactatatttttcacatggatgcccttactacacaaatagtgtaggcttcagatctcgaacaccatcatccttctgttagaatgcaattaacagcaaagaagtcaaatgaggtaatccattcaaggtagtagcaaattctgactcttgagagagtttcaaacttgtatgtacttcctcgtatttaaaactttaaaacataaaaattgtaaaatgttcttttacttaccctgtattagagcagaaggcccctgcaaacatgttgatatttgtaaaacccagagatactcacgtgctttaaaagaccaagagagctaaaaaaaattttttttaaagaaaattcctcaggaactacctttgccttgtcaagctatatattttggaaggagagagaagagaatggtaatacacatttatgatcttacatgcaggagtttcacaaagcactcatcatgtgatgtttgtttattagttaactgtgatatgtggctttatatcaaggaaaaatcattttgatttgtttttattcaatgacaaaagatgaaggatcaaataggaggatgacatcatgatatgagagagaaccaaaacttcttggatgtgtaattttatgatcagaatgtggacaagtcctcaccgtggctagcaaaatctccctagaggatgccatttgtgtgttttttgcagggcatcgttccccacactctggttagcaggcagccttttcaggaaggtgccgtgaccaatgaaaataaattgttcagtggctctaggagggacccagaccagattgctgcttaaaactcacattcgcctcagtgtaagaaaagcagacacgcttttccaaggatttgaattccttgcccaatttatacatctctgctactctataatccactttcttcaaaggaattccatagtcgaatgacttttaatgatattttcaattttaaataatcaccttaaaaattgtaaggcaggtgttcagacatatggcctgagtaaaatgatccagcagatcagataatttgtttaatattaagaaaagagagaaagagatttgagcaaagctggctgcacaaaagttctgtaattgtgctcactgctccccatgatgactgcaggcacagaataaagctggtgatttcatgacctcagacacaggcattgaaaccacagcaagggcactaagaattcttccaatgtacatgggcagataatttctatcccttggcaatgaaacagttgataatattttattttcttctcatcctataaaccaaggctgggctctgcagagcacatgaaaatttaataatttcctttttaacaaataacctaaaaaaaaaccataaagggcaaagttatatagttatcgttatatagttatctgtactgggtttttcctctctttcgtgttcaaagcatttgaaaaaaggtgtatttataccatttaattctttagtcgttgcaactgcctcacattcttcaggtaatacagtgccagaaggaagcaatggtaattggtaatggaaaaatgtacagaaagatagaaactcaaaaatggtacatatgaaacttctgataatactaaaagaatgtaaaccattgtttttctcaatccatcagaaaaaaaaaagcaatttgaatgtgtctaccctatgaatggatcagttagtttgaggctgagggagaaatttgtgaaaaagaatcagggttgacattctgtgggctttatatatgtgaaagaaatgtatttatttccatgaaatcttttgtaaataagtgatggcttcataatggatattggtaagaggtaataaaacgtgataaaacattaaggtaaatttttgttacctgattagagtttagaacttttcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccaacccgcacgccacaacaggcccctgtgtgtgatgttccccttcctgtgttcatgtgttctcattgttcaattcccgtctatgagtgagaacatgcggtgtttggttttttgtccttgcaatagtttgctcagaatgatggtttccagcttcatctatgtccctacaaaggacatgaactcatcattttttatggctgcatagtattccatgatgtatatgtgccacattttcttaatccagtctatcattgttggacatctgggttggttccaagtctttgctattgtgaatagtgccgaaataaacatacgtgtgcatgtgtctttatagcagcatgttttatagtcctttgggtatgtacccagtaatagaatggctgggtcaaatgatatttctagttctagatccctgaggaatcgccacactgacttccacaatggttgaactagtttacagtcccaccaacagtgtaaaagtgttcctatatctccacatcctctccagcacctgttgtttcctgactttttaatgatcaccattctaactggtgtgagatggtatctcattgtggttttgatttgcatttctctgatggtcagtgatgatgagcattttttcatgtgtcttttggctccataaatgtcttcttttgagaagtgtctgtttatatccttcacccactttttgatggggttgtttttttcttgtaaatttgtttgagttcattgtagattctggatattggccctttgtcagatgagtagattgcacaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttctcaggtttgtcaaagatcagatagttgtagatatgcagcattatttctgagggccctgttctgtcacattggtctgtatctctgttttggtaccagtatcatgctgttttggttactgtagccttgtagtatagtttgaagtcaggtagcgtgatgcctccagctttgttcttttggcttaggattgacttggcaatgtgggctcttttttgttccatatgaactttaaagtagctttttccaattctgtgaagaaagtcattggtagcttgatggggatggcattgaatctataaattaccttgggcagtatggccattttcacgatattgattcttcttacgcatgagcatggaatgttcttccatttgtttatatcctcttttatttcattgagcagtggtttgtagttctctttgaagaggtccttcacatcccttgtaagttggagtcctaggtattttattctctttgaagcaattgtgaatgggagttcactcatgatttggctctctgtttgtctgttattggtgtataagaatgcttgtgatttttgcacattcattttgtatcctgagactttgctgaagttgcctatcagcttaaggagattttgggctgagacaatggggttttctagatatacaatgatgtcatctgcgaacagggacaatttgacttcctcttttcctaattgaataccctttatttgcttctcctgcctgattgctctggccagaacttccaacactatgttgaataggagtggtgagagagggcatccctgtcttgtgccagttttcaaagggaatgcttccagtttttgcccattcagtatgatattggctgtggttttgtcatagataactcttattattttgagatatgtcccatcaatacctaatttattgagcgtttttagcatgaagggttgttgaattttgtcaaaggccttttctgcatctattgagataatcatgtggtttttgtcgttggttctgtttatatgctggattacgtatattgatttgcgaatgttgaaccagccttgcatcccagggatgaagcccacttgatcatggtggataagctttttgatgtgctgctggattcagtttgccagtattttattgaggatttttcatcgatgttcatcagggatattggtctaaaattctcttttttggttgtgtctctgccaggctttggtatcaggatgatgctggcctcataaaatgagttctggaggattccctctttttctattgattaggctgtcttttctgcttttcctaatgaactctctgccatatgcttatgagtgaaacagaaattatagtaatcaaccaactcacagtgtacattcatattgaaatgacttaatttcaataatatgatacacaggactaacccttttgatcatgttttctttgtacacatagaggtatagttaatatattttcttcattgaaaattctatgaaaatccaacattattattaaaatttccattaacatattttaattacagtgtccacaaaatctaaagaaaaataaaaataatccaccggagaaacttttaaatgttatatcatagttaaattaacaaaatgatgggaatatagtataaaatgatacataagatgataggagcaaataaacatacacatttcatataattatttctgctaatgctaatgcattgagatattagtgttgaaactaaatatcctaaagcatttagcagtgtgtaacttcctgggttgatattttcctagatgtcctgttaaggaaactgagaaaaaattagtctgtaacctgaagtgtctggtaacggtttgaaattgcctttgggcatcaaatgtgacatgggttattgaattaagagttttgacaattcctcatatagcttcattattctgttgtattattcttggcaattgtggttcccttgatcatatatcaaatagagagaaataagaactaacctcagccatcaactgagttgaggtattttcaacacagaagagatatgctatttgttctgaagtgatttttaagttgaaagtatatagcagtaggaaagaaaacatatataatatggtgattaatctattcatttcatcacctggaaaaacaaaatttattaaattattttttgaatagtaatacaaagggaagaaaacttagtggtcttctggattgtccgtaaaaacctatattttattgcatgtgataaaattataaattactcaggctgaaattaaatacttacacttttcttcatattactattttcagatatgtttctaccttcataatgtatggggcaccattagtgaatggtgtgcctatctttagaaataaaacaataaacttatagagcgtaaaggataaaccaagggattattgtacacttaaaacaacccaacttgtctttatttaaccctttgggactagggatgcaggtatatctctctcagatttcactatagtaacagaaatttatacctaatgtttgtttcagaatgaacacatttagaagcaactcctagaaagctgtcatattttaataattttgatagttgcttcagagatctagatataacttgtcaatttgaaaatttgttatataaaaaagtcatgtaacaatgtggcttatttaagctttagggaataaaattgcactcttttgaatgtaagagacaggaaggagataaaagttgtcatatactgtagactatagggaacaaatccttaaaaccagatgcaagtgcaatgtggaataatgtactgttccaacaatgtcagttttatttcttctgtaacaaaatgaataattcatttagaaagatatcagatatttggattcttttgctcaataaaaccaatgcttgtatcaaaatttgcttttctgacctcatatgtaaaaagatggtatgcagagaaatatgctgtaatctttttttatttgaaaaaataactcttcctctttagtcttcttcatgagataaaaatatatgagcaattactattaaacaaagactacctataataattgatttaagacaaaatttaacaaatattatgatgataatatattgggttcattttttaaattttgattttcttactgtaaaatttatatatctgagaaaatttcaattaactattactaaagtaattagaaaaaatttttatttcccaactatcaaagcagatttttgccttatgatgcagggaaagatattcgacctattattaataattaaatgtaatgtaactctttcccaaatctagaaatgaaccaaccagttggaatttggtcagtcacaatctctcttctctcgttttccttcataattcatgaattaaactgattatttcctcatttcttaaattcatttttctttgttttattttctgtttccttttactacccctaaagtgaggaaaacagttcatgaacctttcttattctctgtctccattctttttcttgaaaatgccatttgctgacataaactatcatctttacacatatgtctaccagatttatgtcttcagtcttgaccttgttgctaagttaatgtgtcacatctccaacttcctgctggtgtcaggtcaattctattgtcaccttaaattcaaaatgtccaaaatgatttattatcatccccaaagaatccaacttctttaattcactttctactaagagaagaaaaaagagataaaaccaaaatttattttgaaaaaatgaataaaaaaggaaaaagaattttattattattatttttttgagatagagtcccactctgtcgcccaggctgtagtacattggtgcactctcagctcactgtagcctccgcctcccaggttcaagtgattctcctgcctcagcctcccgagtagctgggtttacatatgcgtgccaccacactaggctaatttttgtatttttagtagagatggggttttgcaatgttcgccaggctggtctggaactcctgacctcaagtgatctgccctcattggcctcccaaagtgttgggattacaggcatgagccaccacgctcagccagaattttttatgtggactactaaaatccttataaattgaccatgagataaagcaagaaatatatgtttgtataatgtatctattacttgtttgtgtgtgtatattgtaaactttagataccaacaagttgaaaacaacagagatctgttaaagtaatgactactcaaaaaaagctatattcgaaaaagatgagctaactttgtaaacatgctataccctgggtgcatttgttgtttctggttggggcaggaggctaagtattcaggctttacaccctgttgaatgctattttttgacaaatgtataaatcagcatagctttgagggaggtggtctagtgcacataggcaatttttctgttaaggcattaggcaaattctgtaccaggctaaaaatataaatggaaaaactctgtaaatgcataatgaaaatttttcggcagtcatgccaaattagtttgaagacagggaaggactctatagaataaactagactttcatgtgaaaagatctgaagaacaagccaggggcaaaccaaatacagactgaagattaccagaactaaatccaggctcaactcagcacaattcttgattgaaataaactgattacccatcactttatctctctagttgagagaaaagagaaacatcttaggataaagacaccattatattagacatttacagtttatttatgtgcatgacatcaggcaattgaaaattattacagatgctaaaagaaagaatgtaatgattgaaagagaagaagaagatacacaattgaaatagaccaagagatgattcagatattttaattatctggtaaagatttttaaaaacacataaacaatatattagagaaaataaacgggaaaactggaactaatacattgaaagagaaataatttagccccagagaactggaatttatgtaaagaatcaaatggaaattctaagacttaaaaatataatatctagaagtaagaactcattaagtaggtttaatagtagatttaaaagaatagaagagaggattaaggaacttgagaaataattgattaacattctccaaactaaagcacaggaaagggttaaaaataccaaaaaaaaaaaaaagagagaaaagaatgtcaaaaacatatgggttcaacaaaagattcaatatgcacattattgaattaccaggataaaaaaacagaattggatagaagcaatatctgaagtgaagatgacagagaattttccaaaattaattagtaacatcaacccacagattcaagaatactttcatatttcaagtgtaatcgagaaaaccagatttaggtatagatgaacagaaacattaaaaatctaaatcaaagagaagattataagaggtgccaaagataaaagacccaaaggaacagcaaaaagactgacagttgacctttcaacaggaaggcaattgaatgacatctttaaagtgctttaaaatgccaacctagaattctttaccctgcaaaaatattcttcaacaattaagatgaaatgaaagcatttttcaacaacacgtaagataaataattactagcaaactttaactgaaggaaatactaaaggtagttctttaggcagagtgagaaaaaaaacaccccagagagaaaaagggaattttaggaaggaaagaagataatggaaagaataacacaggttgtattgttaaacacaaaacaatagcaataaaatatttggggatttaaatatttgtaaaactcaaatgcatgacaacaataacacaagaggtagaaaggagctaaagtgttctaaggttgtagcattattatggaaatgttaatggtaatatttatgttagattataatagttcaagactagtaatgtctagagtaactactaaaagatggcataactcctaaaaactaagtataggtgaaaaattaaataatgaaaataattgattagcctaagcaatgctaagaaggaagaaatgctaacaacaacagagagggtcaataagaaaaaaatatcaagatgggtgctataatcttaaatatatcaataaatatattaaatgtaaatatactaatattccaattaaaaggctaagattgttggtctggataaagacacaaaacccaaatgtattgttgtctataagagatatgccttaaataggatttaaattataagttaagaacaagtaaaatctgttcctataaaaacaaatatagtttttgtagatttgtgatgtagtaattttaatataagatgaggtaatgtttaaggcaggaaacattactaaagataaagggggaaatgtaataatgataaaaaggtaaatccacatgaagatattgcaaagcaacattacctgaataaaataatacagcttcaaagtatatgaagtaaaaattaatagaattaaaaggagaaatagccatatccacaatcacagtgggaaacttttacattactctctggatacatcaatcagatgaaaattcaataaggatatagaatatctatataaaacagttaaaaaacttgatataattgacatatagaatacactccaccaaacaaaagggttttcaaaggcatatagaatattcaatcatataatgattcaaaatgtagaaagtcaaattttagaatgatttgcaattattcagcaagtattgtctgacaactatagaattaagctagaaaatctgcaactgtgtggaaattaaacaatatacttctaaacctatggacctaataggttggaatggagtttagaaagtattctgaactcaataaaaatgaatttattgctaaaaaaaaaacttggtggtgtgaaattgcagaaatgcttagaggaaaaaatgaccttaaagagagatattaaaagagtagaaatcctcaaaactcaatgatcttaacttccatagccagaagctagtgaaagaacaacaaatgaaacttctctaaagtgaaaacattctaataacaaggacaatagcagaactcaatgcatatacaataggggaaaaaaagcaataaagccaaattgctttttagtgtttataaaattgaggggatccttatcaatagtgattaaacgaaaaaaagagtaaaatcaccttttgctaatatcacaaataactctatagatgattggagagagtacattatgaacaagtttaagccaatatatttgcaatcagggtgaaatagacaaattctttggagaccacaacttgaaataaattaaaaatctgaagacctttttattcattaaataaattgcatcattaatcaaaatcttttgacagaaaaaaaaaaccattttgtgttcacatgatttcactgaaaaattcttaaaaatgtttaggaatgttatactaccaatatacacaaattctttctaagaatacagcagaagtgcctcccatctcatcttttgaggccagtataaccttacttattgaggatacgtgtgattgtcaaataacagattactgaactcaaatgtaataggccaggcacggtggctcatgcctataatcccagaactttgggaggctgaggtgggtggatcacctgagctagaccagcctcagcaacatggtgaaaccccatcgctaccaaaaatacaaaaaattagccaggcatggtggttcacacctgtattcttagctactcaggaggctgaggtgggaggatcacttaagcccaggaggtagaggctgcagtaagctgagatcgtgccactgcactccagcctgggtgacagagtgagaccctgtctcgaaaaaaaaaaaaaaaagtaataagaattttaaaatgctgaataactctccataaatttataaataattatgatattatttcccacactgtattgtaatacatatgtacatttccatctctctttctaaacttgtatttgctaaaagaccacacatcatcgttatgcaggagaatgccactgagctactacacagtagtgaggaattatagaatcagttaagagcattttaggtgtttataaataagcccatttgatacatcataaaacaaatgcaataagttgttcttatcaatatattctaattatatgtttccttaactatctgttcttcaatgttggaatcatgttttatgcatccctaggatcaaggaaaatgtcaggcatatgaacaatgctcactggaatgaaatcaaatggtaatagagtggacttcagtaattgtctagatctacaaatacagctgctggggactttttcttcccctccactattgcatggataatgaggtctacatctctcacgtcgattccagcactctgtggtggtagcaagcaaaaggaaagtaatcccagcattagggcacctcaaatcagggctctttaaaactaaccattatataaatcactttgatatctttttaattatagattatggttctcttagagtgaggcctaagttatttcatccctaactgctatgtgattacattcttgttgcctgtcaaacatattttgagttgtaaggatttaattactgggaacttcgacatagggcacaaggtgagttcttgatttctggccatcctttgaatcagagatcctagggtacatcttgataattgcgcataaacaaattcatcacctgatgtatcacttactgctgataccacccaagatatcaagtgaaataaccacttgacctaaggggccacttaataggaaataattcttatgtggaccaattatttcaaggttttcagaaaattacagtggtgtccattttttaaaattcaaatatttttaaatttaaagccatggaactcttaatgctgggtaggttatacccagagctctaaggaaaatttaggcttaaattcttcctttaattcccaagttacattatgctgcttttgtgtggtaaaattcttttagaaatgtccccatcctttctccaaggtggatctgactccaaaatgtatccagacatcctctagtttttctttattttcattataattgaattttcagaagcaaaagatctcaattttcagggtattctttggttgaaaactacaactatgcttgcatatttccacacaaatgttggccttccttactcttgtggttaaaacaatttaaaccatttcatagttctcttgtttcctctcataacttgagttgaattctttccctgcataagatctagatggcagctacagttcctatgactctatgaatgaactgctttaatttgtactttcttactttgacatcttttactattcctaaaacctctttcagattccccagtggatgtcaagaaccccattttcttttttgtgggcctcaaaaaatatgatgggtattgaaagagggtccttccaaacagaagagtccccctgagcatcagcaaagttttggaacataagctagcattatttcttctgggtgactcataggcaccatgcatagaaaatgttcgtagaaggtcctcccaaagagcaatgagagcaggtaatcagagttgtttgaaacttagctgtcttcacaagatgatctgttactcattcaaaggcataccttacccaattactgcaacttcttactctgttctctctggaaatggacttttatggttttatctgttctcttttcaatctgttagtaaaaaataaactatgtgcagtttcccttacccaacatttctttctcagcaaccttttattctctcatagatcaaaagctttggtttcaaagctgttatttctgatgtggtctttgagaggctcttttgaaaaataaaataaaaatcaagcaccaaccatttctttctttttgcattcctactaaaacaatgctaattctctttgaagcaatgaggatattactaactcagaagagaaagtttgcaaaacataagtataaaaattaaaagcacagataataacattccaagatagtatcctgctggaaataaaataataacaaatatgaacatgacgtaagcaattaccatccttgtttgtctctaaagcccactctatggaaattattctaggatagtaatttttattctgtcccccattttaaaaacctgtgcttgtataggtttattatttatggagtcatgtaaaataacaagaatacatttgcattaagagttccatggctttaaatttaaaaataattgaattttaaaaaatggacaccactgtaattttctgaaaaccttgaaataattggtccacataagaattatttcctattaagtggccccttaggtcaagcttgtccaatccacagcctgcaagctgcatgcaacccaggatggctttgagtgtggcccaacacacatttgtaaactgtcttaaacattgtgagttttttgtgtgtgatttatgttttcagctcatcagctatagtcagtgttagtatatttcatgtgatccccaagacaattacttttcttccagtgtggcccagggaagccaaaagattgggtaccctgccttacatcccaaaatagtttcaaaatttacctgaaaagtatgtccaattcctcataccaccccagcccctggtgtgcttttggtctttgataagttctgtgatggctgtgtcaaaatcaccgcctttatttaaactactacccagacatgatccttgggactcatttggaaactaaattaagattggcagttgacaaatttgctttagagggcagaatgtcaattttttttttttttttttaacctgtggattcactctgggacaattgatgctttgatgaaatagggggaaattatataaaaatacaactcaagggatattaaatagcaaaatttgtttctggcatccagggttatttggcaaagaaagagcaaacaagtgactgtttttcatgcctttcatatgatgacaaacctattctattctgctttgcacttaaaatttacattgaaaatgcaattgaacctttggtttagtagttcagtacgctacaggtaaccagggagcaatgttcagtaaataccgtgctactagatgcaaaacaatacagagaaaatgaggctatttagctctctttcttgattgagatttgcatgaagaaatttcgaaatatttaagtttcagcgtagcacttagagtgtcacttctcttccgcctctttataggttatatttttaatttttaataacgcaaaatgtgtatacagcctgatgcaatcagaaaggcatcttagaagggtaaaaagaggaggatgactcactaataaacagtcatttatagaatataattagtttttctcttttcttcattagcacatgcaacctgctagaggaatgagtctaagggtaattgtaggactccagggttttcacactcagaggtagcataatatataaaactgaagtaattaggagctacgtcaaaaatgtcatctttcttatgtgtaaaaactaggcattttgtagcaaaatagcaatattaataccacagggatactctgtttcttttccactctgacagaaaaatctctagtgataggtcctcaaatcttttatttaaattataagtgagaatgagtttggtgccctcaattagtccttagaggggaaccaatagcacacaagcaggcacacttcttgcaattgcttctgaagagatctgtagctatataggcactcgcaaaggctgtgacccccccggaaggtacacccagtacactcgattcaccagaaagcctacagaatgaatggactcgagattttgcactctggttttatgagtacaagtaatccattgagaaatttttacacccagaccccccagtacttattttctaacgcatttctgcagtgtgttaactgcggcatcatagtgtgctacataatgagtccaattcttcttgtctgtttcttgtttccttctcaatgaaaaataaaaaacaaagatagctgagtttaatattgccaaatagccaaataattagtacaactgaatattattttctctttaagttatacctcaataaatataaagctagaagcatagttttgaaaacaaagttaacagaatattatctaacagcaataatgggtctgaaatgttccatgcaaggaaacataaaatgttaattgcttacgagataacgagacaagagtgtttccctacaatcttgtaactctagaaagatgagcattcttagtctgtgactaattccattgtttattaattccattgttttttaacagtgtaagttggtcaagagcagtggctcacacctgtaatcccagcactttgggaggccaaggtgggaggatcatgaggtcaggagttcaagaccagtctgaccaacagggtgaaaccccgtctctactaaaaatacaaaaaaattagctgggcatggtgacgtgtgcctgtaatcccagctactcaggaggctgaggcaggagaatcgcttgaacttgggaggcaaaggttgcagtgaaccaagattgcgccactgcactccagcctgggggagagagcaagactctgtctcaaaaaaaaaaaaaaaaaaagaaagaaaggaaaaaaaagagtgtaagttaagttttagcagtgttgtgttagagttttcttttataaaggtaaaaaaaacacactgtaaatgtgatttatgagggttacaacattttccaagtttatatcacttccctggttgtgttttattttctcagtgattccattctgtcgagtattgcataagatcaaagtctctctaccagggcacacatgacgtgatcctgtttggaaaacattatcaaacagtcaagctaaaatgcaaatgaacacaaaccctagtattttctcttgacaactgtggaattactaaacataaagacatgaagattgagaaaggaagggagtaaaacaattacatatttaaaaataaggagaaactggattggttttgatgataaatttattggtactacaaaaagctctcatgacaaaataccatacatgtttatacaaagtattattaatgaaagaaatttggtttcagttttatattattacaaggtattttataatctaaatatttcatcatatgtttggccgaatttcaagttacattctcccagcgtgtgttaaaaggaaaaatacaacatgaaaaaacaatattttgagtgggatgtgcaggctgtctgtatgtgacatgtatcacccctcagatcttcagggtctgttccatctgtgtttatttttcctgaagctgtccactcacttgagcaggctgcccttcccagatagagaaaagccagtctttgaaattcactagaattgctgttctcaggatttttatgtttgtcttaattgataaactgccttaagagaaaggatactcaagtttacttcacactgaaatgttctctttaggaaacatacattttggaaaatattaaaaaatactttaccctgactaaaaacaagttaccatatatggtgattttgcatattcaatgttcctgtatattccaagtatacttttagtttatgtgtcaaaattaggtacatctaaatcactggcaaatattctttttcattatgattctaattcttgttccattattataaacatttctatacttttctaatatgctttgctgaaaagaaaataatagatatttgttaaaaatttttctgaacattctgggttgatcctcacatttgattgaacttaagcaatgtaaaataactcgtaattttcctcagctttctaaaaacagagtttggatattgttctaagtgtaaggaaacattgaaaaacataagtatgatatgattcaaattatagttataaatatcactatgactgttgtgaaaataactctggcaggagcaagagttgcaagaggaaaatcagtttgggtatttttgcattagtctaagttagagatgcttttggctttgattgagaaagcagtaatggaggcagtaaaaagtatatatcctaatgtcatataagattacatctagttatattctcgatatcataaagttagtgctacaagatttgctaatgtcatggatgcagggtgtaggaagggagtgatcaggtttgacatctaggtttgtagtctgaggcatcagaatttggtgtttccctttgttgacatgagaaagacagggagcaggtttggaaatgaaagtagtatgtgtgcagaatccatggctctattttgtcaacatcaagtcttggttgcccattagacatctcaagcagtgttgtcaagcagggtgtagggtgtgtcagtctttaattcagatgctttttgaacagtagacaggagtttcagtcattagtatgtaaatagagattaaaggcacatgaaagaatgagatttcttaggggagacacttagggaaaggaagagagctgagaattatgccccagggctctgcaacttctcatgtctgaagaagaggatccagaaaaggagacaaaggaggagtgcccagtgacgtaggaaggaagccagggcactagtgttcaagagctttggttaaaacactgacagggaaggatgataaattggataaggatgaagattaaaaagtgaatattaagtatggcaaagagaaagttattgccaactttgctaaaagtggttttggtggaaaaatagtaaagagagctttattaaatgaggtgaggtgagaaaatgcagacagagagtaaaggcggctttttcatgaggtcttgtagtaagatgctgagaaatagggatgcaggaaaaaagacacagaggagtccagggaggtttgttcatttgtttttgttggttttgttgaatacagttattggaagatgtttgtatgctgatggaagcaacatagtgagacggagaaactgatggagtgggagcaaaattcttgagtaacttagagaggatggaaaccagtgctgaagtacagggtttgaccttaggtaagaaaagggacagtgaatctgctgcaaggagaaaatgcagagctgatgtatgtagatgcaggcagactggtagatttggtggtaaggcagttaggaaactcttttaattgcttcaatgtgcttcagtaaaatgagtcaaaggtcatcaatttaagtgaaaaggtataaagagagttttgaaaaaaaaaatggaaaagtgtatatgaatggagtgacccacaagaatctatttgacattaattttctaataatgatgaccccgatgtgctgctccattaacagggttgtcaagtgttacctatgacctatgaaactcatggaagctggttaggttgagcagcaatgatgttagccaacatagccatttgcttgtaactgttactgcatcagcgtcacgctcttttgaaccaattaaggaaattagattcagagacctgactagcgagaaagcttatttagcatcaattttctgtattggtttcttacgcaacaaagttataatttttctttgtttttaaatgttatcagtaattaaaatgcaacttcagagtgtcctgtcctacacataattagaaattaggacaaagtgttatgtgcaaagatgttaaaacattatttatactgggaaaatataacaacctaactatccaacagtaagagaatagttataatatatccctaggtggtttattttacggtgcttttaagatcagaaaattagttctaaaatgataataatatattaatagttctgtaggaaagaatttaacacaatggcatgcaagacactggctgaaatggcctctgctatctcctcagctcattctctgcccactatcccttgcagattcctctatggcattctactttctgctgtccttcaaaacctccaagcagatccttctctcacttcattttttggtgttattccatctgcctagagccttgtttctcagacctcctcatggccttagacatgagacatgagaaaataagacaactccttatcttcacgtaggtctctggtctacggtcacctcctcaataaggtcttcttagattattctgcctaaaacacgtgctccagatcccactcctattacttgtcttcactgctaatcatggcacttatcatagtctggcattactttttacacttgtttacttgtggaatgtctgtctttcctgtgaaaatggggacttacctcttccatatacgtatcaagaacaatgccagtaggtactcactatatatatatatatgtatataaattatatatatatgtatataaattacatatatatataaattacatttatatatattacataaactaatgaattgataatgcgtcaaaggaatagcattttaatatattctataatgataaaattatactttgatatccacttttgctcacccagaaagttctcacatcatttaggtatcagtaaatgtctaaaaggaagcagtacagactttatacaataaagaacaaaacaaaacaaaaactgaggtagagcagataaaaatcagaaaaggtgctccccattcagctgaagaaactatcagctcacgagaaaatgttgttgaaaccatcattttctccagaaagttaagaggttacagaactcagaaagaagggggaggaagacattttttaaatgaagaaacacagaaattatttgtagtcagaataaacaccagacctctatcaagaacctaatggctcaaaaactcttaatcaagtactgctttaatgttacatagagaatactctctaggttaagcctttgcccttagttctaagagacataatgtctgagggtgcctgcacatagtttacattggagtatgaatagagaatgtaaaagaagattctaatagtaggtagcaggaaaggtcagaaaagcaatgaacagttttgagatttgaagtgtttgtgtgggagaaaggtgcaaagaaattgaaatttaattactctctaattggagatataatgttgcttaaaagaaaaaattacaaatgcacaactctaaaaacccaccctgataaatcacatatcatatccacttcctttcagccacacatacatatgcaaagacatagaaaatgatttcttttcatccaagtgtgattaaatgagatttagaaaatggctacttggtgagatttttgtaaggcactgaaatcaacaatttttatggtaaagaacatatgttggttttgatttattatttattttccagtttgaataatgcaagatgtttttataaaaagttatggggaaatgctaagcagacaaaaaatctcatagtgtgaaatacatgagtacattaaaaaattgcaataaagcctcctgcaaggagaattagcattgagtgtatgcaatatgtattttccccaagcaaatttaatttgatacatattttcaaagtttaaaagttttctctctttattaaatcagagaacatgtgacaagtataaacttccctacatcactgcctttgtttaagcttaccctacagttagaggcccttctcacatccagcctcaatcttccctatccaatataaaacagaataatgtgatgcattttagaattatgtttttataaatttctctactataaatatcatttatctgactttgatttttattctttcttggaaaaatgacataaaaatccatgccatttatgatgtttgcttttatctagatgtatcctaattcataaaaaaaagacgtttcctttaaaattgatctattggttaaattctgaccatactccctacaaatcagcttctggatcaacaaaatattcttgatgaaggaactttggtattgtcagccatgttgatggatgcttggtaaacagcaatatattctatcacccatttaaggtgggtttagagttttctgatctatgggactagcaaaatgttgctttagcaaagactttaatatgccatctagatggaagacatattataataatatcactaaaaatgggtgatatttaatatcagtgcattctttgacattggatattttgaaacaatattctacaaatcttcagatctcaccatttaccattattctcttatttcaatctactatttctttcttccttctttccttccttcctttctttcaacatgtactttttgagaatcaattacatggcctgggcccaaggatcagggcagtaagcaagccagacccaggtttcctagtcatatattctaaagcctagcagagaagacagttaattaaagcataattgcaatggtgtgtgatgggtgtaataatggagcgtgtaccagatggacatagcactgggacttaactgaaatttggggaaagtctccaagaagcaatatttcaaatggtacctaaaggatgagtcagagttagccacagaaaagttggagaagaagaaaataatcctgataaaaagctgagaacttcactggccaggagagcaagagaaagaggaagagaaatgtgaggggtgaggctggaggattaggcaggaattatattattgacagctttgaaaattcaccattgaactttaccatgagaagattgaggtaaatggaatgatttttagcgtggaatgacataaaatagtttgcattttaggaatataactagagtgaccctcttcataattaggttgcaataatttgccttgggagtcctcaatattgcctgccagtaataacaggggtccagaaatccatattctcttcacatgagactccagcctcctttctcttatgtatcttggtctccattaccctccagaatcttaagatctcaagagagaagagttgagctttttgaatcctgccacattgtgtcaaccctgctggctgtgtggataccacctgaactatagaagctgagtgaaatttccagtccctgtgtacactattggtgtcagtgtgacttcttgctccagtattctttacacttactgaaggggcccctgtgaagcaggttcactgtgcacccattatcacttcagcccaatgcactttgggctgcacttttactatttgtctgagtctggtgacagaacactcacactccatgaagtgggcttattacttatagataggcagcaagggacagcaaaagcctaggattcatggtgtgtcatttctcaaggctcaggaaagctacccagggtgtgaagagtctcatctgtgcatgtcctactttcaccacaactgaggcaccctggaaagcagcttgccctgggttttataccctatgggcaacaggatacactggggtaaagcactgaaggacatcctgttcctatgagtgactggagcagagtctttgctatactggcacaggccagtttctccttatttcaggatgttgcattcccagtgtattccacagttattcttaagaattacaagtgagaaagtggggagaattggatcagtccaaggccacccagagaacattcctgcagcacccaagcacactggctaggcccttcaggttaataattttttattttgtcactgcgcttcctccaccagcactggcatcttcctggatggtggggaagagaatgttgaggcagctgcaatttccatggtggtgctacagagttatgggttttgaagttctgttcagttaaagaatgaggactgagagcagtggctcacacctgtagtcccagtactttgggaggctaagactggaggatcacttgaacccaggagtttgagtccagcctgggcaacaacgtaaagagacctgactctacattttttttttttaatagctgggcatggtggtgcaaacctctggtaccagctacttatgaggctgctgtgggaggatgacctgggcccaggagtttgaggttgcagtgagccaagactgtgccactgcactccagcctggacaacagagcgaaaccttgtctcaaaaataaagaaaggaaagaagaggagaggggaggggaggagaggggaggggagggagggagggaggggaggggagggagggagggaagaggaggggagggagggaaaggaggaagggagggaaaggagggaagaggggaggaaggagagaagggagagagaagggaggagaggagagaaaggaggagagaggagaggagagagaaaggagaaaggggagaggagagaaagaagggaggagagaggggagtaaggagagaagggagagagaaaggagagaagggaggaaagaagggaggaaggagggagggagattggttttcttcaacatcccaagttcagcttctcaattctttcatcatttatgtaatgaattccctgccttataaatttagtttctaatagtgcaagtgctttctttttttctgaattggccccgatacaggttttatatgcagtaagaataatggcacagcaattctgtgtgggaaaaaggtgggacagaggcttggaaaaggtctagaagtggaagcttacctgactgcagagccagtactgtatttgattatcatttctatgattacaaaacatctctacagaaggaagtatgtgtgatatcatcttgaaaaatccatcaagagttcagttgtagaactatgatgtcatttgcacatcaggaaagacattttgaaaggaacttggcttacctttgtgaaatgttagtatagccccattatcttgtgcaatcccagtgtcccttacctgagtaatttccttgttagtttgactttttgtgttttcagaaaattaacaaaagttctggaagaaaatgccagaattttcactgagtttaccaaggagaagaggaggggatcaggcactagaagggagggagacttttacttttcatttatataccctttgaaactgcttttacatattttcacgctatgcagttattactcttctaataaaatttcaagaagaaatgtgctccattgttgaatagttagtacaaggatcaacagaagcaaggggcagccaccgcagccacactgcgtcccagctattcagtaacgcagcagtattatgactgaatctcatctgtgagggctgctttctctttgttcatttaggttcgggatttccttaagaagtaactatgctattgtcaagatgctgaggttgaaagaatctcccctgcaattcagtgtatatacagcacaatgttagagcattttagcagcaagacaatatttcctagggactatatttcatgtctcacttcttcacatgtagatgtgcccatataaatagttctcaccagtggaatactagcagacataatgtgtgtcatttctgggaaattgatttttaagaattgagtgtgccatccaggatctgtctccttcaactggctggatgtagacaacctgatgaggtcttaaggaggatagaaaagcaagggctggaagaagccaggatctttggatcattgtatggagcagtggtgcaagaagtctcatctggaaactcttggggaaccctgatactctttggagggtctgtgaagtcagaagtatttgtctaatgacatcaagaaaatcagagatattagcagatgtgactttttgatattgtataattaaataaggtaacatttgggagatctgtataacttggcaaaccaatattttccaaatgaccaagacgtgacatagaaatcatctgaggataaaagattcatttgaagttcaagatacaccaatggatttcagtttaaaataccatgaaaagctcattgatatggcccagattccacattgcaagtaacctttaaaagactaccacttgtatcgaagtgtaacttcaaagaagactatctactattatttgaaacattcacaaatgtctggaaggactacgaaattgctcttccctttacttagtatatttccctataagaccagatgcaaatatgtatatattagaaccaaagcaagatgtgacaaaagtataatgaaaaagcatatatgaaatccaactgtcttctattaagctatagacattatagaggtttataaaaatgtaaagcagtgtcactcttctcactaaaatttgtttgaaaatatgtagttttttctaatcaagtgcattacttatgttaacatagcagagttattactacttttaaagaaattagtaaatattttaaatttgttttaatttttatatctataaatattcatagctatcacagaagtaaatcaaaacttttacagttctcagtaatatttaagagtgtaaactggtcttgagataaaataaaaagtgttgagaaccatttatttggaagaaagccatttgcttagtaagaaccaatgtatgagaaataaactccattgagtttaggcactttgtattttgaggcctgcgtgttacagcccttaactataacctaactaatgcaaacccctgggatagctttccagcacctaaaagtgagctatacgtttcatcgaacttctctataacactgaattgtagacttgaatatcttctcgtctacagttaaggagaagacagtacatggagactgaataataaagattagccaaatataaaaggttttgagaacttttaaaaatggaagtttcttgtattctttaatgacaaaataatttaatttctactaaacactgatcaggaatcacaatttgtaaatgttacttttaagcaaaacatgagtatttgtgtataatgcattatttgattctaagcttctcagtgctttagtatgaaagcacacattttgtgttaaagcctaactttaaggcaatgaaaataatatcttctctttgtttcctgtcacatcaaacaaattgatcactttatttactatagtaaacagtgcaaccaaaatggtgtatttgtatttagaggtatctgggagtttagatggtttttaggaacagtatttctttttctctcattgttagatttattattgaggtaatgcaattacccattttttttgcattcatataaaacatgtaagacagatgttttactgtaatcctatatccaatcaatatattatttaaaagactactgagtagaaagaggaaaatgcagtttatattgtttacatccttgatgcacacatcctttctgagaggagaaaaaaggagaaaggagaaattgatttatgaacaatctatattttattcattttccaacttttctctttatatccatcataaatgaaatcagcaacagtcaggcacctagacaaattgaaacaaatgcgagctaaaactctgatgggcccagtcccattctggtagagttctgtgtaatgtgttcctggattgcaagtttgatcttgaagatattctatgataggccttttccaatctgctcaagctacacaatattggggtagttcctgtcctctaattctctgccagattgtcatagctaatggcagacaatgtaaaagcaaggaagtttggtggagctgtgagattttgctatcctcaactatatcccacatacaaagtaagcagaagaaaacagtaccccaaaatctattaaagggaacaaaacatgctatataattaatgcactgtctcaaggtgaggtctaacatttattttgttacaggtttcagacttgtttaaattcatcttgccaagttcagtttatttgtggtgacaatttaatcacaaatgtttgatacccttaactattgtgagagaaagagaaggagaaacaaaattacatccgttaccatggcatcatgatatctgttagttttctggcctgtgcctgaaaccatccaaagtggcttatatgtttcacaagttactggtccttaccacagtcaaggaggtaaatgctattttcctcctcacttttcaaatcaggaaagcaagcatagcggttagcattttttctgtactgcttcactttaattatgttgttcctccaatagtgtcaccattcatccagtttctaaaaccagaaactggggaatccactaggatttctcccccaggcaccctttcctttaacaagccatgttaattttacctcgctagtgtctttgctagaaataatatccatcctcacagttgctggctgacatcaattatcaactcttggctgacccacagataaacttttccaaaccatcttcccagagtttgactctctccaatccatttttttgacactggaaacagggtgatctttctaaaagggcagattgtataaggtcacttacccaccagaaacacttcagtggcttcctgtaagctacggaataaaatcaaacatctagcttggtatataaggcctggcacaattgacctctgcctaactatctctttcttccctcacctcccacagctccttgaacctatacccctgacacactggattggatctggtgggcatgctcttgtggccacacacgtgctgttccctcagcctggcagagtgttccttcattcttactgaccttggataaactccatttacacacacactcagctccaatgccaatctcaaggaagttttctctccacttctgtactagcacctatcatgtacttatctctgttattttgttttcatcactctgtcttccatacctggacttgttaggaaaagcttggacaatcagctagcttggctttaaacctttgttttcattgttctgtattccatacctggacttgttaggaaaagcttggaccatcaactagcttggctttaaatcttggctcttcctgaatgatcttacatttctctgtttctctgactctcagtctctccattagggaaataagaatattaattatacctacattagacaatgcaaatatgagttgatatcagaggagtaccattcttagctatgggctcatatagtgtaagtattcaataaacattaattatcagtattagccattctctaggaacataatagaaatactgctatcccaaagagttgtcttcgttgtacttatcactctctgaaattatcttgtttatataagttaattatctgtctccccagacctggaaagtaagattcatgagaacagtgaacttggtaatgaacttggtaaccttgttcgctattgttcttatcacccgatataccatgggaagtcaatatgttatctgagttaatgaatatatttagtagaatattgcagcaatctaaaaaagctgacatgagcaaggagttgagaagtattcaagcaggatcaaagacagattgaactattgcacaggattactctatatcatcttcaccaagaataagtggggtgatgtaggactttttgagaccgcattgataatttgatgccacttaataattaaattatgtgctttatcaagacacaatggattgtccctattaatcacaaaaattattgagatgagcaaggcctaatacttatggcttgtatttgcttgtgatacacaattgcttacaatagtttgactctcttgcacactttctgtttttttgagacagggtctttatttgtcacctatgctggagtgcagtggcatgattatggctcactgcagcctcagcctcaacctcctgggttcaagcgatccttctcacttcagcctcctgggtaggaaggaccacaggcatgtgtaaacacacccagctagttcttgtatttttttgcggggttttgccatgttgcccaggctgctctgaaactcctgggctcaaatgatccacccgcttcagcctcctaaagtgctgggattaaaggcttgagccactctgcccgtctcttttactcactttttaaattaacgcagtcaattccttttaacttgctttctaactataagccattgatgttactgaatggccatgaatcattaatttcacttttgctgaccatttaaaataatatccctgaaattgcaagaatagattccaaatgagaaaatagctgcagaaaaatagtatcatggtgccaaaagtctcgccaagttaagtcacgtgtcacaaatggaaaaagctcaacacctgaatatattttcttttagccagctatgaggtataaaaagttctgttggacatttaaaggccaattggagggcaatgccatcagcaggactgggcatgtcagggagatggacgaggtgccttgagaagctgtgaaaggagaaacaggagtctcttagccactggcagccctctcataatttcttgagactgcttatagacctgttgggaggcttctcccctctaatgtcattctctactaatgcagccaatctccacctcagcaatgcacgattataaccaccccaaatgcacgattataaccacccctagatctttttaaacataaagatcaccaggatctggccccgactcactgaatcggtgtctcttaaaactggaaatttgaatttttaattctgtatatccacaatgatcataaatccttgtttgcccagttcagtctgggtcttcacttgttcttccactataattcattccaaaaaagctctgtgtttggacaataaattatgtgttcaccttacctataggtgaacacatctatctttatgttctataggtgaacatatctatctcatgagtagccaagatctaccccctctcaaatgctgtttctcatatttatgctacatatttatggagttcttgctaaaatcttccactgatacatgtacatactcatatatatgtagttacttcaaaaaagttcatgaaaaatagaacaaaaagataaaaataaaaaatatagactttatttctcagcataatctccatcaagtttaagacacttatgtaagcaatgatatcagccatttagcccatttctaaagaactgggggtcctgggaatataatcagtcaatgcagtcttttttacattattaattgaagaaaaatgggtgtcctttaaagattttttaagattagaaaacagaaagaagtcagaaggagccaagtcgggactgtaagatggatgcctaatgatttcccgttggaaatcttgcaaaattggccttgtttgatgaaagaaatgaacacctgtcgaggtagagaagtactcgctggtaacgccttcctggatgtttttctgataaaacttggctaactttctcaaaacactcttataataagcaggtgttatcattcaatagctttccagaaggcaaaaaacaaaatgcttgagcatcccataaaaccgttgccatgacatttactgttgactggttcactgttgctttgactggaccacttccacctcttggtaaccattgctctgattgtgctttgccttcaggatcatactgctaaagctaaagttcatctcctgttacaaatgtttgaagaaatacttcaggatcttcattccacttgtttataatttccattgaaagctctgctcttgtctgcagctgatccgggcgcaatggttttggcattcactgagtggaaaattggcttagctttaatttttcagtcagaattgtataagctgagtcaattgagatgtctgtggtgttggcttttgtttgtgctgttaattgccaatcctcttcaattagggcatggacaagataaattctcttctcacaaatctacctggatggtctgctgctgcaggcttcatcttcaatatcatctcatcccttcccaaaacaagttatttatttgtaaactattgatttctttgggccattgtccccctaaaccttttgtaacacatcaatgattttacaattcttctacccatgctttaccatacatttgatgtttgttcttgcttcagttttagcagaattcatgttgctctacttggggctcttttcaaactaatttcttattcttcttagtgcctcagagtagatccttttcatacatgtcctaagttaatgtgagtttattttggctcaacaactttgaaatccatgcatagtgttttgaaaacatgcattttccatgaactttttgaaaacttgtataaaatatatgagtgtacacttacatgtatgcatatacatacatacatttatatctttttaaagttgattttacaatagaaaaatgataagcaagcagtgacatcatgtgtctttagtcttctattctgtaaaaaaagtttggacctaattaaaggttttttttttttttttaatcactgtacttcttgcaaagtgtgtgaaagaacctccttgccccattgcatgaaactgaattcacaaactgaactacttcagaatatttagctcttgctcctagtcatataaacaaagcatcagactcaaaggcaaagaaatagtatgccaatgcctggctgattacctgtcatcctcttatctatcattttatgtccagaaaacaacagcattaggtgaagcttgaaatgacaaaatgatccgcatgataaccaaagcatatgagtaacaaaattccagtctaatgtttgtgtatagcttttgtgtttgcaaaattggatttttttcaaatccagcgtgctaccagctaaatctatagactgatggtttaatctatacaaatcagaataagaatacctatttttcgccttttaaagatgaactagtttgtttctaaaagctatgacctcagagaaaagttaatataatctgtgccttgtatatctctgcatctgtactccaggcccagtctgagacctaattggtagtcaagaaatactagccaaattaagatgaataatttaaaaggcaaatggaaacagcactgttctatgtgggtagttctcgactagaggcaatcttgcctctcagttgatacttggtaatttctggagacatttttggttgttataaggagaaggtgctactatcatgtagtgaataaagacctggaatgctgttaaatatcgcccaatgcacagaagagccctaataacacaaaattatctagcccgaaatgtcaacagttccaaggttcagagattctgctctggttcaataccctagatctagactacttccacattttttaacctgaattattaattttacaaaaaaaaaaccctgcttaccctcttgttactattggataaagatcaatttcattgacttggacatcaggacactgttaggtttatttattataccctttctattcactattatgtcctatttattactcaggctagaaacctctacggtggtggttctctgtaacacactcacctggacagcttgttaaaacaaatgtttctggggttctttctcagagtctttgatttaactggtctggggtaaggactggtaatgctgatgctgctggcccatgtgccccactttgaaaaacactgatctacagtaatgtaatctacctcttcatattccccaaattatttcactcctccccttcttccaggttatttgtaatgcagacctcctacttccttttataaatacaatcaattttcattatttgagggttctatattttcaaatttacttaataaaattttctatagcctcagaattaatactcacggtgatttaatgatcattagtggacatatgcaaagcaaagaaaaatttgagccttttaatgcacacgttcttagctgaggttgaacaaagagatgctctgccttcttattttggctctcatattgtgaacaagtatgccttgtatagtctatttagtgccatttttggcatttttatgctttttttgtcagtgattttcctgattaaaatggactccaagcatagtgctaaagtactgactactgtttcaaagtacaaaaaggctgtgatgtgcctttcagaaaacacgtatgtgtttataagctttatttaagcatgaatgatagtgctgttggctattacgtcaatgttaataaataaataatatgtattaaataaggtgtctgtaaacagaatcacacataatacaaaattatatattgatgaattcacctaaatgttgtaaccagaggcttataggaacctaacactgtatttcccctaggaacaatggttcagtattcactaattcagtgtttgctgtgactttatacacaacattattggaatgagacttaagaactgactgtaaataaatctttctcacccacctcccactactttttctaactgccctgtctcccacagggcttcctttcttcctattaaatagctcctcctatctgcaatttaaaaattctgcctcagcaatgctggtgttatttcataatgccctgctgggttgagtttgtatttgatattgtttggtttattctgtgttaagcataatgttgggtacttgataagggtttactaaatattactgaataagttaattcaaatgcaaatatgttatctcagtggagggacattgcaatgttagcaaggattctttttctaatctcttggaacctaataaagccctgaggaaatagactaccttacaagtcagtgttaagaaaaggtaagatatgaaatgattttttttcccaaaaggtcaaaactgttagatcctcaccctctttctctctatctttctctctcctttcctcatctctgtgtacatttgtgtgtgtgtgtgtgtgtgtgtgtgtgtgtgtgtgggtttgaatctgtgactgtagaaaagaaaataaaagataatttattggcatgttagaaaaggaaaaaaatagacatgacagtaattgctgaacaatgcacccatttccattccctatccgtggcctcacttttgaccccagagtagaaaactcttaggtagatattgcttgttgaagagggcatggaaatggatattcctgggccattaacaagctgtgtgtgagtccccatcttttatcctgaagatatctgaaggcttaggttatgttagcacactcagcctgacaagatacagtagacttaataggtattccaaagctctgaaaaggtacagtgttctttcgtctttgctgccagtgcaaagtggtttttctctagtccttttctagcaaagctctcaagctctcctcctatcaacaactcaaaggcgggtgggtgaggagttacttttcattagtatatttccacctaagactgaagcaggggattttaacaaacgtttcttatttgaggtacagcagcactcagggagcttgggacatggctgtttactaaccattctggaactatttcaatactctagcaattaggcaggctgaagcaaacaagctcgagatcagctatgaagacaagtttactgaatgagaacattattctgtcttaataacgttaaccagtagaaaactggcttttattgcttaatatgctatctgaacactatctggcatgtgtcttttccaaaggaagaaataccatctgcagatgaagatttgtaatacagaaaaatacctggttcctattttctgtaccaatttgaaggttagagatacatgaacagagttcaaagaaatattgactacagaatagattaggaaaagtccagtgatttgcaaggaagatgaacatatgagatctacctatggggctttcccttcttaccttgcccagaaaataatgataggtttctctgtctacctcagcacccatctgtgaactggtggaaggagccatgtttatcaaacagagagtggaagaaagcaccagaactgcaaatccagaatttcagtctacagagtaaggaagggacaaggctggccctgcatctattcctgtagaccctgcaatgccaggggatatagcacaaggccattgtaagttccatgaggaactaggaaagagaaaaaaaaaagagaagcatctaaaaatatgttaaaagttcacatttctggtgctgttttggacattttttatgggaaagttctttgtaagtaatacaatatctttgaaagaaatttttgctttcttgccctggtttccatgagatgaataactatatttccataacctgtgcatagatgtggatgattaacaaatacacattgaatggttaaagccttgctatccaggataaaatgatccaaacatgaatgcttactgagtagtatcaggtaaagctccaagtcagtacaagtctacagtgaagaaagatgtggtaaaaattattcttgtcacaaacttacctgtcagctgatgaagtgatgtttatatgtgtgggcaaaaggggttagcaggtgtctgtaatcactctgtcctcttgcctttttgttttcttaatctgtcagtggcaatttggtatgataggaccttttgaagtccagggctgtgcctctcttgttcaccagggcctgacacagagtagctgctcaataaatatttgttcagtgaatgaggagccctttaacaattgggaacatatacctctacagagcagtggactctgaatccattctgagatcgcttctgcttccttgcctcttaaaatccaaaagagtcagaacacacaaagagagctctccatcaagtaaaaatcccccagtgacaacagagtctaaggttaaatataatttttcaagttgtcttctaagattcagagttctcagtttcaactcactattcccagaggatgttcaaagaccaggaaataatgtgaaaagaccgagtctatttataaattacttttggtggtgctcaaaacttgaacttcttgtgatcttatgaactcttcgacttccctgtcccataccctactatccttccccctacctaagtcagagtgtggacttcatggattctattggttactaatctctgctgagcaactcagcacttctggttgtttgtatgaaactggaatctccaggtaaagagtaatttgtcttgttacttgatgccaaacaatgaattcacctgatataacacattcattgaatatctatgcttctttatacaggcagaactcaaggcaatgtatctattatataaatgatatttttcgttccttttctaatatcactattatatatttttttcctgaatcaaaagtgcttttaaaaactggaaaatttgttggatatcttttttatttctcattgtttttaaaataattagatcttattcagggcagccaaattcttaaaatggtagttcacacaaactgtaagctttgtaaggcccgtattttattggtttactgtaatattcagtacctaataccatgctatggccatagtaagtactcaatagctatttgctgaattaacaaataaatgtcctttgtgacgtttttcacttcctccattacttcttagctacaggcacagagcaataaattggttagaaataacccttaaggtttttaaatcataagcaaagcagagattaattctagaaatatcagatgaggacttttccagcagaggtcatagtgagaagtgtgtgtgtgtgcgcttgtgtgtatttgccctgagccgaagaaaagtttagggctatgctagactgtagcagttgccattgaaaaagctgtggaagcacgctcactacagttggttatttcgtagttttgttccagttgtacataaaaagtgtatttatgatagaaaaaaatacaattcttccttctattgatttttgaagggtagaacaatttaaaagttgctgcatttgacagcaatgccagaaatataaattttataaataattcagtgaaaggctggaggtcttatctcatgtaataaggtctctggtctatgatcaatcacctacttgggacaatatgctcctagttttttcttattttctcattctcctgaaagcttgctacttggcacccttgagcccaggattttgaggctgctgtaagctgtgattgcacccctgcactccagcctggatgacagagtgagactctgtctttaaaacaaataaatacataaatacagtttgatctacatccctttccttttggactgtgtttcttgtcagattgttgttatataagtaaaatcaagaagttatagttggagacagctgtggctcagtagaaactctttggggctaaaagtaaggaaatccaggtttagtctgagtctttcacgtgagcaagaaagaagacttacatttaagtgtgtgaaattaacttttaactataaaatactacagagatattcattagcatcatcgttacacaatggcccaatacgtaagatgcaactataaactgatgagaataattattcatgtcacttatagaattttttttttttggaaatttctcatgtaatgtctcttaagtgatatgtgtacattaacaagactgtgagtagtggaaagaattagaatcagaagacctggtttctaatgctggcaatactgtttgctagttttatgatacagacaaacgcttcttctctctaaagttaatagattcatttatgtaattaagacaaaaataatagagcattgctgaaatactgagtgacggttaaaaagcattctattactaatgaagaattaaaaggatgaatcataataaaatgccaggtactggtacagatggtgaggagccgagtctcaaaacctcaccccctgactccagacaccctatacccagcaagcagctactgtcagttccaccctggaacctagtgttagtcatgcatgcgtaatggctgtataaatatacttgtatgaccacaaaaggaaccatgttttatgtgcatgcgcattatatgccactcagttagaattctgtgaactgtttcatttaattctcactacaaacttcaaaaatagatactatttccccaccttttacaagtgagggaatgaagaccaaaagaagtaaaatccattgattaaagttacacagtttctaggcagcaaagaaagagttgaatcccagacttattgagtttaaagtctatgatgtcacctagtatactcaggccctaagcacctaagagtgtctgcagagatctggacatctgttctgggtataatacttgcattgtctaatattttaaggccatgtatttatttactgcatagatttcctctttattttatttgtatttttcatgagtcattactctgcacaaatgactttgggcaaatcatgtgaaaaaaattgggctccatgagatcatctataaaatggctgggttatgttttctccagcttttgtagttctgtaattctgttaagggagtttgataagcacactttctcaatgtcttcactctttttcttggcttcctttaacagcataatactataggatcaaaaagaaaaaagtaaaacatgacctcctaataatgcatggcccttgtattagtcagggttttccagaaaaacagaatcaatatgagatagatagatagatagatagatagatagatagatagatagatagatagattagatagatacagacagacagatagatacatagacagtataagaaattgactcatgtaattatagaggatagaagtcccaatatctgcagtctgcaggttcaagactaagaagagccagtatttcagtccaaacccaaatggcagaaaaaaaaaaaaaaacagtgtcccaggtcagcggtcagaaggaggaattcagcctttttgttctattcaggtttgcaattgcttagatgaagcccgcctatgtaagagagcaaaatatgctttactcagtctatgaattcaaatgctaatctcatccacaaacacccataatagtgtttgaccaaatgtctgaagatctctcggcccagtcaaattaacatataaagttaaccatcacacccccagaagattgtgcttcattgctcagaaaagcttttcttggccatgcggtgaaggcatggggaaaaagagtgataatatgggcttggacttcctgaacatcgtcagtcaggtctctctaatctctttccagagagccagaataagacctgtaagtgagttaacattgaagatgatttataatacctcctctgtatataattaaaaatagacaaaattaaacataaaataggtacaaagtaattgaaataaatcttctcatgaatattttaatacttcaaatttgaaggtaccccctttttcctgatgttctcaatatgcttgccaacactgtcctattcccacaggatgaacatccaaactccatccaagtcataggtgattccagagagaaatcttctatgaaattcttccatctgtcatattttgaattttgcatttttaccttttatactgaaaattattcctgttatttcatttaccaaatagtgtattctttatttatggttataagtggatatcatagatacacttataacaagttactaacaacattaaaacccataaattaatctcattcagtggtaaacacataatgttgcattctagttttccaaaagagataaaagaaatggttaataaaattgagatactcatggatgtctctaataccagctgacttggaaaggtaaacatctcagtcacaactgaaacttagcatgtgagttagaggaatgtaatattaaattcctctcttaaacccttcagatcattatccccatttcacttttaggtaaagtaacatcagtgatgtttttcatttgattatttctttgattacattcataaatagaatggcaatggatatgtccagtgtggaagcatttgaataaatagttgctgaaattgctttataggaaaatagatctagtatcattccatgctgaaaatattgttatatgtcctatacagagtctcggagtaataagtatcatttagtcttgtggtgatatatttgctcatttattctttaactgtgttcaacaaatacttattgagtgaccactgtgtgctaagcctctaggctctggggctacatcagtgaacaaaacatacaaaacctctgccctcaggagcttataatctggtataacttccatggtactttgcatttatatatacatatctccaggtgccctcagtccagggagaaggcactactggtttgttctctaggactttatcttattaaacagatgaggttaaaaacactctaccactcaaaatgaaacaatgggtatctcccaatacatggtaagatgccatgggcatcgcaagatttaataatatttaataatttaataataaattgttactattagaatagaatatgaaagggggaaagataataccaagatgtgaagaataaatttttcaagcaaagagagtggctgggaatgagagaggaattgatacaataaaatgggtaccaaaaaaacacaaaaggaataatgaataagacctgctatttgattaaaaaaaaaaaaaagaaaagaaaaaaagagattcaatgaggcttggaaaaagtctgtcacctagatttgatgaagggcatcggctgactagtagagatacataaggggaatagttttaatgaaacacgatgagtcagaactgtgatttcagtcatgtcattctgccttacttaaagggaagaaggtctagaatcagagttgctgatggagagtatgtttcagcaattcaggccagagatcattaagaatgtgtatagatggaaaggaataaataactattacagatattgttgaattagaattatgtgtgggagagtgggaggtgtatgaggcatcaaagatgaccaaaaacttgcttctgatgcatcaaagatagtggcatttcccacagtgatggaaaggttacatttaaaagatgaattctatttgtttaaatttatttttaactttaatacaggcattatttagtctttcttatggagaagtattaattatcatcagaacattagaactttatgatttttgtaagttgtggtgaaaatacaaaaaggcattagagaatgattttacttttttatctggaaaaggaacagttaactgttttattaacagtagtggttgatacttccatagatctgataaaataaatatgggcctttgatttttattcatatctctgatataattatttaatatatccctaaatataactctaaatacacataataaagaaaattataatgatggttttaacatttatagtgtagtgttcctgctttgaaattttgctcaaagaaattaacagtttgtataaattgcattgtaatttaaataatataaataaatgtaattataatttttcagtaatttctgataattatttacttttttctagaacacattatggtagaattcaattcaaacatattcagtgcttaccaataatgatgacgtctaagaacaacgataatataattactccaaataatagctaacaattgtgtacattcactgtgtacctaccattgggctgttttacctcatttaataatagatgattgtccctgctttattgattgagatactgtgtcacagagagttttttttttttaattataaccaggtttgcattaagccagattttgaacccaacaatttcaaccaatatgttatgcaatactagagtgggcgttgaaatgtggaaaaaaaagaatttaaaaaaaaactgtttaaattgtatacatttgaaattgttttctcatggaaatttgtccttatccatataacaagcatgtcaggtagtcaggtgttattatctccgtttcaaaccagaaaacctggctcaggaagattaacgaattgtgaaagtcaaaactgtttttcagtggtcaagagggaattttaatgctctttatattttgattttaaaattagattagcttcattggaagaagaatggcctgaagtggacctaaagccaggttctcagagtttatggtgcttaaaaattcctagggaatttatttaaaatgaagatacccggggccgggcgtggtggctcacacctgtaatcccagcactttgggaggccgaggcgggcggatcacgaggtcaggagatcgagaccatcctcgctaacacggtgaaaccccatctgtactaaaactacaaaaaattagccgggcgtggttgcgggcacctgtagtcccagctactcgggaggctgaggcaggagaatggcctgaacctgggaggcggagcttgcagtgagccgagatcgcgccactgcactccagcctgggtgacagagagagactgcatctcaaaaaaaaaaaaaaaaaaaaaaaaaaaaaagatgagcccaaattacagaatctcaaatctcatttgccttttgacaaaataccacttcacaggtagaatttaagtgggctgagacgatggcaggattccatttgactgaaggcacaaaagtggaaatcctaaggtaggttgaagaaatcagacaaattgatggaacagaggttttgcagaggtgagaatgaaaggtatgatggaaaataggctagaattagtctatggagatccaaattgcaagctcatactcacatctaatatgtttatagttcactcataggcttgagaaggcctgaaaaagttttgaacatgttaagtgtattatgatgattaaaactacaggtggtatgaagaacggcttatagaggcaatttaaaattgtgcagttttaagagaaatgttatcaacctaaggtgagtacggtgttacaattggtaatgaatggaatggaaaagacataatcaagcctactagttgattagtcagaaattaagtacaaaaaatagtagaaaaacaaatgcaatgagctttttaagtttgagactaagtatatactccagagggggaagatatttgaaaattatccccatcctgtttcaaatttctgaaaaatgtcaacagcaattatttcttttgccttgattttatttatttatttagagacagagtctccctctcttgcccaggatggagtggagtggtgtgatattggcttattgcaacctctgcctctcaggttcaagtgattctcttgcctcattatcctgagtagctgggattacaggcacgcacccccacacctgactaatttttgtatttttagtagagacagggtttcaccatgttggccaggctggtcttgaactcctgacctcaagtgatccacctaccttggactcccaaaatgctgtgattacaagcatgagccaccaggcttggcctttatttttaaaatctgtttttattttaggttttacttattttcaagtttatgatactcatgaggcttagcagatctctactttgggatgggtttggttcacctagtagttttggaatttctaataattgagggtcaattatttggattcttggttcttcttcactagattatcttcctctgtggccaaggggccccacaacatctacaggctacattaagaaataagagtttgtagggttagagaaacctctaacactcatagagcctttttgtgaaattcaagtttccatgggtgaaaactcccatgtggcctacagatgacaggtgttcagggggtagcataagggtttgagttgggtggcggtgagtcaggcaggcagaacattccagaaacacactgcaaattttggcaagttgtgtctctcatagtatctgtctgcttaagtgccaccaacaaacacagattccttagcgaagcagaggatagaattaaaagaagaacagccggctttggccaagtattaggtacaattaatggtttccgctttataaaaattgttcctgacaaatgctggtagacaagggatcattagggagacaaacagcatcctggggccacagtaatacaaaaattgctggtgacgatcagtgaattcatttatttatgcttttactatttctatgaatgaatgataaacatttagagaaaagaaaaacaaggatgtttttacaggagctttaggaagaagaatgcttcctcctatttgataaaaataaattagagactatgtgagataaattggacttcaccagagccattatatttttcttcctaattgactgcactgaggcaagcagaacattcgcgacttaattatgcatacttctgagggtgccatcagacaggtcagtggttctcaaatctgccacacattagaatctcctgcggatctttaaaaatgcctgggccacaccccaagagaacctaatttaattagtctgagctagatttaggctatggatttttttttaaacttaagttgccaattgattttagtacgcagccagagttgaaaaccactgagagagataagtgtcagcacttcagtgctcactggcagaaaaccacgtttttcatagaaccagtgactcctccaaatatagagcaaaatgcacagtaagagtggaaaaattgggaaaaggaactggattctatctatatatttttttaatttgtaaggttctgttacttggcttgatatagtcacaagcaaagagaaatacttggcatgctgtgaatttggcctaggcagcagtactcaatatcctggcaggagagaaaactccctaatttgagtgtctgctgtacaccaagtttccattatatcaatattcctatttctttcttttttctcttcaaaaaagaagattctaaaatgcctgtaaacatttttaaattatttttattttaatatatagtatagcactttcacacttcaaacagaagtatgaaaatgtgcatgaaacaaagcaaattcttgtgtaaacactgtgcaggtcaagaaatggaagacaggtggcatcccagaacccttccatgctcactctcctaatcagtacactattatcctgatttttatggtcacacctatttttctttattaatatttccatataaattaaagaagcattgctaaatgttagagttttgctcaaattttccttttaaaaattatgtaaatggaatcttacagtatgtacccttttatgtctggcttctttcaaatgtcattatgcttgtttgacacaatgcattggtctgttatttttgttgctgtaaaatcttacatttttaaaaatattacaaaatatgtatcccttttgctgtcagtatatatgagatagtgcttttatttattattaccaaaaagagtaccaataaattatgtacctgtctctcagtacacatttctgaggagtatataatcttagagtgaaattgctgggaaggtatgggtacttctaatttagacgataatgacattttccccccaattttttgtgctaatgtatactcctacaagcaatatttgagcattcctgctgctctacatcaggagtctgcaaactatggctcgccatccaaatccagcctgccactgatatttaaaagtaagattgttttggaacacagctgtgtcccttcatttacccattgtctctagatgcttttgggggacagcagcagagttgaatacttgtgacagagaccatatagccttcaatacctgaaatacttactccttgacacttcacggaaaaagtttaccaacctctgctctacagcatagctcactcttggtgtggtcaggctttttccatgttgccatttctgctgcatatgttgtgtaatttccttgtggattgtttgcattttcctgattactcgtgatgcataacaccttttttgtatattttttggccatttggatatcttcatttcatgaaacctcttgatcatttttctattgggtttttgtcatttttgtattcagtgctttataaaatctggttttgaactccctgctgggtatacaactattatttactcccactttgtggcttacctttttattctcctaatgatgtcttttgataaatggaacttctattttttgatgtagtcaaatttaagattttatttttggatatagcattttgtgtcctgtttaagtaatcattctttatcctaaataataaatactctcctgtactcccaaataataaatactatcttacaaatctttccaggggacatttgttaatgtctgtggacatgtttggttgccacagctgaggttgtgctactaacatttcgtgtgtagagaccagggattctgctaaatgtcctacaatgaacaggacagcccccaccccaccaagacttacctgaccacaaatgtcagtagcactgctgttaagaaacctggacctaaaagatttattgacttacctttcacattatgatgtgtaatctaatagaagtcgataaatctatagtaagttggttttatgagtggcgtgaagtaggattcaagtttcacttttttctgtatgcatatttgactgcctcagtaccatgtcctgaaacaaccatcctttcccgttacatctgtgttgtgataagtcaagtgttcctatatacaaagttctctgggctttccatacgatttaactgttctatttgtctatcctcatgccaaacactttcttttaaatattacagctttatataaggtcttgatataaatagagcatttagtctcaacatattcttactggataaagaaaatgtggtacatgtgcaccatgtggctgtgcagccacacacacacaaaacaaacaatgtcatgtcctttgcagcaacatggatgaagctggaggtcatgatcctaagcaaactaacgccggaacagaaaagcacatactgcatgttctcacttataagtgggagctaaatattgagtacctatagacacaaagaagggagtaacagacactgggccatacttgagggtggtggatacaaggaaggtaaaggtggaaaaactacctatcgggcaccatgcttattacctggggcacaaaataatctgtacaccaaatccttgtgacatgcaatttacctatataacaaacctgcacctatacccacgaacctaaaataaaagttaaaaaaaattatttctcaagagcttgactcttcttggtccttgcattgtctataagttatagaatcaggttggtaaatgtatacaaaatcatcttatttttgtatcagaattacgttgattcatttgttagaataaaattgttatttttagaatattgaaactttaaatgcataaatatggcatgtctccttaggtaatatttcttttcaattttctattttccgttttatagtctaaacatctagtttcatattttatgcatattttacattttgatgctaaacgttctcttttaaattccatttttaaattatttctatatagagatatcaatttgattttttgtgtattgacattatatccagcaacatttctaaatttactaattctaataaattacatatacattcataatcatattgtctctgaaaagcaacatttctttctctctttccctccccagttccagtagcttttacttccttttaccccccttacttcgctggttaggagttattctccaaagttatttcagcatagtcaatcacatttaagcagtgaatatactgtcaaaagtattgtagtggcaatgattatatacatttttctgagcaattttttattcaacaattatttaatgggcatccactatgtgctaagaattttgctagacactagtaaaattagagtgaacaagtcataatctggacacagggagtttatgttttagtgggaggagagaaatcaaaaacagataaattagaaaaaattagttgctccatgccatatacattcttctgaccttgcctttagtttactaatttttatctcaattgtatagtatgctgttaaacacatcctttgaattattaagatgggtaaccatatttttcagttctagaatttcaatttagttcaaatctgttctttcttttatagtttccatttctttagcagaattcataattatgtattttatttctcaagttattttaaagcctatgcaagttaacttttctatctaaagcacctatgtgtgtgtttttattttctatatttatatttattcttgtctgccttcttttataactggttatattttaatatatatgagatatgtatctgaaaatattgtgtagaaataagctgagtcttaggataatttttatcatccttcatcgtggatgtttatttaagtctgttgcttgcctgggggtgctgcaagtttgaatcacctttattcatttccaggcgtggagatgattggaagataggaggatttctctacttctgattaactgttattctcgtggagggggagtcgtctcaggtcccaacccaaaagagagagggttcaccagggatcactttttgttgattcctgagcatcattcactatgccctagccaagagaagctgccaatgtttcctctcagcagccttgtcaggaatcaataaatactgccagaagaacagtggcaccacctccctgagtttctttccttctccaaatcctaaaccagtaatccttccctatgttgtcagatctccacttccttcagatgcttttagaatttattctgcttttttagaggcactcagtaaaagagttggctagagttacctagttcactattactggaagggaagtcttaatgatttttttttaatgtaaacgactaaagagtaatggaattaaaaattctcaaaacacttattttttgaatattttatgtatactttaaagttacaaactatgcatatatgcatatttttgaccctattacatttacatagatttaagttagaatttaagatatgtttgtttactatatcattaaaatataaatcttgtatcttaaatttaccaagagattctttttattcatttcattctcaaatgaaatatacttaatacagaaattattaatatcatgtagtctgtatcttcccattgcaatgttaacataaaacccaggatcttctcttttttgttgactcttatacctcagtacctagtgaagtgtctggcccacattagagaagcaaacgaatctttgctgagtgaatgaatgccgtgtacaaactatttgcttctatagtagtgtccactgcactacttttgacaacttacctgttcagtaaaaatggttgcagatcagattggaagaattttctaacataaagtattaaacatagtcgagtgttagaccatttttcatgatttactgggtactaagtttttgcaaatatgttttgtaagcctaaaattttgcaaaatatggtaaaaccacaaataatctcaataatacttagattcttgatagaaaacaagaaaagtttttgcagaaaatttgtggataattaccatgagtctaagaagcacaaataatgatgtacagtttttgtgggacaattttcagaccttagaaactaagatttccttccctatctagaaatgtaggatgggatatttatttttaaatcctcaatggaaagcttctctgttggtgatatttagaaagtctcatgaattcacaatactaagacaaatataaaaaccttttgttttgtctttttttttttttttcctttttgtggagaacagggtctcactatattgcccaggcaggtctcaaactcctgggctcaagttgtcctcccgactctgcctcccgaagagctggaactataggcgtgagccaccgcacccggcaaaaccttttttattatcctaaaatattaggaaacccaagtgaattatcccatcagtgaaagagtgtgatatccccccaaaatattgttttaaatacaaataacttaaagtttaatacattttgcattgcctggattcggaaatataagacaaagtaaaacaaaacaatggcaaaaagaattcagtaacactacttcattactagggctttgaaataaataatagctgtctaaaattactgagtattcttattaagtttaaagtaagccagcctctgactagcttgatgcagtgtaaacctgtaccctttacccaattcattcattaccaccacggtgtgtgtgtgtgtgtgtgtgtaattctgtacaaatgagtatgttttaaagttttattgaggcataattaacatacaataaactgtacataaagtgtaaaatttggtaagttttgacatatgtatatacttaagaaaccatcaccaaaatcaagataaatatattcctcaccattgaaaaatttctacatatgcctttataatccttcacttctgtcctccccataccacctgagctgttcctaggcaaccactaatcttatttatttctttctctataaactagtttgcattattttatgatattaaataaattgatcatacaatatgtatgtactctttttgagtcaacatatttattttgagatttgtccatgttgcagcatataccaatagttaatttctttttatttctgattagatggatacatgacaatttttcaatccattcagctactgatgggcattcaggttgtttcattgttgaaagtatatgtccatacaaagacttgtatataatgatgctaaaagactatgcacagtctttgcatggttatagactttgtttctcttgggttaattcccagtggtataatggctggattatatgaatggttgtatgtttaatttttagcaaaactgccaagcagttttgcaaaacagttgtaccattttacgttcttacaagtagcatatgagaatcagattttctctgcatcattgacaaaatttgttgtttttttatttgagttatttcaataggcatgtagtgctatataattgtggttttaataagtgttttcattacgactactgatgttgatcatcttctcaagtgctactttccatctatatatctatatatcttctttcatgaagcttgcattcaaatgctttgcccaatttttcttgttctttttcttattattatgtttataattttatgtatattcgatacaattgccttatcagatatatgacttacaaattttgcccccattggtggcttaacatttcatttcatgaacaatgttttgctgatgaagtcaaatgtttttcttttatcgatcaagcttttgatgtcatttataccaaactccaggtcacaaaaattttatattttcttttagaaattttatagttttaggatttacatttaggtttatgatttattctgagctagtttatttttattattatactttaagttttagggtacatgtgcacaacatgcaggtttgttacatatgtatacatgtgccatgttggtgtgctgcacccattaactcgtcatttagcattaggtatatctcctaatgctatccctcccccctccccacatgccacaaccatcccctgtgtgtgatattccccttcctgtgtccttgtgttctcattgttcaattcccacctatgagtgagaacatgcggtgtttggttttttgtccttgcaatagtttgctgagaatgatggtttccagcttcatccatgtccctgcaaaggacatgaactcatcattttttatggcttcatagtattccatggtgtatatgtgccacattttcttaatccagtctatcattgttggacatttgggttggttccaagtctttgctattgtgactagtgccgcaataaacatacgtgtgcatgtgtctttatagcagcatgatttataatcctttgggtatatacccagtaatgagatggctgggtcaaatggtacttctagttctagatccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattatttgcccactttttgatggggttgtttgtttttttcttgtaaatttgtttgagttcattgtagattctggatattagccctttgtcagatgagtagattgcgaaaattttctcccattctgtaggttgcctgttcactctgatggtagtttgttttgctgtgcagaagctctttagtttaattagatcccatttgtcaattttggcttttgttgccattgcttttggtgttttagacatgaagtccttgcccatgcctatgtcctgaatggtattgtctaggttttcttctagggtttttatggttttacatctaacatgtaagtctttaatccatcttgaattaatttttgtatgaggtgtaaggaagggatccagtttcagctttctacacatgactagccagttttcccagcaccatttattaaatagggaatcctttccccattgtttgtttttgtcaggtttgtcaaagatcagatagttgtagatatgcggcattatttctgagggctctgttctgttccattgatctatatgtctgttttggtaccagtaccatgctgttttggttactgtagccttgtagtaaagtttgaagtcaggtagtgtgatgcctccagctttgttcttttggcttaggattgtcttggcaatgtgggctcttttttggttccatatgaactttaaagtagttttttccaattctgtgaagaaagtcattggtagcttaatggggatggtattgaatctataaattaccttgggcagtatggccattttcacgatattgattcttcctacccatgagcatggaatgttcctccatttgtttatatcctcttctatttcattgagcagtggtttgtagttctccttgaagtggtctttcacatcccttgtaagttggattcctaggtattttattgtctttgaagcaattgtgaatgggagttcactcatgatttggctgtttgtctgttattggtgtataagaatgcttgtgatttttgcacattcattttgtatcctgagactttgctgaagttgcctatcagcttaaggagattgtgggctgagacaatggggttttctagatatacaatgatgtcgtctgcgaacagggacaatttgacttcctcttttcctaactgaatgccgtttatttccttctcctgcctgattgccctggccagaacttccaacactatgttgaataggagtggcgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagggttgttgaattttgtcaaaggccttttctgcatctattgagataatcatgtggtttttgtctttggttctgtttatatgctgtattacgtttattgattttcctatgttggaccagccttgcatcccagggatgaagcccacttgatcatggtggataagctttttgatgtgttgctggatgcggtttgccagtattttattgaggatttttgcatcaatgttcatcaaggatattggtctaaaattctcttttcttgttgtgtctctgctaggctttggtatcaggatgatgctgcctcataaaatgagttagggaggattccctctttttctattgattggaatagtttcagaaggaatggtaccagctcctcattgtacctatggtagaattcggctgtgaatccatctggtcctggactttttttggttggtaatctattaatcattgcctcaatttcagagcctgttactggtctattcagagattcaactgcttcctagtttagtcttgggagggtgtatgtgtcgaggaatttatccatttcttctagattttctagtttatttgcatagaggtgtttatagtattctctgatggtagtttgtatttctgtgggatcggtggtgatatcccctttgtcattttttattgtgtctatctgattcttctctcttttcttctttattagtcttgctagtggtctatcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttctctagttcttttaattgtgatgttagggtgtcaattttagatctttcctcctttctcttgtgggcatttagtgctaaaatttccctctacacactgctttgaatgtgtcccagggattctggtatgttctgtctttgttctcattggtttcaaaggacatctttatttctgccttcatttcgttatgtacccagtagtcattcaggagcaggtttttgtttagtttccatgtagttgagcggttttgagtgagtttcttaatcctgagttctagtttgattgcactgtggtctgagagacagtttgctataatttctgttcttttacatttgctgaggagagctttacttccaaccatgtggtcaattttggaatacatgtggtgtggtgctgaaaagaatgtatattctattgatttggggtggagagttctgtagatgtctattaggtccgcttggtgcagagctgagttcaattcctggatatccttgttaactttctgtctcgatctgtctaatgttgacagtggggtgttaaagtctcccattattattgtgtgggagtctaagtttctttgtagtcactcggggcttgctttatgtgctcctgtattgggtgcatatatatttaggatagttagttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccagtttgccagtctgtgccttttaattggagcatttagcccatttacatttaagattagtattggtatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgctgaatattggcccccagtctcttctggcttgtagagtttctgctgagagatcagctgttagtctgatgggcttccttttgtgggtaacctgacctttctctctggctgcccttaacattttttccttcatttcaactttggtgaatctgacaattatgtgtcttggcgttgctcttctcgaggagtatctttgtggcgttctctgtatttcctgaatttgaattttggcctgccttgctagattggggaagttctcctggataatatcctgcagaatgttttccagcttggttccattctctccgtcactttcaggtacaccaatcagacatggatttggtcttttcacgtagttccatatttcatggaggctttgttcatttctttttattctttttctctaaacttctcttcatgcttcatttcattcattttgtcttccatcgctgataccctttcttccagttgattacattggttactgaggcttgtgcattcatcacgtggttctcgtgccgtggttttcagctccatcaggtcctttaaggacttctctgcattggttattctatttatccgttcatctaattttttttcaaagtttttaacttctttgccattggtttgaacttcctcctttagctcggagtagttcgatcttctgaagccttctctcaactcctcaaagtcagtctccgtccagctttgttccattgctggtgaggagctgttcttttggaggaggagatgtgctgtgaattttagagtttctggtttttctgctctgttttttccccatctttgtggttttatctacttttggtctttgatgatggtgacgtacagatgggtttggtgtggatgtcctttctgtttgttagttttccgtctgacagtcaggactctcagctgcaggtctgttggagtttgctggaggtccactctagaccctgtttgcctgggtatcagcagtggtggctgcagaacagcggatattggtgaaccgcaaatgctgctgcctgattgttcctctggaagttttgtctcagaggagtacccggccgtgcgaggtgtcagtctgcccctactgaggggtgcctcccagttaggctactcaggggtcggggacccacttgaggaggcagtctgcccattctcagatctcaagctgcgtgctgggagaaccactactctcttcaaagctgtcagacagggacatttaagtctgcagaggttactgctgtcttttgtttgtctgtgccctgcccccagaggtggagcctacctaggcaggcaggcctccttgatctgtggtgggctccacccagttcgagcttcctggctgctttgtttacctactcaagcctgggcaatggcgggcgcccctccccgagcctccctgtcaccttgcagcttgatctgagactgttgtgttagcaatgagcaaggctccatgggcgtaggaccctccgagccaggtgcaggagataatctcctggtgtgccgtttgttaagcccgttggaaaagtgcagtattaaagtgggagtgacccgattttccaggtgctgtctgtcacccctttctttgactaggaaagggaattccctgaccccttgcacttcccgggtgaggtgatgcctcaccctgcttcggctcacacacggtgagctgcaccccatgtcctgcagccactgtccggcactccccagtgagatgaacccagtacctcagttggaaatgcagaaatcacctgtcttctgcgtcgctctttttgtttaagaattgacgttcattcttttaagtatgcagattttcaattgttgtggcaccgtttattgaaaagcctgttctttcttcactcctctgtgcctttgtctaaagtccattgtctatatatgtgtaggtctatttgatctcactgatatatctttatatcaataccacgctgtattgatttctgtaactttttattgaaatcagatggtatttgtcctccaattttgttctttttcaaagatgttttggtgcttttcaaagttttgtgtttccatacaaatttcagaataaaatagtcagtgtctcaaaatatcttgctgggattgggatagggattgcactaaagctatcagtaaagtttgggggaactgacattctaataatattaagtgttctggactataaaggtgatatattgctccacttactttgtcatcttcaatttttctcagcaatggaaaatatacatatctttcagatcatttgttgaatttacccctaaatatttcatatttttgatcatactggaaatggtatttttatttccatatatgattgtgtattgctaatatatagtaattcagctgatttttatattgacattgtaatttatgaacatactaaactcatttattagatccagaagcactttttgtagatctatgggattttctacatagataatcatgttgtctcaaaaagatagttttacttttttctgttgaacctgaatactttgttcgtttgtttttttttttaattacattgcactaattagaacctcagtacaatgctgaataagaatgctgagagtagatatccttgtcttcttcctgatcttagagggaacacattcagggttttaccattaaatagaatgttagctgtaaatttttggtaaatgctctttattacattgaagaagtttccttctgtttcttctttgtcaacagtttttatcggaaatgtgtgaatagatttttataaaatgttttttcttcacttattaagatgatcacattttagtttgataatatcatgaattatattgacttttgaattttaaacagatgcttgctactgtattcttagaatattatccatcttatataatgttggattctatttgctaaaattttgtttagaattgctatatctatgttcatgagagatattggtctataattttcgttacttgtatttcttgtccaatcttgataggaggacaatgctggcctcatagaaggaattgggagatagtccttccacttaaattttctgtaagactgtttatgggattggtattttgcttttgctaaatatttgttataaatcaccagtgaagccatttggacttggagtttatttttgggaaaatttttaactacaatttcaatttctttatagatataggtttatttggttttctatttcttcttaactgagttttgatagtttgtatctttcaaggaatttgcacatttgatttatttaataagtattgaatatgttagtcccaagttgtttatatcattttaatagcagtaggatttccagtgaagctaccctcttatttctgatattgttaacttgctaattttaaattatgattcataattaatctgactgaatatttataatattattgatcctctctaagaatcagctttaaaaaagaatcatcttgaggttttgagtgaaaaaaaaaactcaaattgctttttctatcgtctcactcaacaatagtcaacacagaagacttctgtgagcaaatatttggggatttctctccaccaacaggaaagtaatgcattctgcagcagacaacagctgggtatcatttaatttagttcaatccagacactatccacctgcagatagcatcagattccacagatttaggtctcagtctcataagactgccctcaattcagatgctaatagcaagctcctggtggttttgtctgtgcttctgaccaactgactacaaattggggatcccactctccccttcttgaagttgactaattttctagaatggttcagagaactcaggaccacacttactttcattcaacaactcattataaactatattacaaaggatacagataaagagatggataaggcgaggcatgggggatggagtgtggagcttccaagccatcctggctatgccaccctccaggaacccacatgcgttcagctatccagaagtatccagaagctctgtgaatcctgtccttctgtgtttttatggaggcttcattatgtgggcatgattgattaaaccaatggccattgagaatcaattttaccttcatcccctatttctcctagatgattggagggtgagactgaaagtctcaatcctctattccttccttggtctttctggtaaccagccttcatcctgaagctacctaggaggtgtcaaccatcagtcaactcatgagcatacaaaaacccatcactttagagactctaaggactttaggagttataggcctggaaatggggtcaaaccaactatgtattttaacaatagcataggtttcattgatttttatttgcttttttttttaatttgctttttttatttgctttttttttttttttttgctaatttctcatcacagaatgttaaagtcttatcttctcctctgtgactccaacaacacaaatatttgatctttggttatagtcctgcatgtccctgagcctctgttcattttttttaaaatttaagtttattgcacagcgtttctccttctggaaagatagacaacaattttttctatttctcccactaaggataactaagacctctggacataatacaaacaagcataagaaaaccctgaaaggccaagagaagaggtgaccacctgtattcccaaagaattgcatggccagcatggcattgagtagcctggattttctttgtacttcaaataatttaaactgggtaacaataacagtttatctggatcataaaaacaaagagaaatctcctcacctaagttatatgtgcatttttctggcataaaatttggaattcagtagcaccttattaaagtggtatcaggccagctatggtggcccatacctgtaattgtagcactttgggaggaggccaaggcacaaactcaggagtctgagaccagcctgggcaacatagcaaaaccctgtctttacaaaaataaaaataaaaattagccaagcgtgatggcatgcacctgtagtcccggctgcttggtaggctgtggccagaggactgcttgagcccagaagattgaggttgtgatgatccaggatagtgccactgcactctagcctgggtgacaaagcaagactctcaaaacaaacaaacaaataatgaaaataaagtagtgtcagaggagatatagtgaagagtcatgacattcatcaccactcagcagtgaagaggcaacaccccttctcctgcccctgtgtgaataggggaacatggggagcagtaatggggtactcttcctgtccagccaaggtggtatcagtagagatctagtggggagcctgaactccaccctcatccatcagttataaggaaccctcccctctacagaccaggatttcagcatagggcaagtggagatactgcacttttactcccacttagcagcaatgaaatggtttcatgcatgcttcccccagtggagcagtgtcagagaaggcctgctgaaacccacaaataaacgaggtccagaatcttataacataataccaaataatcttgttttcaattaaagaaatcacttagcatattaagaattaggcagacatcaaaatgtatgagaaaagatgataaatagatggcatactgagaggacagctgttaaatgatttgacaaagattttaaaatatccatgacaaagtgctttaacaagcaattacggacacatctgaaacaaatagaaaacagaaagtttcaacaaaatctgaaagtcttaacaaagatatagaatatagagaatcaaatggaaatttcagaatgaaaaaatacatttaaacactcagtggatggactcaaaagcagaatagagaaaacagaaggaagaataagtgtagttgaagataaaacaatagaaattaacccctctgaacaacagagagaaatagactgtaatatgtaaaaaatatttacacatattatcattttctgctaatcttgcttatttatttatttatttatttattaactttaaagcattttgatatttttactttggttctaaataaagtattctttccctaaaaatagtatacgtgttgtagaccaaacgtcctaataccataattgagattaaaaatctttgtatctgagcccttctactctatgttttgtgactttgtcttcagaacactctttgtagaactcataggcatattttgaacgtgatggtggccaaagtgaacaatgctgtttcctctgtctcaggctttcttcagcctggagttgtcaagtgaaaattccagggtctctttcacattctctattttactttctcttctaatgctgtccagtaggtatcaaggaattacaagacatcctggtggacaatagccagaatttcctcttttttatggtgaaatataaagttatagttaaagggaatgagattcagaatcagatagacagggttgaaattcttccattccccattcttaactgtgtcacactgaacaaggtagttaattgcttgcttattatgacccaggtttgcatatacaataatataaaagttcagcagcttgagagacttattaggcattaaatatatttcagcttcgctttcattcctggccaaaaaaaatgttatgaacaatgtccctgtgtggactgtgtgtgtgtgtgtgtgtctgtgtgtgtgtgtgtttgtatggtgtgtgttccatgtaactcagggtacttaaaagttcagagtaacttgtaacaaaccagtttaaagccaggctaagacaatattttataaaggaatgatttgtctagctttcttgttctgaacacaaaataatattttgttgtatgacataggtcgggtcttccaagatgattttcagatccctgcagcattggactctgaagattacggagcattttgttagaataactgaacccttattctgaaatgggaactatacatatagtttatatagtatatatatatagtttatttatatatatagtttatatatgatatatatactttataaacaaaagggattatatattatatatataaaatatatatataatatctataaactatatatataaaactatacagttaacttgagcaaatcgtatacaacaaactagaactatcacgtagtgcatgccattactgtgctttctcctcatttggaagctgaaatgatttcttacaccttgtgtccaagataatgaggtattgtgtttctttgaactctccctaacaatgtgtttttccagtactgattgttgatgtcctgttagcactcttatcctgttctgtcctgactggaataacggatcatttgatttggttcttttactagtgttcaatcttttgcatatgcgaatgattctcattacacacagtctatatcaaatggtttctcaggggactttacatctttcttacatgctttgcaaaattctttaatatttttggcctaagaagggtaatgattctctctaaaatgactatccattgtctgagtgtctgcttcccattctgtgatttgcatttactctgcctgttttaatgttgttgttttttctcaaactgagagaaaattaatttgcctccacttctaagcatctgggcctcatagaggaatcttctttcactttctctctctccctcttcatcttttctttttgaatctactttattcttctctagtcttgtttctctttctccttaccccaagcttcacttctctgtgttatttgcaaagtaacctctattaatctcatggtctagaagcactgctggtgaagaaacagtgactctgaagtctcatctgatcacctgccatagtatcaaacatgtctaacaccagatctgtcatgacaagttttccaaaattccagtgagaaatgaaactcaatagctaaaggacttcgttccttgtagtttggtgggattcataaccaaggtgctctgctgctagggaataggaacattgcagacacttagttacctaagaaggaggctgctgaattccaaatttcacaccagaaaaatgcatatacagtgtgtgtgaggatatttctatctttctatgatccaaattaactcttactgctacttagaaagcaacaagttcatagtcctgaaatgacccattcattgagaaacaatagaagacataagataatattttattgcaaatagtagtctacattccctctttgttcctttctgaattatttttcagatctagtaatactttcttttttatatgtcatggatgagtttttagaagtcgctcttactaaggagaggaacaaaaaaagtgaccttaattgtgatgtctttgtagttataatatctttaactacaaatacaagattctgaagcactgctgacagtatgaaaattttgcacactgtctgtcttgtcagcaagatttcttccttttttttcccggaatatcctggaatatgatcatttgaatagactgttcatatagggaggagaggaactgattaagaagaattagaaaaaatatactgttaagttagccagggtgagttaaagatcattaaacttggttatatactctttaaaaatggaaaagaaaaatcaaacaataacttcagaaaaatagttacttaaaagacaggcttttgatgacagcttatgaaaaatcaaatattcttttctgtgggcattaatgcattatgaaggactcccttttgttctgacacttgaagtaggaaaccatttcctttgtcttggccttactctctgtattgttgcctagaaacacagtcttttagagacatttgcccatcaaagtgcagataaggtaacacatttacttttcaaatgaaaattactagaaagaagtgaagtgaaggtaggttaaacaaaatgagttttttgttatgtgtaggtagagcctaaaattactcacactacctgcgtacaaataccgaagaattaagtataatcacaaagaaaagcataaagctatagggtgatttcttttttaagaaagcaaaaaataggcttctcagtgttaaaattgttaaaggaaccatatgtagaagctcattatctgcacagtaaaacgattaacagttgactatatgccaagcattttctctttgaatgttccaacattatcccagattgtttgagattggccaactgttgctaatccatttgctttgcggggtcacatcaaagacatccaaagagtctggtcaaaggatgaggttgtgtttgtctatggattattttatattgtttattctgcttttgtatagctttatcttcctttccataagatataattattttttaatactcaggataaaattatcactacaaattctactcactcactaggacgagtagcatttgttgttatgagtagaatttgtactagaaaaaaagtagatggctgcaataaatatttcaccacatgcatacgtgatataaaatgcacttcctgtactcatttctcattagaagtttagccacgaagtagcttttcaagaaaattcaggggatcatataatagctggcactgtcaaaattaaaaaaaaaaaaaaaaaaaacatgttttctctcagttggacccattgtccttgaagaaatatcctgagtgattaattcatcttggttttctctctagaaagtagggttttttccacttctccccactgctattcgtgtgctttactcatggggaccctcactgtaactggtaaccaaaatcatgaccaaaagaatattaactcttttaactcctctcaaaaggttaagatgaaagatggtttatacttccaaaaagtggtgtgtattaacctccaagtaaggaattagtagtgattacacgtggagatgacgtctcagttacccagaacctatccatatgaaagcatttctattagggcacttctttggataccatccacgcacagcagaaatgttcaactaaaacttttgtgttgaatcaaacttggtttattacagtaactctgacaaggacttaactataacattttaataggttctacagtaaataagtcactattactatcttttttttgttttgtactagcaaagataatcacttgtgattccatgttgtaactcacatgagggttaatgatgtgctgtggaaatgcagtgtgagttcacaataagggtagcaaatggtgggaaagtgactaggaagcatatgaggaaaactaatagaaggtaagggttattttattaaggtttgtacagattcattttcaaattgactcacatttccagagatgagtgttctcctcttcctgcagggaagggttctttctcacgggaaacgtatgtccggcgtgattttaggaagaaagggagaggtcagagagcccttctcgcatctgctgtttctcaattgccttctgttcaaaatagttaatttgccaaagtggcgtattttggggtgacatattctggtccccttcagtaggaaattattttaaacaaatgaataattgaattaggagggaggatgaagcaagatgcaaatgaaattgcttatagaatgacagaaaaaataaaagtataatttgagaggtattaaatagtttatggtataaaatattaaataatattaatgtgatttatttttaatttagtatatgtcagttctgttatttggcccaagatactcatttcaattgaactttttatataatggcaactgaattagacatactgataattgccttctttgtgggatctcttaagtaagttaccaaattgaaaagacaatagcaaataattcccatacttttaaaggccaagcagaagaacaataaaaaacttggaatacatttctaaagaaagattgagttttgaaacaacttggatatttttatatcccattgcctgcatgccctaaccattgttagcgtctttggctattaatcctattatctttgttcaaattattactgtgtactatctcagaaagattagtatttttatctttttttttccatctttgttctaaatttacaagtgagattaccacactcaaatttggcttaatagattattcatgcctaactaatgaattaaatggattttgtctttggcctttgcctgaaaagaaaaacaaaacaacaaaacaacaattacaaaaaacagcaataaaagcagcttacttgcaatctggatcacatatcctctttattttactattctcaacagggttagaattgcattgagccaagatgcagcagtgctgtgctgaagttgtttgtcttttaaggttcagtgaaaatcactgtgaggttctgacctttccaacagatagtatgtgtttggggactgttacagtatttgcgatgagttcctcaggatcttattataaatggttgagtaaatctccaaaccctcaacttcatgacatacaaaagaaaattattttcaaaataagaactaattcccgagataaaaataggaaaacacatacatttttgcaagctagtcaagaaaaatcattgaatttaactgcatttcacatctaaatagtttaaacatttctgttgctgatattgattgtcaaatacaaatgcacacctgtgctctttcctgtgagttctcaaagtgatgtaccagtgctggaaattgaattttctattttttcatattttagtgaccaaaatcattgagtgtcatatgaactattactattaattaagaaataataaagaagaatatacaagcattgatcttacagccaatgaagcacagtgagaaaagcaagggctttggagtcagaaagacctagactctgaagtgaatgtaattgttagacatgtaagtttgatcaatacatcttacctttgtgagatttatgttctccatatgtaaaatgtacataataatacctacctcatcaggttttcaaaggagcacatatttatgtttctagcccaatatagggacccaaaaggtgatgttaattttgacactacaatcaaaacaaataaaaaattaaacagtgttgtggtctgaatgtggaaccccaaatgcatatgttgaaacttaatagccaacatgatactattaagtggtggaaactttagaaggtgattaattcatgagggggcagagccctcatggatgggattatggcccttataaaaggatttgaaagagtgggttcctttccttccaccttgtaggagcacagcattcatccctttcaggggatgaagcaacaggatgtgatctttgaagcagagggcagcactcaccagacactgaatctgctagtgcctgggcagatgtctctttgagatactgacttcctttcctgtcctagcctttaaaactgtgacaaataatttttttgttctttataagttatccagtctcaagtgtttccttaaagcagcacgaatagactaaggcagtatgtaatacatattatactgttgtaaacacttttaatttaacttttttatttttttgagacaagagtctggctctgttgcccaggctggagttcagtggcgcattctcggctcactgcaagctctgcctcccgggttcacgccgttctcctgtctcagcctcctgagtagctgtgactacaggtgcccgccaccatgcccagctaattttttgtatttttagtagagacggggtttcacagtgttagccaggatggtctccatctcctgacctcatgatccgtctgctcggcctcccaaagtgcttaatttaactttgaataaaaattgtctaaaggggtataatgtgctgttttgatacacatatacaatgaactgatcactccaataaaaccaattaacatattcagctcattacatagttactactgtgtgtgtgtatgtgtgtgtgtgtgataagtacacttaatatctaccatcttagcaagtttcaaacatacaacacagtattaactgtagtcatcatgctgtacattagaactctagaacttcttcatcctacataaatgaacttttataccctttaaccaacatctcattttcctcactccaacccctgaaccatgactggacccctagtaaccatcattctactctctgcttctattcattattattttcttttttagattcaacatttaagtgagatcatgcaatgtttttctttttgtctgacttattttacttagcataatgacccccccaccaggtttatccgtattgtcataaatggtaggatttccttctttttaaggctgattaacactttgttttctatatgtctatatgttcatctatgatgcacacagcttatttccttatcttggctattgtgaataatactgcaatgaacatgaggatacagataactcttcaagatattggtttcttttcctttgaatatatacccagaagaaggattgctggatcaatggtagttctatttttaattttttgaggaacctccaaacagttttccctatggctataccaattaacattcccagagtagagagcccagaaataaatctatacatatatggccagctaattttcaaccagggcaccaagaaaaagatcgttgcaacaatctttggaaaatccaatctgccacatatttcaagggagaagacagttttaagaagagagataaagtcataagtgtttattaccacagacagcctaggttacatgaacattgaagaaaaagataagtctttcaataaagagtgttgggaaaaccggatatccacatgcaggaaatgaaattagacatgtatcttatgatatacacaataatcaattcgaaatgggttaaagacttaaatataagacctgaaatcttaacactcctagaagaaaatgtagggaaaatttccatgatattggtcttggcagtgaccaaacaaaagcaacaaaaacaaaaataaataagtagggctacaccaaaatgaagtttctacacagcaaaggaaagtatcaataatgaaatggcaaactaccgactgggatgaagtatttgcaaactctatatctgataggggtttaatatttaaaatatatgaggaatttatacaacacagtagcaaaaaaataaataatagcctaatttaaaaattggcaaaggacctgaacagacctttctccaaagaagacgtacctaccaatggtcaataggtatgtgaaaaagtgttcaaggtcattcatcaccagtaaaatgcaaattaaaagcacaatgagttatgagctaatatctgttaatgtggttattaccaaaaagagaaaaaataacaagtgttggagggtatattgaggaatgagaacccttattgtaaagactgttgacttattcacaatatgatttttttgccttcttacctcttaagatttttacttgtattatttttatttacatatgcatactcgtttaacaagacaaattgctcaagccaaaagtgccaataaatccttaatagcaaactactggcctttatcttcaatgttcatgtaacctagactctttgtagtaataaacacttatgacctttatctttctccttaatactgtcttctcccttggaatatgtagctgattgtattttccaaagattgttgcaacagtaactcccatctcacttgccattcttataatatgactttatatttcttctacggaaaggtgtagtctatgtccctacttgtgaaatgcagagagctactgtacttttccagtggaagaaaatctttgtgattttaaatgaggaaaacattttttgataagacactaaaaacatgatccacacttaaaaaatgataaaactgactttactgatactaaaacttctgttcttcaaaagaaactattaagagaatgaaaataaaatccacaggataggagaaaatattttccaatcatgtatctggtaagttacttgtatccagaataagtaaagaaccctcaaaagttaagaattaaagaaaaaataaaacagagataaatgatttaaacagaccttttgccaaagaagatagacagatcgaaaataagtacctgaattagtcattaagaaagtgcagttaaaatcacaatgaggtaccaatgtacatggctaaaatattttttgaagtagcacaccaagtgttgataaggatatagaagaacaagcatactgatatggtttgtctgtgtccccacccaaatctcatcttgaattatagctcccataattcccacatgttctgggagcgactcggtgggagataattgaatcatggcagtgggtctttcccatgccattctcatgatagtgagtaagtctcacgagatctgatggttttataaaggggagtttccctgaactagctctcttctcttctctgctgccatgtgagatgtacctttcaccttccaccatgattatgaggcctccccagccatgtagaactgtgagtccattaaacctctttcttgtataaattgcccagtctcaggcatgtctttatcaggagcctggaaatggactaatacacatacactctggtgagattataaaatattacaaccattttggaaagcaattcatttctttaaaagttaaatatgcacttatgttataacacatatcttggatgttctactcctaggtatttgcccaagagaaaataaaagtgtatgacaatataataaattgtacatgaatgttcataacagtttatttgtaatagccaaatatgaaaaatgaccaaatgttcatcaacaaatgaacagataaattgtgatgtatccataccattcaatgatattcagcaatgtaaagaaagaactactgatatatacaacatggataaatcccaaaataatcaccatcatcctaatcatcatcttgattatggtgatgatttcatacttgtatgcataagcccaaacttaaatggtatactttaaatataagaaatattatatgttaattatacctcagtaaattctttgtaaaatgtaaaacagcttccaggagaatctcattctcttatgccacttaaccaggacttttcagcaaatcattgaatctatgtgtccctgttttcttgaataatttggataaagaatagtatcaactacatagcttgttaatcttgctttagtattaaatgagttaatctctgtaaaccccttagaggtgcctgaaatacgatctaagaattagttattagctacgcttaatatataggaagaggcagcaggttcctcactggtcttatagaccacatatttccctgatgtgatggaagtctatttcttctttcagtgtcacgaaaccacggaaataggtcgttcggggctacaaaatctttgtatttggcacagctacatgttggcaatctaacaatttattttaaaaattatttaaaataaaatacttaaaattaagtattacttaagttttacttcaagaaaatggaatgtcaaagacagatttttctaacacttccaaagacattttccatatttgctcatttccttttggtctgggttctatgtcactatagtgctctttagctcagcagaatatctcctctatatctccatgaataactaaaaaaatagatccagcaggttttcaattgctagtcactactcagaaattttgttgtttttaaaaatctttcattctggaattcctttcactccttccatctcctaagtaccataaactgagtttttaaacatagcttttcatggaatgagtacttcttacaaaatagaaaataccaccgaagagctggagacatgtttcaccccaaccccagattgctggaaataactaggattcttccatactatatacgacactttgttaacaatatctctgggctgagatgccatatctgagagaccaaactaagtatacttggttttttatttagtggaactgaaagcagctgcatttctgtttgaattgctccctgagctctcctgcaaatatataaagggatgttataaataagttagaagttgatgattctcatttgtcagtgagggcagcctaagtaaaagctacagcaggaaaaaacagaagcaaaatattaggaaatccttcataagtgtagggtgagttaatcattcagaagctattctcagagaacctgaggaaatatttaaggctagggacaatatcttttctctggaaaagatagcaagaaggagatatgtcttttccaagattaaatacaggattttgtaacttgattctctgatattaccaaattaatttgaacactgacacttcaagactaaaggtatgtgcatctctaagtatgcatgtgtgtgcccgtgtgctgatgtggggtgtgtataagaggggtaaagaatatgcatagcagggttttaaatcacccagccccttgctttcttgttctcacgggacatggctgtatctgcagttccagcagaactagctactttctgttttctgaatatgaatgttgatatccatttgttctcatgcatgtgaactcatacttttactcttttttttatgttttgagatagaatttcactcgttacccaggctggagtgcaatggtgggatctctgctcactgcaacctctgcctgttgggttcaagcagttctcctgcctcagcctctggagtagctgggatcacgggtgcccaccaccactcctggctaatttttttttttttttctatttttagtagagacgaggtttcactgttttggtcaggctggtcttgaactcctgacctcatatgattcacctgcctcagcctcccaaaggcctgggattactggcgtgagccactgcgcctggcccatattttttctttttgaatttccattatttatttattagttccattgctgcattggctgagataacttcttcaacctccctaggctgatgtgagaagtctctcctctgtgttcccatggcactttgtgcatacttctgttgtggctagccactcagttctatcaacatcagtgtggttggctctctccagatggaatctttccaagactggggtcatattttaattttctttgtatcattggtgctaagactgtatttggctttgtagttggtgtttttcataggcttgtggaatgaaggactgaataaataaatgaagaaatgaaaccctggggcttcaagaggcagtaaacaggtgcagtacttcaggggactttattgtgttggtgctggcactggtgacacagacactggtttactgtgctggtctctagcagctactgctccccttgctgccaggtcttttcacgtccctgggcctatcctgaattgctggggagtctggcagggtgatcagttgaatgtacttaaaaaagtgcaagatgctagaaagaattagcatcggggacagagctgaaataacatgatcaaaataagatgaataaagagacattaaatttaggtagatgaaatgaggcaataaaaaagtcaaggggaaaaatatgagaaagatttcaaaggaaagagctgtgcaataaagacaaatatttcaaaattctgcaacaacccaagagatcaaatatgtaatgtaaattgccaagtgcaattatttttaaggaaaatgaattactggaataattccttgaggaaatttacaatatagagaatttttctgtcaactaaaaaaataaagtcctctttcatgctatgatatttgagaaaatagctcaagttattttgaaaagtttctctagaaatatgtggtcataatggaatcattctcactttgtgcatatgagcacatgttcctatcatatgttgctgtatagcaagctatccccaaattccaaaatttagtgatttacaataacaacaatcattttactgttatctcttatggaggttgactgggttcagcttgggagttctcacttgagtccttcatgtagttgctatcagaggacggtttggcctgcagtcttctaaggcacactcactcacatgtctggtaactgggctcataagatgcaaatagccaggggctgaaacaatccagtatctccttccatctctttacagtatctccatgtggtttctccaacatggtagcttcagatagtattcttgcatggtagctcagagctacgaagatgtatatttcaaaaaaaaaaaatggtggaaatgtatttcctgcttggcttcagtaatcatgcagtattatttccaccacgtgtattccttgagaacagttacaaagactctcaggttcaagaggaggtgacatatactccacctctcaatgggtggaccttttaaaaccatcatatacattttctaacacagagcaacacgtgcacacacgcgcgcgcacatacacacatgcacacacttccttacaagctttcagttacttgggtgtcaggaattttcagcatgattcagacatgcttttagaactgctcatgtcttgctaatatgcatgacctccatagacatgtaaatggaactttattgagtgaaaatggcaataagttagaatgagataacttcttcattgcctatttttagagagactaattcctagagagattttacaaaatgcatatgattgcagtgggattgcgatgcccattctgacactctgtaacaggcaaaggttgcttgggaaacagaaactgccaactgttttgcatccaggggcttgtttgatggaataactgatttttcttggtccctcttctctatttactcgttgcaatatctctggccagattcccacatgtagactttctatttatgccttattttccactctcttcagaaaaatgactgaaactactatcactccactgcaaatcaaaacaaaaccatgaaagccaaagcagtcaccaagattattcaaaacgtattttaaaataattaccaccattgataccattacaaatgtctgatgccagtgttcttaatcttttgttttctattattgtcccgtgagaatttcctttcccatgatagttgaaaccacagatatattatatgctatatgtatatctgtgctttatacatataaaataagatattttaaccccctcaagagccaatttttcctccttgggatgatataacatctatggaaaatatatgacctataggtattgatttaaaccaatgatttaattaattagaacagcaaatgggagatactgccatctcagagattcacatctaaattttgacattttctaagtgtttgtaacacacacacacatatataattgtgttcatatatctaaatatctgtacataacacataggaaactccataaatccttatgtaaagagatatttccaccaccactaacagcaacaacaacaaaaaacaaagaggaaaaaatagttatttcacatatttcagatactgaaatatatctgtaaaggccagaatcgttgttcagaaagaagactttgggaaacaagggaaataaaagccattgtttggcttttagaaatacacaaactttgttaaactcccttcttaatttgaatagggatctgtgagaatagcaaatttcaaaaaggagatattgtaagtgtcacaattgtgtacatgccttgtacatggaagcgctgcatttactgccatgcttcagaatcaaccatgcaatggtcaggtggcccctttttctgggtcagaaagtcagggaatttcaaagtttaaaagttgatgacagtactataagcagtgaaagacagtttaatctgtaatgcccctcacaggcaggcaacatgggcttgatatgttattgtcaagccacatgtgcagtgttttctgttccataactaggttcagttgtgtgcttttatagatcctcagtgtacaaatgtatgcatgttaaatcttaggtagtactaagtgcttttagagagctctatttaaaattataaagctttagccagtcatagtggtgtgcgcctataagtcacagcttctcaggaggctgaggagggaggatcacttgagcctggaaggtagaggctacagtgaaccgtgattgtgtcactgcactccagcctgggcagcagagcaagacctgactcaaaaatctaaacaaataaataaataaaataaaattataaagtttgagtgaaccaccatatagagaaagatttatgtttagattaaaatgaggatgaaataaactgactagatctccagcctctatggccaccaacaaggatcattggtctacttggtggaaaccctgaatcagcttcccagatttggcttcacagtcacctctcttaagaggtctctccagactgcttcttcccccacagtcaaccacttcctcctctgtgtctccaaagcactaatataccccaagcacactataggaaccatcttccttgtgaactggcctgcttggctccccccgacacatccatgaagttgtgatcctctaaacagtcagggcatctagctgtctttgtatccctagttgggaaacacagtatgtgcacgtgtaaactatgttttgaagaaaggaaggcaaactggcaggttatggtaagttagtttaatcgactttggagaaaacctggtatggcctcaatatcagccctcgccattctgaccattcactctcagaagacacaggcactgaaattaggcggtggaagcactgaattggactgggccactttttccacttgcttgttagaaaaagggcataattgtattccataacttcactcttcccctctttctcatgaagaaaactctagagaaaagaaagctaatgctgtgtctttcaaacgggggagaatttgtatttagttgaatctcattggtatttttatggtggcattgctgcccttggaggggcagtcctccccagctacaggatagaacttgtctcattttctgtcaccagcccctatgacttcatatagaattccagaattctgataaactgtcatgtggaaaaatgataaagtgatttatgctcaatttttctggaagggagaaatgcaagggctgtcagtctgggtcttgagaacaaatgagttacagttcatgaggcagctcaataaggctatcatttcccatcagctcctatcactgacagccaagatttactagctggggaatgggaagggggctgagatttggtgccaggtgaatcggcactattattctatcaaccaggctcatatagacaagaggctaccatgaatatttgatggaagtgtcttcccagaaatgttgtgaaacagcattagttttcttccattcgccaggagcctctcctttctatccacgtgcacctctttgaaaaatgaccacttgtaaaccacaaaagcatttgggattgtttgtttttgctgctccggctggtggtatattcctcttggcagtctgtgcatgcagtgcactaattcactgtcctccattctcataggataaagcgaaaaaaatccctcatctactgagatgctatagacattacatctgtcattatccatctgatgcagtggcagtgagcgtatagccttccagccccctatgtgctcagagaaaacagactttgatctatggcatttgctgtgttctccaggaaaacaaaaggtggagaggtgggtttggactcagcataggcctagcaattgctcttgctgatttactctgaagtagaaaaacataactgtaaattctaaaatattatatgtctcttttatttgggacatttgttttcagtgggaaggggctttgcaggggacacacatcagtacatttcatatgggtcaggttattttttaaaaaagacacacttaacatttgcttttttgagctagggaaatgtatttctaaaatctcttgtgggaagtttagtatttagtatttatgttgtattcaaaatcatctgtagatgatttcgaatgcaccgtatctatttcatcatttctcaagtgtaatcttttgtaatctttggaatgttagttccaaaagacaacagtaggtatttggtgaacatgtgggaaatctgggccatttaataaggaagatatttttgaactgctagatattttgtttgtctttctactgccactacataggcagattgcttcattgcattatgaaactttcacttctcttaagaaattgtctaaatgttcagtctagtgaaatattgagcaaaaatgtttcttttatatgagtatgatgccagttgctggctaccagtctttctggcactgtgagatctttccttaatagcagtataagttttgaggctgcccaagccatgccttgtagggtcacgtagtgggtcagtgagatggcttatagagttaagtatgcaaaagatggtcagagaatttgaagctaagacaatacaaattttgagttttaacttattattttactcattcaacaaatatttattcagtaaatattatatgcagccatcattcttgaatagagttacttattaatcaagagaacagaaataaaaataattatcatgaagagtttcagaaaatcacaaatattttgagagaactaatcagagtgagctaaaagagagtggttattgattttagtttgaagtcaaagacatttttctgaggcaatgacttttaagctgaaatctggataactagaaggaatatggcatgcaaacatcttgagaaggtgcgttcccagacaagaaatagctagaatgtttgagaaatcaaggaaagtcagaggcaagactgtagaggtcttggtacatcattaagttgtatggagcagaagacttcaaagctctatttctggccccaggaagtcagatacactcataagtttccataaaaaacaagaaaggaaaattacggttgatgagtattctccgcaaccatcatagctaatgttaaatgtgtgttttttgtttgctatagttctaaatgctgtatatgtattaaatctttcgattctcacaacaatcctatgatgctgtatttttattaatccctttactgtacacctgcaaacagaatcacagagactttaaatgcacttcccacagtctcacagctagtaagtgactgagccaggatttgaccccaagaggtttggctccagagctcgtgttcgtattaggagacttaccactgaggaaacagacttagaggaagtctttgctggatagtttttctgaacttcatgtgagtatacaacttatgccactgagatcaaaataataacaaagtgttatatttttctcaaatgcttctttcttaggcttacctaatcctttatattaaaaagtcccaaagcctaactaacattctatagtccaaacagacacagtattattgggttcttggaaatctattcttcagaaatacaaattctaaaataaaaataccagattaaatataagtagtttctttataacgtttaaattcagaatccccaatgtcaagtgctctacggacgaaatattcactttattactttttaaagttaagctaaccccaatatagagaattaaatgatagacagtaaaccagcaggttttaagttttaatccacgtatctttgtctttctgctttatcagctaacgtattatctgccttaaaggcttctatttggtacactgatggaaatgatatgctgagtattgtatgcatttgtagtctgtatactttcatttgatgacaaaatgttattcattaaaactagctaaaaaagaccctctgtagtatcaattgtttcttctcttaatattagctcagatgcctttctcagctccttcctctaagcatgaagtaagatacaccagaaatgaggacttttccaattaaagcagcactcacagaatttataaatgcttgtttttctatcattacaatatcataaaacaccgtgtttttgattcatgaacttaagaactgatctaattcataatatcaataagtgagaataaaaagaatttcaagtttgtgtttattcatatatgaatgctttgagaacatagaaacgtatttgaatagaacttttaatcccagaactggaatttagtgaaattgaaatttctcttggtgcctctctcccacagcccactccaatcctagagcaaatccccttgcctctgtcctcagggtacacccggaatcccaccacttttctcacctccactgctgccaacctggtccaggccaccaggatctcctgtctggcctctcactggttcccagcttctattctaatgcaacagttcctttaaatgcaggttctttgaaagtttaagccagaacatgtcactgctctgctaaacaccctcaatcaagaggcttccatcttctgctagtaaaagtctgcaatgactatacggttctccatgagctggagctgcctcctctccccatcacctttatcacctctcttcgctctgcttttagccaccctggctttctacactccaggcccacactgtctcagagctttttcacttttggtttctgtccttcgaatgcctttcctctggaacatatgcatgactctgagtcaaatgtcttttttgtgactcttaccctaactacctattttaaaatttcagtctctcacccttgcactgtcagtccaggtggctctgctgtatttttttccataacacttaacaacttaaatcatactgtataactaatgtattaagatgacttaccctagaaaatgaaatccaaaagggcagggaatttttttcttgtttataatatatcatccagtggcgccatgcctggcacagaataggtgctcaagaaatatttgaggaattaatgaatcattgccttttagttaagaacatttgtcagtttgaccaagtaaataattgcaagttttatttttgccaattatttgatcacaagccgttatgttctgtgatactacattatttcattttattctttcttttgctctttttttacttcccttccttccttcctttctcaccttctgatttccattctttctctttctctcctgcttctctttcttctgtctctgtcttttctacctatctcattcaacaatatggaacaagagttaggttctgtgaatatgcaaagttgaatcagaagctgttcctccccataaagctcacagtctaatcctagaaacttagaatagaaactggccattcatgaggttaagtgctatgaggtaaggcatgtgctttgtgcatagagttggaggtgaggttagggaagtagtctagtgggatgatgcttgacttgggttttgaagaatgaataataatttcctcaacgcatgggatacggtagctgaattgtagggaatacgtactgatctattgatttttttttttttttttttcttaaccccaggtaacggtctgatggtaagttctgattttctcaatagttattatttgtacaattttaactggcagctccttatatctggaaatacagaggcatgtggatatagcaagaaagcccattggcatcatattaaatgagtgcatttagacctgggcttcacatatgattatccagtgagtgaaaattttacagaaatggctttctcaacacatagcttgtcattgttttcatcattattggaaaatttgacataatttgtaatctgagaaagaaaaccaaaatttagcttgataatcagcgtcaagctgcaataattgtctaaaaatccccagaatttaattttaacttatttctgcttctataatgttttttttccaaacacttcaccttataaacactacacccactcagttttagaaaagaggggacaggctatttgaatgcattgctatcttctgccatgtggaagataagaagtcactctgggtaattcaggatccttacttatgttatcaattattccttttgtgttttgtttattcaacctctaacttaaactcagttttttctgttgactcttaactgtgcttccttctgagagatagagatagatacagaaaagaaagaagagaaatcattatgaacaaaacaaaaactcagggcttactacctttcacttgtcatcctctctgttccactttttgcagctgaatctgtggccatttcctcatatgttctcactgcttagcctgctctcatgcagcgtgcagccttccctttccagcaaacagctcttgatgatattaccaatggcctccctgtcactaactaaataacattttttcagtctgtcttacttgctgtatcagcatcattcaacaccaattctcacaccctctttcttgaaacattttctttccttgtcttctgggacacaacagccatctgtttttcctctgtaaatgtttctccagtgtatccttttataagtgtatttttacgacccagctgctaaatcgtggagttaataaaggcttgctcctaggccttcctttattcacactatccaatgtgatctcatccatatatggagcttcaattaccgcttattaatctattcaagtggttcccaaaactgtatctcaggcatacacttcttcagatcctagaatcacatatataacattttactcgacagctcttctcaatagctaatggcatctccaaagttaaagtgtgaaacaaacaactcccgattttcgcattacgcttccgctctaaagaaacctagcttggttttcattctgtgttttctagctcatgaatgataccaccaatcacctggttgctgatttaaaaaccagagtcactttttactccctatgttcatcctaaaactaagtactacagatttcacctgctaaatatctctcaaatctctcaatctatccacttgttgttttttttttttatctccatgaaacactctcatctgttttgggtggacgactacacggggcctgctcatgaggttacatctcttatccttatttcttcgtacactagactcagtggtcttttcagaagcaaatcgtatgatgtcaggcttttcctcttaaatactttcccactatccttagggtctgtattaggcctttaaaattattttaatgtctagaaaatccgaattctaacctcttcctgcttgttttgttttgtatttgtttccgttttttttttaatcagatctgtgttttggatgtaaaataagtcattaatgtatatactacaacaaaaaatattgccaataaaacagtaacacaagccttgtttatcacatgaattataaactgcatttcaactttagagatataaaaatgtgaaaaaggaatgtgggccatatacatgatgagaaaatatgatatttcttctggtccccgcacttcatctccttgtctatctccttcctctctcgactcatctcagataggggtctccaggaagcctgctctgaagatttctatgcaggaaatttactggagcacactctcaggattaacacctgagggtgatcctaaaaagcaaatttgggtagagaactatgtctgagatgattctacaaaggactcaggctgggatggcccttcttcagtatcttgaattggacaagaagtctagacatttatatttctgcattaaccaatcatcaaatgtgagctgcctgcccatagagagcagacatgaccttgagtcaatttctagcaaagcaagcagctggagaatgagtgctcagtcctgaggtaggactgatgaatctaggtgacacaccacagtatccgctatagtccacttcctgctttatatagtaagttatagaagagctgctccaagattctactggtcctcttttacctgggcataagttgcaagaaaaagtttaatgggatagacttaagctccttttgctgcagctggtctcaagaccataacttatactttcaccattagtcctgaatttccttcaccctacattagtacttctgaaagtctaggtaacttgccagatgaggtggctcagatcctcatacctgagaagtctgatcctcttgttaccatccctttctagggccatgcctgctgcacttttctacttaccattaaaattgggcaagtgagtaccaagaaatgtccaagtggatcacctagtttccaaactaagaatatgattccttgatccactgtgtagtatcagtttcaccttctaatgatcaatatcatttagcccttccaggatgcagacttctctctttgcttcgtagtctcttagaatgagaagtcctaagttactgggcaaaacctagattttgagatataacgggacacttctttgtcccttggtagaagtatgttctctctcagaatcaagacatgtaaatctgtacagcctagaattatggagacaggaagcagaaattcctccaagtggttctctaggaatgattgtaagtaggtccattcctactttgactccatagtttctagacacatatattctacctagcatggacacacagtgccatatactagtaattgatttcacctgtacattgtcatcctttctgggtatcacctaagatcacacttggataattgtgtcttaaacaggcaatttcttcactatgtataaagctggaagcttatgaatggtcagtatatgatagagccgtgaatctcatgattcacacacttctacccctcttttctctaagataagtcagtttttataatatggctttatgcagaatcctgtgtcaatggatcaaacactgtaaatctctagactctagttctgcagagtttctgcaggcagaaaagaataatccataccatgatatatattaattccaatcaagagaaatgtggtagtttaaaatgtatccaaaaattccttaacagtccttcaccaaaaagtggactttaatatactttctcttgaatatggtatagctttagtcatctgcttttagtgacactggcaggagtgaagttacgtgacttacaaagccagattagaaaaggtgatccagttctcgcctggctctaccttgcatttgggacacatgtctttagagtccaccactatgctctgaaaaggtccacatggaggagtttacccacagactcagctgaagttccagctgagagccagtatctatttccagccatgtgattgagcaagtacactttcagatgattctattccccagcctttgagctgctctggcttatgtgcagtgaagcagagaagtgttgctgatttatgagcaaagcaagtgttgtcattttaagccactagagatggttttctgtgcagcgataaataaacaaaacatagaattactaccccttctaggtggaaggggtttaatatagtcaactttccaccatatctgtggcatgttccttcaagggatagtgctatattgggtgctaagtattttctattctagcaggttgaatagttgatgagggcagtaactagataatttttgtaaatgggcccatgtacatttacatacacataagactagcacttgggctgatgctgagtcttctgtcgtgttggcaggtgcttcttgtgcatgttagatcaatatgaagattttaaatatagtgcctattctcatatagtcattaacatgccaccaatccagacctccttatccctcatcattcaactcttccccttccagatccataatcaaccagctaagccctttgccactgtctgtgagtcagtctaagttctacctaaggccacttttatttccaaacaaagtggacaaccagatgcatgacatgataaccattggagaattgaagatatgttaaccattggagaattgcacctccccactaaattttccagtcacccttcagcagagctgtaaagtcatcaatgcccttttttctttttcttatgtccatgtagtaagctgattgatgcatggcccaagcttgaacgttttcttcttctgccagctagttataaaggacctccctcccattcagccatatgaattgagagccatatgaattgcaataatggtggatggcatggggatctaagacaccggctcctgcatcttatttggaacccctggtctggcttatgcccaatccctgaaataccatttctgtgttacattagattgttactgggtacacctgaattatgatgcagtagttctgatagacactagattataatgggtagttctgacatagtgacctctaccctatgttcagtcacttcatcttttccaaatcccagtagcatgccagaagctctatgttggcatggtcttgcagatagtatggttttgctccaggatcatacagtctatgttatgattcttctttttggattttacataaactaccattaggcttgctcatcaaagatgtttctggcatcataatattttctgggttgtttgtcccaaggagcagggccacttataccacagcctagttctgttttagactctgctcaaagctgacagcccttcatgtcatgcggtaaatgagtttgagcagtattctcaagtatggaacttgctatgctcagaagattgtgtagcctataaggtattgtttgcttttcttggtaatgacagttgcaagatgcaataatttgctttttactttaaggaagtgtttcatgatgtcagagaccattagacccctacacgcttcactcatgtgtggggctcctcaatttttattgggtttttctcctatcctcccacatgtgtcttctcaagcctccaattcatttgctacttttgctcttctgtttcaattagcgggatgttattgatatggttccatcaatatagtgaacaaagatgatattctccaaggtgtccagacaatcagttcccttcagactatattttgacataagaaaaaataattaacagtatattggagtaaggcaataaatatttactgtttctgatcgcatatgacatccagaggcagtactaatctgctctagcaaagatgccatgtctggtataatggttgcaattagagataacacttgtttgtttgagtcttcagtagtttactgtcattgaccaacattctatctggccttagtatgacccaaacctgcaaattatagggggtagcataggaccattataagggtggctttaatctctgctattccttacagggtgagatactgattttactgtcttgacagggtctaatatttggacttcctcattacagtagttcttaccccacacatcaggaaacgtgtcataaatttgtaactataaagtatatccattccactatacagtcatgactaggtaaatgatcatagctgtgagcacttcccttacaagatctttgcagacactgtttcttctccaaaatgctgttcattttcttctttgtgttcttaactcttatctatcctttcaatctcgtatatctgagagacattcctgactatatgaattcccacttcatatactcttatatgacctgtaactctcctttttagtatatagcagagttttggttttataatcatttgcatgaatatttaagtaatatttattttactgactaagctgcaagcttcatgaaataaagggaggattttgtatttacatcatctaccatagcacctggcatgcagtaggaataaaagttattgttgataaattattgattcgatagttgatatagaataaaggtgaatacattaatgaattatggaatgtactagaatttggattagaaaattgatagaaaatctcaaattctatcttataaaaatagattcttaggacccttacaacttcaaaaaaatgtttattagtatctggcacatagtataaattatgtaaatagttttgactgaatgaatgtatggcacacagatttgattctacatattttatccagactcatgtttaactagcttgagtagctcaaaaccattttaaattcctaactgggatggttgtaccgtaatggttgttgctttcaatatgcctttaaacataagacacgcatataacaacattttagagaaataggagtaaccgtattatatatactgttaaatcattcattaagtcaatgtgtttacttttgttcaattttacatattctcaactacaaaacttttctagtattaaatatattcttgaattaggcttttattctgtgtgacattttatattatgtaacatgttagagcatattaaatataagaacatgaatttctatctcctgatctttttttatgtccctatagaattccaaacacaaaaattacaaaaaagaagtaatttctcattgagagaaatgtctgattcaaggagcttttttgaaatttaagaaattgaattttaagaaatttcttattaggaatgaatctcatgaatgcttttaaatattgctgaaggatgtatgtacagaatttagaatatacaattatttggaagcaaaaaaatggaaaatctgcaactcttcatcaaaaggaattgttaaaaaaaacaaataatacatgcatgcaatggaatacatacctcaaaatgcagactacgaggtcattagaaagaatacagtggatatatgagttttaataacgaaacctctgcaaggatgtctttaagtttaaaaagtctttaagtaaaaaaggaaagtatagagcaactctatgtagaatggtatcttctgtgcaaataaaactttctgaaaagatacacaaaaaattgttaatacttcctaaggaaaggattagaaggtggaggaaaagtatatcattcactttttggtttttgctcttctttgctatttgaggttttatgttgtccctatattacttttatcataaaaattaatttgaaaaatactttttattattatatcactttatgaaataaaaactttaaacatccctgtatttgttaagggttgaaattttgtattgttgtctaaattgcattttattgtacattttatttctcaggtcatttaatatttgatttcctctggaagacaaaaaaaattcaaaataatcaataagacttcacactgttttattattgaaaatgtgatcaattttttttcctcacagttatcatgccactgttggatcaggtttcaaaatgtcatgtaacaacactttgtttgtgattaacacctataatcttttgtcatggcaacaatgatataataaatgctgaaggaagcgttgactgaaaaccatgtattactgccaagtgttgggacattaaaagggaaaagagaggaaaaaagaaaaaaacaaaaatgaaaacgaaacaaaacaaaaaaaaaaaacagacactgctgcccaggcttggcatgtcattaaggatgctatgtgacctcttcactgcctttgctaaaaacatacgtgagattgccagtggttcattcatctggctaattctatgtatatatagtacatatttgttttgtaaagttcatcaaaatcaaaataaacaaagtcattttcattcaatttgtgtgccttcaaaatgggggagcgggaatccctgtgcaatgtaattctttacttatttgcagaacaacggcagaacattggtcttgttggctgtcttactctgccaggagtcctgttcaccaaggcatggcaagaccaacatcctgtttattattttactctcattatgttgaaagcaaacactacattattgcttttgttcctccatattgcttctataagagtgtcacatatacaagaaacatttgaaatatttctattggtcatgctagtttaggaatttagaaccactttgaaatgggtaaagctcaagcctctctccacaaaactttataattgcaaaatatataagttttttgtttgtttgtttgtttgtttgagacagggtcttgctctgttgcccaggctggagtgcagtgacgtgatctcagctcaccacagcctcgaattcctgggctcaagtgatcctcccacctcagcttccagagtagctaaaaccacagccatgtgctaccacacctggctaatttttgtatttttgatagagacggggttttgccacattgcccaggctggtcttgaacttttgacctggagcaatcctgccaccttgtcctcccaaagtgctggaattacaggcatcagccgtcacacctgacaaaaatatacaagttatataaaattatataaaacatcagatgatatatatgcttgtattctatgggaaatggggtctctatgaaacgtggcatctcattactatgtatgtgataatatccaaactcctttgtaggtatatacagctcttgtttatctaacttacaccaattttccagtgactttccaaccaggaaagattctgtccacaaggggacatttcacaaggtctggagacatttttattaacacattatgatgatggtggtgggagcatgtatctagtgggtgaacagcacggatgctgctatacatcctacaatgcacaggacagccccaacaacaacgaataattaagtccagcatgtcagtagtgccaaggttgagataccctggatggcttttttctactgccactttccaaatcttattcagcttcttctacacattaaacctcttgtcatttccattctctctacaatgcccttcctctttgaccacataatcactcatgtttgacgtatttccttttgggtaactattcatcagtgtttgcatagaactctgctgagaatgcccccgttgtaatattatgatgtttactagcatatatatcctgcccaccagaccttaagctccttcagggcttctgaaatgctagtgcctggtagtcagtagccactaaataatatttgttgaatgctaactgaataaaaataaatttttaaggttaaaatatatttaagttttgtttgatgttttcatgaaagaaggatggaaatgccttaaccagttattcttgtaattaatccaggaggttggctatgatgaaactaggaggaaatgacctattataggaaataaaatttcggtcacaacaaaggaatactctgcttggaagttaaatcaggccttatgcagttgcaggtgctttcattatgcagaagatgtaaaatacagtgattgaacggcactttcttagcagagagatgatacaagaacaggtcatagaatcttaattgacttcagctatttcaagcattctgctatcctgtaatcattttagcctgacttctgcataattgcatcccatctctgcagggcatagtaaccgtggaagcttctccaggactgaaagtttttaaatgctggtgagtttgtggaggtgcaactgaaactcattctctccactcctcaccctgtggcacatattaacacgatggccctctgtcttcacctttctctgtgaagtgctgtcactccttcaagtcattaggttgccctttgcactagagtaaattccatcgtatgatgtgtgaagggatacagtatgtatcccttaagtatggtgtctccagtttctctagagcatggatgtattttcagtttcccctgcaatgctgcatacattggacttaacataacatgtggtctgagttcaggctctgctgtttgtcaactaaatggcgctatgcatattacttattatcttgggtttcagtttctttacctgtaaaatgaagcattggaataaattatctctaaggacactcatgggatgaatctcctttaattctatgattactattgattaaggaaatctctgctcattatcttctatgtgcacataagggattttatcgtggcatgaccctcagcctacttgatgtttaaacaacttgccatcagacattactgagaactttactaatttaagactactcaaatgaatttgcattgaaattgtgaccaagaccaagagagacttgtcaattcccttcaataatcaaacaataaatgcttttccttaatttggaagcagcttcctgcttcttgccctatctctagcctctacaatccatattcaggggactggctaacagagagacactgctgtccattgtctggctagctaataaatccaatctccctatgagcctgttgtgaactttggttatacttccacaggatagggtcaagagacactaaccttaatgaatagaaagctacacatttcctgtattgggattttttagtgcattatgaaccatttagtcttttctggcagcctacacttaaggaaacatgaattctgggaacaggaatggagcttctaagcatagattctaacctgaggttatttttgttaaatgtcagctaattctgcctatgtatagtgaatagaattcatgattagaatttaaattatcagttcctgttcctacctgctctgataattggcctcataaagataattgatagcttatgcctaaactcatgcctggtcaagccttctccttctatgtacgaaaccacttttaagggacaaggaattgttaattaaataacatcataagtaagtgaaaatatatacataatgttaccttaatgactatgctccataaatttcaaaggcagccacacaaacatatagagaattctcttaatgaatattttcacatttaggttaagcctactaagattctcataggaagtcagataagcgacctagttttaatatgaaaaatatttcaatgtattttaatggtaatctgtatataatgtagttatctacctaaggtgtgttttaatttttttttcctaaaatagaccttaatctgacatcaatatttttatgttcctgtaatggctgcatttggggaaagaactattggagacataaagcaatatctaaataggaatggacaggcatccacaggggcaaaaacatgcaccagcctgagctcaggatacctttcaaatgtaaccagccaacactgttaataagtagaagcagtggagaaccatgcagtattcctacacacaacacaaaatagaggtaagtgacaaacctacagattgaaaggtcaacaggctatcttttaggtcaggcaaaggatgcatacaattagtgctgaggaagattaagtatctgaggctaggacaataacatccacatttagaccttcttgtaattaatccttcagtttgaagacaattttacgtgcatacacacacatacacacacacacatacaaacatatacattcacacacacacccacatgtcaaatttcaaagttttgagtcattataaagttttgttgaaggcatttagtataatgtaactgaaataactgttggcatagtcgtgatggtttggaatacttatatgaccaaaggggtggagctgtagctcatatcaagaaatgctaattagatttggactataaattgttcctatcagccacattgaccatacagctgtgacttttcggttaggctgttttatttggtttattttttgtccaggacagccaaagaatgaagtaattttaattgcataaatttgactttcaatggatgcagtcactaaatactcatctccagaatgaagctttagcttgcaaagctaaatataaatttccttataactgaagagaaaatacgcatcttgaaatgggacaaaacaaagatattttccaatattaactgcaaagtcagtattgttttcatcctttcgtgtttatccccattatcacatttctcaaaatgtgacatttagtttttatgatccatcaaaccaactatttggaagactaccaaatattaacagaataaattcaagacaattgtttttctgtttcatcttctgtccaatagaaaaccttagaatgtatgtgtacatgtatctatatttacatatgtcttctgttagcaatttaccattcttaaagttttgcttattttaatctgaaaactcccttcttatatgtgcatgtatgataaatttttgatattcaagtatttataattaaaagtattattctgaacattaataatccaaatcaacactgccataataatactgttttttattaataatgtaagcctacagttataattttaactctcaattttgtacagatggtgatttttgtatcaaaaatatattcttaacaatagaaattgaaagaaaagatacttccatttaatagactctgcatatcctgataagaatattaattgattctgagattggaaaagcatttaaatacagtgaaaatactaagttataaattaactgttcatatttgaacctgagattgttagataattgaacatttcttttaccaagcataattttaatttaattttgacccaaataactacatttccactcaaggaatagttttcttttcctttttttaaaaatttgaactccactattttctcacctctatagagtttaaaaatttaaacaaatataatccaaattgcttaagctacctagggaagataatgtaaaagtcagtaataatgcataaggactatttaacccagctatgcagtaatgcaaaaaatatgactaaaacatgcatcaatgaaaccagaaatagaaagaatcagttaaaataatggaaccttttagcccaagcacactatctgtaaagtaattttatcatgattattctaggtccctccacctgaaatcacttatctatattcattgaaagaaaagccaagtgcattatctgaagggcccaagtggattcatatttatttttccattttactttaggcccattgatttttattactggcaatgttgttttaataacataccacagcagatttttaaaacacaacattatgatgtaatgaatttgatgtttgcctttaaaaatcactaatatatccacagggttgttaaaaatataaaataaaataaaagttcttaagacaaatatatttctgaggaagaattacttatttagttatataagctagatgactgatgaatggaggctttactcctctgatttcaaaggagtgggaagacccgatctggagtattgtttgcattacttggtttcccattttcagatagttattcgcaagctagggtgctcataaaagaggatgagagaccaattatgatttatacattacacctcactgaggataatcgaagccagtgagtatgtgcaacttggagataatatcagtgcgaagagccttagaaagatttcttcaaatatgtgaaaggctaacatggaaaagaatgaatagatttctttctttatagatatctcaaacctctaatcaccaaatggacttagatcaatataataaggaatattctaacagtgatatccaatgggaagagtgcttcaagggaagagatgggtttcttatactgaattttcctctgttgtggatgtgataaggggatttcctagatgatctcttaaaatctcttcaaacctggaggctcgacatggtggctcaaagcctgtaatcccagcactttgggaggccaaggtgggcagatcacttgagtccaggagtttgagaccagcctgggaggcatggcaaaaccccatctccacaaaaaatataaaaattatcctggtgcagtggtgtatgcctatagtcccagccgctcaggaggctgaggcaggaggaccacttgagcctgggaggcagaggttgcagtgagcaaagatcatgccactgcactctagcctgggtgacagagcaagacatcatctcgaaaaaaaaaaaaaaaactgacgtaatccttccttttttatatatgtgaaattatattgaaataaaaggggtattgtgtactgagttgctccttttgcaaacctcagtttgttgaccagagcattggtcaacaaagtgtaatgagcccaccccatggctatgtatgacaatcagtccattgggacggggcaagaacacattgaaacttctattggggtttattttattgacttttctgtttttatatatttggatgatcaatataatattagtgcagttaattatcattataatttataaatgaatgcttaaagattttaaatgtcaaatgtaaatatgtaacctttttactgataggagtatgaaataaaaataaacatttggggaccacttcaatgaagttaaagcagaggaaagttagtttagaataagtgcactggaatcttttatatctatgacagaaatagagaacaactcaaagaaaacttaacctttagatatttatgttggtcaagttcatgccaataaagctatgctaggattaaaaactgaaagtatattggaagaacaggacttgttagccatattaatgttaaaaatttcatacattgtcacagaattaattgcgtatgtaaattcgggtgcagtaataatggcatcataggtgaagcactaccctttcacatctagggtcatgttacatctaacccaaggttttaaccacaattagttgagtggtttggggttattacctgccaagcagtagttcttcattagaatgaatataaagcacatagtttatcacaattaggcttaattggctatcttagtctctgttcagtagatgccaagaacagagacagcatggacaaaaattctcatctcaatacccagaaaggacagttttaggtcatttcttgccaggttctgtgatggatgtggtctgacttcactttaaagtactcaaacagagggcattcatagctaacaataccatattttattttatcttcctgagagttattgacttatctttatttcttaccccagcttcttccttttttctcattcttttccggtgccatttttttccttcccccactttctccccctcatacatgcatataaacacacacacacacacacacacacacacacacacacacacacacacagttctgaggtcaatcaggaggctccaatcaagcaatgaatacacaaggaggactataacagaatgatatatgatttgcattaataaatgccattcttgcttttatattggattctgaaagaatttttgtatgtagaggatgaaaaaaaagtgaggaaccatttttacctaaatgtttcaaaaatatcctttccaatatgcagcattttaaattcagagactattaaaagagagaaaaacaatcagttttacttcataatgttgagagctcttggcagagttgttagaagcactgtaatctattgtgcaaatgatgctgaaattttgtatcatctctgatcaatgagtgtttctagagtacttagaatcaagagaaaacaatgaaacaaattagtagatgagaggtatagatttgcctcatccacagggaaacatatatttttaagtcacaatgattaatagatctagacccatcatatagttaaaaaaagtattgatttctccttcaggcttacctaagaaaaattatgaacatgagtttataaaagcaaacgtattggtaataaactgagaacagaatgacaaaataactttaaagccagaaaatcctgatcaaagttattcagtaaatatgttattcagtagctatgacacagattgttcctaaatataaaccagaagagtataaaattatttcattgaaatacttagttctttaatatgttgggttttttttttgggggggggggttgctggtttatttgcttttgtgtgttcatgtacattagaccaaacatacaaatagattatgttgacttctgcccttagtgaatattatgtttgtatttaaaggttattttcatcaacttttcatcataaaaattgaattattttcattctttctgttttagtccagtcccaccatttaatttggacattaaatcctctgagtataaatatgacagtaacataaataaaattgtagaggtgaaagtaaattggcatatacagtgttttatgcagaaagtattattgcaactactaaattttcctgtagttgtgctctaaaatataaacatgcaagagtcttaattttatttccattataagtgataattgttattgcttgaggtgaatgataatatatagtaaacaaagagcccagatttctatcaaaactgaaaatccacttatgtgagcaaagatgaaaggtcttctgttttaaaactgaaaatcttatgaatggccataaatgtgtcttttaggtaacaatcagtgtagtgagtatcttattttctgaaaacatgcttggaaatttattgaattattgttactgagttgttctgctaggaattgtgagcccatgagtggaagaagggtggtgtcttgtcagaaattgaaatatatatgaagaaaactgagcattttattaccatttagcttctttcaggactacttaacaggactgatatcccttagcattgaaaacaaatggtgttctctttagttattggatactgcatttaagaatctctataaagataagcactcagccttgacaatgtaaaatctgaaaggagcaactcacaagctatcagaagaaaagaatgaaacacagaattttgtctatttatcagcccatctacctgaaattatttagattatttaaaaaattaaagtcaaacatgcatgatcatcttagcactatcatgtatgttgaaataaggtttataacgctttgaactttaccccttcaggttactcatcggtgttctgaaacatgtgcatacaatattcaggttagaaatcattgagaaaaaagagtatttaatttttaatgagtatgcatgtccttattgtctagaaatagtcactataaagatgttgatgtgcgtgcaaaagtttgaccttcgacatgagctgcccagcactcacatatgcgtacaagcccttgtcagttaacaaagaggatctgaggtaaaactcctaaaacaaaggtactaccagctgaagtgcagacaaatttaggaactatgagtagggttgatctagttttcgaaatgatattgagctcttagagaaaatgaataagtggaaaatgaatagtttatacttcagagaagccctgacaattataaacagtatgaatccacaaaacacataagtgataaatgactatgatgatattaaagaaaatcccccagagttcctttttagtctctttggtttgattccttttataaattattaatatttttattaattatgaaagtaatttttgccataagaaaaataatgaataagagaaaaggtaacatttcccctagttacatgctaatcccaatcctcagaataatgttgacaagttggtattctttggacatttgcatgtgcctatttaaaaatatgtataatatataagtgtaatataaatatatacagaaacatatatgcacatatatctaatgtaacaggtgtcccttcagcctgattggtcccatggctagtagacttgtgagatttccttaattatctgcaaataaaatggaaaccccatttcctacaaggaagtgtgtagtgacttcccacaggagtcactatttttttcagtgaagtgcagcatgacaggggacagggataggatggtgtaacagtctgtgattattgtaagtgacatttttttttctttcaggtatacctatacttgcacacacatcacacccagacctatacacataaactttaaaaaatatccctaaataatggtgcatgtctgtttctgcttcttgcttatttccctcaatacattttggacagttctaatgtcaatacatacaaagctttttatttctctcacagaccagtgggaagtattccattctgtaatgtaccaaaatgtattttcactttccccttttgatgatatcatgccattattccacaataaaaaaaaaacgacatacctaactatacatctatctatctgtgtaaatatataatatagtcctttacccactcattcttatatatctgcagaacaaattcctaatatgggatttgactgaagtatacacaacttaaatatttttaggtatgaagaccaccgttcctttgttcatttgccagtgctggagtttatcattcctttaatttgcttgatctaataacgtggaatatgttatagtttcacttcagaattcacagtgaatatatttgcatatggttactggccatttctctccttaaatatttttttgcccatttcttatatagattgttttattgacttataaaactattttatactttattaatatgagatctttgactccgtgaacattttcttttagaatgccatttgtctttttaatgtgtttatgatatctttcatcctcatgagatgtattattttatgttattttatttttactaaaacttgtggtatgttatacattatattaagaaatgccctctctacttaaatatttttaaaatgtctgctgtattttcataattctttcatagtttgtttgctgattcttgggcccttaattgttctcatttattgtggcagtggtgtaagatgggactttacttgggttcatatatttaaagcgtttagaaaggttcttgggacactagaaactcttcgtgaatgtactttaatttttatttacaattctggatcagggtaagttgcaactccctgaagcacctgctctgtgtgtactgccttcacaggaggtagggctacatactggttggacaccgaatgaaaataagcacctagattctagaactttgtatccagtgactaatttgtaaccccagtaacataacttggttctctaggcctcagtttccttcctgagaagctgagaatcaatccccttgtcatttctcaaattcttctttcacaagcactgattctatagggcatttgtttacttgaagaaaatagaagtgaaatacatcggagaaatgctgaaagctaaagtagtggtatgtgtgtgagagagttttgttttgcttctcactgtaagccttcccgaagtcataaagattacctgtgttgtgaatctacgtgtgtgatacaatattttctaaacttctctaaccacatatccttttgttccctcagaacttctcataaaaattaatatcttagggactatatttttcgtgaacagcagagttagatcatctctaagtcccttttcttctctaatgttctgggaaccgcatatgttctgaggctaagccatgctgataaacagaacttgatttctgaagtcactccacaggatacacattattaacacccatttccaacaattacactgtttctcatgatggccccacatactcacgtattcattcaaagtgttattacttccattgccaggtgccaagatgctgaggactcagagatacttaaaacctggtgccttcccttggagttcttagtacctctgtagtgtgttgggagcaccatttatttcttagttttagaggcatatctactttatagaatcaactactcagtaacctgtgtgtatgaaaggtgcatgatattttaatattgcaagatgctaaagagattgctttgttattttttagataatgactatcttcacagtgtaagaagtatttatgttttgaatcctgatagcctctaaactgaaacataagttgtttcactgtcaaatttgcttaaaataattatattttcatagctctgtatttagcatagcttatgcaagtttattatatacatttttatgaatgcttattgaaaaagtaaagtattgaaatattacagttattaaaaaagcaaataagccatatgatcaaggagctgttctatagatctaatttgtgacttaattattttaaggtaaagtataaaatagccaaagcaaatctaaataaatttgtgcagcaggtttagcattccttttgtggttattgttgaaactctagcagggtaattaacagattgaaaactatactattgttttgtacattttcaaaagaaattgaagcagtgtattagatggaagtagtagctgtaggctacagctctctctctgctgttggatctgtatatcattaactggaaataaaatgacccattgagggaataccatttcctctggattcatatctataccatacttactattattaatcggtcttaaattatgcttacatttaaaataacctattctgcaagtagaaaaatgaaaaacacatagaaaaaaataaaattgaaaattctatgttgtcaggtaacatgagcagaattataggactgtattattttgaggcgatcttctaatactatatctagacactgcaatatctcctgcaaaactggagatttgcctgagacttggtcatctaaccctgaaagctgaggaccagaaacaaatgtgtaaacttgacctttcccctgcctactaggagcgtgttttgaattctcactatagtcatgaatgagtaaatgcagaaaatgggagaaagaatctgcttcctgccgtatttcccactattgtaggaactgagagagtttcttctacaggtccttgtgaccactgactccaacttctgggtcaagccatcagacaaattctgtctgcaatttaatgatctctagtgaatgtcgattgactttctagtttttgatcaccaaaggcaagtataatgtgggtacgctaaaattcccttactaaaatattttagaaaatttgttctaaacgttaccactttctggcccactgaggcaaagagaggaggagtccccaaagacaaataaaataataaattaatttagaccctgggagattgactggcttataaagtcctatgttggcaatttcaatggtctgaacaaagtccgcaaaataagcctgttcctggctctatggcttacatatgtcctcaaaaagagcaacttgctgatgcattgtaacatgaattaccttagtacatttacattaaaatgtgacatgatatcaaaagattataagattgcatatctttgtcatactacctggaaaaaaattatggataagtgtcatgttaaaatcttgttctgtcatgaatataagctgagtgtaatcacaaatgacagctgaaagaggatagaaaaaccatcttgacacctaagtgatgatattgttatctgtattctgaataattttacttataacaggtattgctctgtaagtttgtcttatgatccgtgttttaattctgatgagagaagaatgttggagttgaatatcatattccttaacatttattttccctaatgttaatattgcttcatcagttttctttctgttggtataatataactatagtcatctctttactgtaaaattaattccccatgccatcttgctaaggtttgtcttctataaatcctgtttagatgttttttattttattagtattttgaaaaatcttaatctttcaaaaagcaagtatcatctgtttatatttattgtcattactgatattagtgaccatttattttacgtagatgtatatgtgtttatacattctttccttattttctcttgtcctgacctactttatattggattcatgtttcttaattctctttactgtttcagtggtttgaaagctatatattctatttgtagtctttctagggtttaaccttaatgtgttcacttaatttacagagctatggtagatcaaaatcactacattactacaaaatattattggaaatgtagagttctttagccttcaggttagcctttagcctttctctttttcactccctgtctttgcctctcagctttcagataccgtccttatgttactatttagttttctagttctactttaaaatattttcctatatttgtcctttcctttaacaatgttcatttatttacattaatctataaattgaataatgaggtggtcacaactgctgcatatgttttagcccttcatttttatttggctttcttctcactaaaccacatcctttagaagtttcttaagtgcaggtctgtaaatagtaacatatctttgtctttgaaaatgtctttagttaaccctcattcttttcaatgctagttgtatggaattcaggattgttaggttgaaaattcttttcctttggaattattaaggtattatttcatgtatttacctcttattattgctgatgataaacctgctgtcaatctgttcaccattcctttacagatcatatgcatttttcttttctatggcttttaaagatttttcttttatgttctaaaatttcaccatggtttctctaaaagtgatttgttaactgctttaaatttggcttactacttgaacttgaagacttatgtctttcttcagctctggaaaattattaatcattttctgtgtgattactgcttccctttaattctatctatccttaccctttggaatattttattaaatgtatattgcattgatttgtgtagttctgtttaacttaaccacacttatttcccccccttttaattttctgcattctgggtggttatcttgaattggaagtttctggaacttttctttctcagtaatgtattttttaagttttttaaagttatattttatttaacatatataggtattggtagcaaaagagaggtcacttatgttagttcagtctgccattattttagatttagttgaattctgtatacaaagttttgacacaaaatgtgtctttatactatgctgagacaacatctaaagcttctcaggaatagcaaaactcttttaattccttggtcaaaaaaggtcaacctggcttcgaatgtgctggaagtataaaatgactctacaaaattacagggcacattactattttctctttagtgtagcttaattgtgaccgtgtgtgtgtgtgtagatacatgcgtgtgcacagaaagactgatttctttccacactttaattaattgaagagatgtagattatgcagcccatttatttacttttctcctatacacgttttacttttctaccaacttcagttgttaatattagactgttttcttaatctgtgttgcttttttatctccttcttaattacttttagaaaatttctcttttttactccctatctttgcctctccgttcaatatattttttaaaagtttcctaaattttggctttttgtacctgttacaaattatatatacatattaaaactgtcatcatagtactagaataataaaaagcaatgctattatcatcaaaaccattgagaatgcctttaaattttatttagaatatcaacaatagttaattggctagtgcactcattgaaggagagcctattttctctaaaatattttaccagtagtgggagaagaactgccacatggcttctaaggttttatagataactccttgttaacctcaatcatttgactttagacttttgtgaattcctttttccatctttcttttttcactttattttgtttagatgctggtttgattgaggttaataaaaaaaaaaagaaaagaagaatagtggtcaaaaccaaaaggaatgaatgtgtatcttctgtgtaattaaaagttgatgatatctcaatatttgcatgtaacaatattaaattctaggactaacacataatatttcagcacattttaatgtttaggtgtcttaaaaatacatccattttggaataaatctatcttctacagtcttagctccgtgaggggatacagcttctaaaagcattacctacaaagtttggaacataataaggaatggagagaattgttaaagggaagagaaggaaagagagtatgcacaatgagaaataatatactgtttgaagaaaataaaagcaccataatctaataaaattctcagtcttttcagtcattagagcttagctttagagagcagtcttactttgttgttaatttgtttgagtttttaaaccagacttactaatttaaatattagtacaaaaatattgtaacagcctatgcatatttgagaatataaacctctcatccttttttcaaatacaaacctcacattcttcatacaaagatcacaattttaattcttgttcaaagctttgtgaacatagctttcagagttactaagtctacaaatagttacagatatacaataggtaatgccatttttatatatctcaggctgcctgtccccagtaatctagaatgagtaatttcaaaaacaagcattctgacagttcaatattataatttatttttataccaaatttttaaagtatttttttactttgtaatactatatgcttattcaggactctagagaaaagaactccattcacaaaacaattcctacaacgtttttatatgtacttcgatgtatatctctattgagtaccacatcagagaaaatatagaatgtgaattctgtattatgacttgcagggaacacaaaatactctgacatatgattgaaatctgcctaatagcagtaaagtgaatcttaggaagaaaatcttaagcatttattccacaactctgcaaaacagcttcacactgaacctctgagcctgaaatgtgagaaaataaagtgattgaagcctgtcagcaaagaaaatcagccaacagagtgatgattccccagacaagaaaattgaaacaagtatctctactgcattaaatctgaatcagttaccattcaaaaggaagaaatttttagataaagctgagatttacgtgaattaaaaaactaagtgtgtgtgtgtatgtgtgtgtgttccatttatttacccaacaacctaagtttaaagaataattcataattgagtaacataaaatagcccaatgaaatataataaaagagaacatttaattattgccactactactttaaaatgtttgcactctatttcaaccaattatgtgcatatacatatgcacgttttactgtagcaagtgaagtcctggttgcctttggatcccttaatgcttccaagataaattctaaacctcttaacctgccaataaaagtcttctaccatctgcctctattgtatcactcccacattatctcctatttattccctacaacataacacctgttccagccactgttgttttcatcctgtccctcaagtgttctaccaccttctactccatgtgcctgtgcatcgccctatctctttacctttgccaatgccttcttccctcctcccttccaattatttaaagaggtaagtttgtgctatctcatcgtacctttcttaacttattctgcctcaaattaacacttttctctgaactcccatagcatttaactataaagatatacacatgcctgtacagggctattactaaatgtattatttaaagattgctttgtgtttttattgcgatttaagatgttattgcttttccaagttgtttaaacattgtagtcattttttattgtgcttggattttgattggtttcaatccaaaatatgatctttagaaatgtctaaaacgtctatttagctatttgtaacctctaaagatagtaaggttggtgcaggaaatcatttgaatggcactttgttttgttttgttttgttatgctttgtgacaaagtcttactttgtcacctaggctggagtgcagtggcatgatctcgactcactgcaacctccatctcccgggttcaaatgattctattctcatgccccagcctcctgagtagctggaattacaggcctgtgccaccatgcccgaataatttttgcatttttagtagagatggagttttgtcacattggccagagtggtcttgaacttgtgacctcaagtaatctgcctgcttcagtctcccgaagtgctgggattacatgtgtgagcctggcctgaatggcatttttaatgtgatggtttcagagtccttaacgaagtaagatataatctcccattctttattacatgtctatgattgtgtcaagaagtcattattgccattttttttactttcatggtaaaaatagccatgaattataagctttttttttttctgccagcctaaattgttacttagtgaagatgagagtacaactgatggactttgatttattacatctttttttcctctaaggcatatttatttccaaatttgcttaatgttatagtatacatgccatcttaattagattatcattaattacctaatgagaagagtttgtgtgttgtaacaaagcacttaccattaagaaattcctttgacaggtttgttaaagatctcatgattgtagatgtgtggcgttatttctgaggcctctgttctgttccattggtctctatatctgttttggtaccagtaccatgctgttttgtttactgtagccttgtagtatagtttgaagtcaggtcacgtgatgcctccagttttgttctttttgcttaggattgtcttggctatatgggctctttttggttccatatgaaatttaaagtagtttttttttctaattctgtgaagaaagtcaatggtagcttcatggggatagcattgaatctataaattactttggacagtatggccattttcacaatattgattcttcctatccatgagcgtgtactgtttttccatttgattatgtcctctcttattttcttgagcagtggtttgtagttctccttaacaaggtccttcacatcccttataaacagaaataccatttgacccagcaatcccattgcaaggtatatacccaaaggattataaatatttctactataaagacacatgcacatgtatgtttattgcagcactgttctcaatagcaaagacttggaaccaacccaaatgccgatcaatggtagactggataaagacaatgtggcacatatacaccatggaatactatgcagccataaaaacggatgaattcatgtcctttgcagggacatggatgaagctagaaaccatcattctcagcaaactaacacaggaacagaaaaccaaacaccacatgttcgcactcataagtgggagtcgaacaatgagaacacatggacaaggaagggaaacatcacacactggggcctgtcagggggtgggggctagatgagggacagcattaggagaaatacctaatgtagatgacaggttgatgggtgcagcaaaccaccatggcacatgtatacctatgtaacaaacctgcaggttctgcacatgtatcccaggacttaaagtaaagttaaaaaaaaaaaaaaaagaaattcctttgacaaggaacctcaatttctttgtctatgtaagattgtgctatagaaactacatggtcacctccatttctaaattgttagaatgctgtcaacctgtaaacatcatggcattaagagagcatttgcctaactgtgaaagggttgtatggaaaaataataatatattgcatcaatagttagaaagttttaacttttagaaaatgattttatgaaattagcctgtgtaacttcataaatagatgagttaatgaaattctaaacatgtgaatgtttgctaaaaataaaaatattttatcccctttccactttaggaaaaaatatattaaatataaaaacaaactcacatgtatcaatatttttttaaatcattaaccatccttctttcataggtttaaaatctttattgaagggatcactgtaatgttttacacacaacgtttggctgatagtaactggcaattggatttagaatcccaattcaagcacaaatccctggatgtcacaggggaaccttgatccttgatctaaggcaaataagttcttctccaagttttataaaagaggatcacttatagccaaccatgacgttataactctcatggcatggtgcttagtgagagaacaagctactctaagtagcaaagcattgaaaactgaagagcctcctgtaaaatgtaagctacttttagcatgcagtcatagggagctggattttatttttttaattcagtaattcagctttcaaatgatagtgttcagttgttataaaggtcacctgcccttggcctcatttcagcttaattgggacaggttaatcttcttttctgttgttctttcaatttggaatgaaactgggatctctattagtactgctcatccatcaaatcctatgaccttgaaagaaggcagcagcccttcttctcaggagagagtctgaagatgagaattaaaataggtcttctcagtggagacccacggcaacatgtaataagacatgtaaaaaaagactctatcactgcaggcatcctgtaacatttctccaagttacatatggagtcaaaaagagaatttatttaagctcagagtaaaaaaagaaaaaaaaaaaaagaaatcaggaaaatatgttaaattcttctaaaaatcaactaaaattgtctatgaaaatgttcaatggacgtagattttaaaatatgttttctttccaattatgaaactttccaggtatgaaagttttaactttctcgctagaaatatttccaaaaaaaggaagagtagttatattagcaaaaggtgtggataataatgcccttttcataattataaaaaatatttttgtttaaacaatgagaagacttgttgaagtaaccgtaggataggctgcttgtatgataataaacacaaagtgaggatgaatatataaagatcactattataacagcaatacttcatacatgagtcaatgtttattttgctaggtttggttattgaggaaaattgccatgatcccagaccactatggaaagtttataaaaacaaggtgtaatgcttccttttaacttcacaataagcaacctatgtaagaacacataccgaacaccaagtaaattaccactcttcttctagaattatccaagaaaacaacatcaggaagaaaaattagtttgatgcatgtaagactgaagagcttttcacatgatataggactacaaacattaaatagtctgaaaaaatgttgaattcattataattaaagaccattatctgaaaatgaaagaaaagacttcactacagttacatgttttacatgcttcattttccatgtgatttcatgcttgtaaagccacccagaaggatccctacatctccaagttcagtgctgtgttctgtttataagttgctctatttacaaggaaaactcagagaaggctctccaaaagtgattcaaagtctagggcaatttaatgatcattcatcgaaagttgttatctttacattaatatttagatagccaatcttatccaacctgatattttattaagtataaaattatctgtgacaaacaagtatatccttaacatctggtacaaataaaacatcaaaaggataatgattataatatttcatgttttattcatttttaaagaaaatgtttactttgaaaatattattataaatttaattgatcaaagctcaggctgagccaactgaaaaagaatttatattccaattttatgtcctactagttggtggccttagataaattatttaacttatttaaatttcagtttcttcaagtatatgtttggggtaatagaactcacatcattagatcattgtaagactaaatgagaaatttatacttggttgaagtgaataacaaggtgctacttccatgatagatgcttgataaatataatttttaatgttttctgtattattttgatactttcatggaataacatgggtatatcttattatgaatctaatgtacagattttacatcttccaatattgataaagtgagcaacctatttaatattctttaaaattttcaagataatttagaaattttcaagataagttagaccagggtgatacacttatattggaggcaatctcatagcccaggtccgttaaaatgtcaatgtcaaccaaagaaaatgtaagaatagcaaaatcctgaaatcttgattatataccccatcctttctccttttcctttcaccatcatagcaatctctgctagttggcgaatcttctaaatcaagatttcaaggcagagtttatagggttttgttccacaggtacagttctctaaatttatgatgaaatataatgggaaaaagtggctttacctaaattgttttagttcagattgcataaaatttcgattacacatggttattactcagccctctttatgtgtatatgctcataggatgcacatatatttagacttttgctctattgacttcataattgaaagaaaagaaaaaatataatggctctattaattatttacatattacatttaattctaccagatgctgaaaagagcaaaagaaacactgatcgatgaaacttatatatgggccaagttgctgttgcagagtggagcttgcaacttgaggcagagtacagttgtgttgtagaaaacaaatacactaacattttgaaccaaactcaaaatgtgcctagaaaattctataacataggatcaggtagtttaagtaaagttcctgtgaaaggtggcatatgttttcttggatagtttagtttttatcttttaagtatattaaagctcaagataaagctttgtctaccttacaacattgctctaatctacttatatcaattctgccctttggggacacccacacactgtgtaactccagagacccatattcccagagaacaccatgtgaatggtgcccctggaattgctcgttgcagtagccctgctgctgatctgggtgctctgaataacttgattgaatcttttccatgattttagtaatttatcagagtgactgttgcttacaaagtattcccttaggtgatttctttctttcctttttctttttgatggagcagtgtgcagttatggtgttacaaagttataacattgtggcaataaattttagagcaaacgataaaataagataaaactcaactagccttatgaaaaataattctgctcagcagggtttctttttcaggatagtcaagatttttcttggtaaaatgcatatattaatggaccatggtcaatataattatatgactcaatctgtacatgttcaggaaatgaaaaatactctctctgtttctaattcaagccatttttattcagtgttatcctgataatcattgcaaataacaaaggtctattatggtccttttttattttgctaatgtaaacaacaatcatataaagctatgtagctacttatgaatgcatttaaactggaactgtttcatttaaaaacagaaaattcacactccatctaaactccctataggactcataggattcctcttatagatctcatatattgatcagtttcactgggacagtttttcacagtaaaaatcccagagatccacaataaagtgtaggcttcaaagagggatgacatgtattttccatcccttagttgtggaccctgcactggcctggaattacatgctaattagatgttcttctccccgtcacctcttcttatcttcctgaagaccataaccacactgcatgcccctgagaataagagacttctttgtgcttcacttacttcaccctgatccaagtcctaatggtgcaaggattactctggagttacagtttgagatgctcagggaaattaggaaaggattcactgggaaagcaaaacataagttctgaagaatgaatcaaagttagcaagatgggggcaggtcatgagtgagggtggtggatgctgttcctagtagaaaaacagcaggtgtaaaggtccattgatggcagctagtgtgacaaggatgaggaaccaagaccaggccaccgtggctgcagctcagaacatcaaagggtgctggtgagagacgaggcaggagaagactgcaggagcctggccaggcagagctgtggaagcctcataagggattttaatttctatattaactcaagataaataattcaagcagggtggtgacatgatcagctctgccttttgaaaggaacagtggagcagcagtgtggaggaatgatgggagtgctttccaatcaggtggctttgcagaagactagacaagatgatgatgaaggtgaaaacagatgagtgaggtgtcaggaataacttgcaggttttattatgattataattaggagagacaattaggtgaatgtattgaacacacagcacacatgcacacacacatacaaagaaatagtaaatcagagaaatagtaaatcttttctctgatcatccagatgattactgggcttgtaattaggggaattagggagatttggggaatcccagctttaaaagataataaaggtgttctgcaagccatatagcaaatgatctcatatatgaaattgttaggataatattagactaatggggagatagatgaattgagttatagcaaaaaaacaagaacagaaacaaaacttatctttcaagtaagtcaatttaaacttactcttttagctttgctaaacttatgtttttctttttattaatattagctcttctgtatttaaaactgaggctggtgaactacagcttaagggtcaaatctggttctcagtcagttttgtagataaagttttattgagacacagccacaaccctttatttacctgttgtctatggcttccctttggctacaagcccagagtggaatccttgcaacaacagctgtatgccctgcaaagcctgatgtatttactagttggcctcaacagaaaaagtttgccaactcctgggttgaaggatttttgctttccttgcttttattctcctctgctaaatgttggttgataaggtcatttatatccttcctttcaaataaattttgatatattttgtttttggaatttgatcttttgtatggggcctcaaaacatgaaattctaaatacataataaaaatttttaaatatgatatattctcccatatattattttcttgtttctttagaacaaatatgattttatatctaattttgggggccctaaaataatcactccagtcaaccattcttaccattttgcttttgggattttactctttttctgatacatatctcattagtaaatctctggcatattcaaagacagacatagtctcaagatgattacatatataacttgcaatttttattgcacgcattccatttcagtacatcagctgctttattaaaatatttggaaaatacattaagtactgtgtctaaatgccttactgaaagaataaatctaaaggcttcagcttaaaggttataaagcactgacatgacgtggttggagcctacttttctatacaacataatctaatagtctgtagatgcaaagatactcaatgagaagttcttttaattaagtacatttagacctagataaactcatatgtatgttttctatcatatttgtttttacgtattattttttatgccattaattgtataagttaatggtgacttaatataggagaaaataatcaaaatgaaatactactttatttacatttttgagaatttttaatggataattatagttattattgttccattcttcttccttccttgaatctttttaatgagcaaatagttattaaagtatgttttttctgagtggaatgatcagtagacaacaacaaggatccccaatttcttttcatcattttgatatatttagagcacctaaatgaataggaaattataggtattgtctacccagccattgtcacattttattaaattaaatcttatacattttactgataacatcaaaatatctgtaacacacacctaagaatcccttaagctgtgaaaatgaaggccttgctgaaaggatacattagatgaatttttggaaaaatatctaagtggttttattcatttacaaatgatttgtttagcatctattttgaataaggtgcagtggtcatatccaaaaaatataaatgaagagttacaatcctatactcaagcaccacatagtatatagagagcaaataactgatgcttaagaattatttataggataaatacgaacaattacaacacagaatgctacatagtcatctgtacataagccatctgcttgtggtaggtacacaggcctttgggagcacacatagaacaagagcatctcaccaggaaacggggaggaagaatttcaggacctgagacttgatgagtcagaggaagcttttcatgcagacacagaatgggttcgagcatcgtgattagcataaacaatgatacacgcttgaacaaacgtaaaggtttgggaaataacatttaacgtgtgattattgtgagaaaggagaagaaaggagagagtaggcagataaaaaaaaaaaagaccagattatgaaggaccttgtattactttttaaggagattttttagatagtgtagtattttttatttttagtctagtagatgtacataattctaaatatatatacacatacatatatatgtttattttttatgtaaagaaagagaatgtgtgtgctatctagatatataaataaaatgcattgaggtggagctatgtggtaaattgggagagtttggcttagaatttcatactctctgcctcctctcgctggagaatagcaggactcaccagtgattatacatccaaccagacaggttctgcagaaggatagaagctttctgttagagaacccacaaaggaaagcgcccaaatttaatgtaatgcttttaaaacaattaatttgttagcataggatgatgaaaacaatttgtactaaaaaggaccagggattaatgattaatgactgttcagttttctttttgcaggcaatctttctaaaacacttacattggaacctgttccaacaatgctcattgtaagtctagggcttcattatgggagatgagagttgaccaggaaggtgaggtggccaggcttctgtaattgcactttccttagataaaacagataaaagttcttacaaagactgaatttgaaataaggtacccctttactttaaaatttgaaaaacattgcactacttaataagatatacagattgtgtttttttaattcaagaacatttatggctttgtgatttatttcattcgttgtagtaactagtatttttttcctttgaggtttatgtaggcaaagtcttacaaaaattatcttacttgttggcacttttttagtataagattgtttccttacatagctgttttacaaatgcacaatactaaataaaacatacaaaatgctgttgaaaatgccatgacaattttatgctcttctatatgctccattgctaaggaattagatggctcttcataaaaagagactctctgtagacttcgaatctaaggctttatgacttctaagatgctgattcaccatcatctcacatacaataattcatctggaacccattgagtgcactggtttcacatcagttcagttaagccatgcgtcaaaaccttggaaaaagtaaaacaaaacagaaagtcctcaagacagtgtgcaaacaactgctaaagcagaaattgtatgcaaaaataaaagaatattattcaggtgctgctaaccaataattgatcgtttcagccacatgtatgtatatgagttaacttcaaaatcagcattatcttcttctatacaaaatacagttgcatatcagtggaagccaaagcacaatgtcagtaaatatttatgcttcagattttcttaggactgtattttttttttaagagacaggtttctcgctctatcgcccaggctagcgtgcagtggtatgatcataatctttagagctctatttaaaggaaaaaaaaatacaccttttcaaggtggaatctgccaaatttcatcatcttaaaggggcttttcccctttgtaagtgacattaagttttttatcacaaagaaggaaaaggaaagatgtaagaaattggtcaaaatcagcacagatcatgttaaaacaaacaccctctgagtttgcttctgttgggatttggctatagtctccatgaacatgctgtacaagcttcttaatatgtctcatttggaagaacaaagtgattcttcaaacggaaccactttctgcactttaagtattactggtagttgtgctcaggatacctgttgtagtagtgtgtatgtgcacacacacaagcacacaccctttacatacgcatacatactttcaattaaaaatgcaaaaaccaaatattttaaagatcaccatgactagcacatactaagttttaaatatttgtcaaattttgtaggcatagaaatattttttatataaattttgtcagtaactatgcctaagctagtattagaagcaatagaactattttgagctctctatgatatatacttctgtaccctgtctagaagattatcttacccctgtatatatatatacacacatattagatatatacatatatattttacatacatatataatatatacatatatattttatatacatatattgtatattatatattatatatgtatcatattatatactatatatgtatgcattatataggtatatatcatatatacatatatatataacgtatagacacgcatgcatatatatatatgtatataattttctcatgagtagatccagggttcctttgactcaaccggatataaagtaatgcattggttcagactagatcattctagagctaaactaagaggagttctttgaaagacttgatggatttctcaagccataagagggcaactgattttgatgagaacagaaagcaccaaaattgacaaaatagatttcagttaacataggcattgatcttttgtgaacctgagcagggtggcctcgcctttatcttttcttctctcattatgagtcatttttaggaccaggcatttagagcacatatctctagtttctgctaaaatgaatctaacagttaacacattggtacttatgctacagcatattatcaccttctgaaataacataacagttttttttaagctaagcaagatggttaagcttgaaaatttaacaaaacccaaagatggaaaatgtaaaagacctgtggattttcttccatgagtggatataaatgctaatgaaatgttccttagaacacatttaaattaaaccatgagctaccttcaatgattatagaaaaattgttcaagaaggattgaaaacttaactgccattagataagaaagttctaaggtgctgatgggccacatgcacagctctgtaactagaccgaaggtagttttcctttctctgcatattaataatgacaggtggtgctggagataattttaaccagattatggtgagctgtagttctgattcaaaggcttttttcactgccttacttgaatagagtatgactgaacacactttaaaatttatttctttcccgaaagcatttgaagatttttgtgagagaactgatgaagtacttgcttttctcaaaataaataaataaataaatctttgaaaaacttaaagcgctgatttttaaaaggcatctcagacatttgtgtggtagctttttctaatttctgaatatgaagatgcctgttaatagcttccaaatggcaaagtgtgtgtgtatgtatgtgtgtgtgagcgtgtgtgtgtgtgagagagtgtgtgtgtgagagagagagagagagagtgtgtgtgtgtgtgtgtgtgtgtgtgtgtgtgcgtgcgcgcgcgcatgcatgtaaaggatgcacaggaaaataatttcttatccttggactttaaaacaaagcccttcctaattggcaaaatatggaaatcgttttggccaagaaataaactgtctttggtgtttacattttacaagaaaatttttttctaagctgtgttttgcctatcatctgcctcttggtcaaagtctgaggcatttgaatctcattcagaagcgtcattacctcttaaggaggttttaaatcaatcaaacctgtttcttttactgaattcatatgtatgtatgtgactgtgtgtgtgtgtgtgtgtgtgtgtgtgtgtgtgtgtgtgtgtgtgaacataagaaaaaatatacttttccaatttttgacaggcatgtttaaggcatagtcacatttgctaaagcaatcagaagcaaaaaatacaatcaaaattctcagacaccaagtttagaaaccaattaaatctagtcagtgttaagatttcaaattgacccaacaagaatttccttttctaaagcaatgctaaatgtattgtcataacaagggaaatataccccatgacagcaccaagtcattattttatttaaaaatcatttacatctagtttcctatattctgagcattttgcaaacgtgcacccaatcttgataacaatgatgtgagataggaactgttactgcccctgttttatttctgtgatacatgtgacattgaggcacagataccccaaggtcccacagcatatgaaaggggtggaccctagatatgaatttaggcaagcttctgtttacaacaattatttctgacagcatcaaaattcatgtacttaaccattatattcaactgccttaatcaaagtgtcaccctttgtactgaaagtgcttacaagtacagagcctcaggacttccagccacaattaaataatcctgaagaagaaaggtgagagctatatgactctgcattaattttttctgtcagatttcccaaagtacttaaaatgcatcgcatctcttataaagctttttcaaggggtgatggatttgatataatccttaaccaaagtaaggagaatataagagctattgtgggcataagtcttagtccacaaactcaaatgaagtagaaatattcttaagtgctccgtagcttaatttagtttctaatgcagagcttccctttgtggccctacactaggtttctgctctatccctagagtcttccacagtgtctggacattgggagggagaagggagatgggccatctgctctagtccctgtctcatacaagttgccaatgagatgactagttctgaatgcctcttcacgtcctcttagctttctgctactttgtgtcacctgtgagaaccaaaaaccttttgcaaggctgcatataatctgtctgcctggatctacctgtttggtgcttctccagtggtggtactcctgcatcagcccccagataataatatctctttcctccccctgctgcctttctctcttcttcttccttttcttctttttcttcttcttctcctcccacttcctcttatccttccccttctcctttcccctcccctctccctcatcctctccctcccccttactcttcccccttccccctccctctccttcccccttccccttttcctttccccccctcccttctccttccctcctccctcttccccttcccccctcctctccatctctctctcctccttcttcttcctcttcctcttcttcctctctctctctctcaatgtttgggaaagaatcctagcattttctccaattatctggtcataactccctgtcaatgccaatgaatatcctttacaaagaacttcagtggttagaatacaaaatcagagactctcagtttatttggggattctgtcctgccacacttttcctttgaagcgacaagcacaaagccaaatatctgctaatattggtgaaaggataaaggagaaatactaaccaaggcatacaatttcctctcaaaatggttgcccttctcttcaagaatgcatgaagaactttttctctaaggccaaactattagacgttaagttgaatgtgttttgtcttaacagatataaggaaagtgctctgaaaagaacagtatttatcttaatattagttgcactgtcaggtcagaaaacaatgctgtttaaaaaaagcactgctctatttatcaagccaaaattaaatggtatacccagtatgcagacctttctctctctaatgccattctcaaataaaaggagccagggctccttggagaaatggctgattctagatgtgcaacagggaatacacaaaataaacctggagcatctggtagtgtcagagaaataagaaagtactaaaacatgtacacaatcacacacacacgtgcatgtgcacacacacacaggaagatgggggtatgtcaaagggacattgcagccaaaagaaagggctctaaataaccaaagctaaaacaatttgagcaagaaaataaatagcatagtattagattataatctgaggtataaagtaaatatctctaagtctattctgatataagtaaatgattgaatacatgaattgatgggggaggatagacatatctcctgtgcagcagtattccaaataattgatgtagatattctgccctcaaggagataaggcatgactattcattcctttagtgtgggcttcccataatgacttctttccaaatagtacagtatggaagtgagggtgaaagagtaattttacagtggagaaacctgaaaaacatcactttagccagataactaaggatatatcaacaggggcaaatcatgttgaaagcatttactcttgatatgatgtgataagaatagcactttacctctgttgtctccctccccaaaacatagtaccctagtctgagcatgaggaaaaccgacaaacacaaatggagggatattctacaaaatatctgaccagtactgttcaaaactgcaaaggtcatcaaaagcaaggaaatctgagaaattatcatagtttagaggagcctggggagataggacaactaaatgtggtatcatggatgagaccctggaacataaaaagaatagtaggtaaaaactaaggaaatctgaataaaatatgccctttaattaataatcatgtatcgatattggttccttagctatgggaaacataccataccaatgtgagatgttaataatagaagaactggttgtgggtatatggcaactctctgtactttcttcaaaaccttttggtaaatgtcaaacagactttattttaagaaatacagtggtacccaaacaatctctggatggaatgaatcatgtcaccgagtttgccctgatctgttgccctgtctgcatccttcagctttcacatggtaatgggatgggaaggattctgtctgtgacaataattgaggcatgggcaaatgtaagaatgaaagctgtaacattttaagtttcttattgaatcatttgttggctccaatcaatatacagttagaaattagaaaagaaaatctagaatcagcatattttcttaaatgattattttgccttttaatttgtatttgtttgtttaaaagcctatagtcgcatacaacttgggagcttatggaaaaattgttaatactgttagtgtattttttttcaactcaggcatataaaagatactattgcacagttattaaaaacaaaagaaaaacaaacaataacaacaaaaaaagcagattgaattcagataaatgtattagacctaattagaaatagcattaaaaaacaaagacaaaacaactaagaaacaaaaagcctaagagaaaactttacacttcttagatggaatcacagctgtccaatgccaagacactaatgcattctgcatcaaacagattgcagaggaaaatacaatcttattttagatgcagttcaggttttgggaccatcccccaccttctgaggtcatttgctttttagttcatgacattacatagacattgctcatacctcattaaatgccaattgagtttaagtgaggtaataaaattcttttttatttttttattttttggaatgtctgtacagcacattgagaggcatttcatttcagagtttaaaatatttagtgagcaggtggctaactgccaactacaacttactacttaacagctctcagtgaaaaaactctgaagaaatcaacatcagcaactcttacagctccttcaggccaaggtttgtaggtttctaagtgtgttaggaaaagcctacggtatgtggcaaggaaatgacatgagtgagacgttaaagagcagatatcaagatctatgccagcatttgacctttcagcttgcacctttgactttttcttgtcaattaatactcttgctggttacagatcattttataacttgagatgcaactctagacttgttttagttccaagatgttgaggtattattattattattattattattattattaccattatcagtttgtttttattattagctttactagaagtgggactttgaggtcctctatttgaatttgctttgaaaaagtggctctagaggtatttttattcttaggatttctttggcatttttctatttgctatttgttgccgtgttaatagaaaagtgtaatatctgaaattgattggcagtgtttgaaattattatctgtaacaaatttctgaaactcagtaacttcaggaaaactactaagaatgacgctttacattcctttgtggaacaactgaaataagatatatattgccaaagaagatcctatatacaacccaaaaatgaattcacagattttgtaaactcttattaggagtaacactgggcgtttacaagagggcatctccattctgaaaaaagcacagcctcagattcctaaatttcatgctatgcactgttccatcttacatggagaaatcatgtcaaaaggaatgggggaaatgatcttaaagcaacatcttaattaaactgtttattagtcattgatttcctggcaggttagagttacttttttttttttttttttcacagtggaacacccaatgaaaagaaactatcttaagaattataataagtaggctaagataggaagaaaaaatattatttccaagtttcagttggcattaaatgactctggtaatacccttgggtcccagatgctacattattttttttaaatcagggaagaatggactacaaaatctctcccaggtctaaaattattttattccataaacacagatattattactctctacaaaattgtcagttaagaatagtctaagagtagttaaatcactgtctgtcattatcaatagaaaaaaaatgtgattcactttaatctatgacagtattaccattctctgcctgctaatacatccattggtcttaattctgtttttcaaatcttttacacagacttttatcaacattggaatttagatgcaaagtgtttcttgtttcagagattagtgagatattattttttaaaattctttttaccaggtttttgtattaaagcaagtcatgactaaatttgcatgcttgtaaaatttattttcactttaagaaatttgtttagatattcattaagagagaaactttgaaatctgtggatcctgagagacttgagtgtttctatagatcatgcatgcataacaggggtaatatttttcctaaggggcaaaaaacgtgtttttggcaggcgagggggaataaaaaaatcatagctattgcaatggtttgtggccttataaagagccttagtgcataaacaaatgtatgtatgactgtggcaaattttatagagattcaaaaaaatgttcaaaaagttttcttagaaagatgataataaaactccaaatcactgaaaaaccaaagcaatttaaatgtattacatagttttaaaccctcaaaaatttatctgggttagaaagcagagtgccaagtctcttcccaaagcaaattaaactggctgagttacaaacctctcaaaaattggatttataatgagtatgcaggcagatctttaactatagagactcctgagaagactgagctactctaacattctttgtgagcctaattgaaactgattgtggttggcaccttataataaactttagtttaaatgattttatcttggttctaaaaacagtttggccccatgtgtttctaaaatgtgcaataaaattcctttataattcaataaagataagagatctacaatgttggatttctactgtgttcaacgtccttttaaaatgcaaacatgaactcagccaaagtgtagaccacaaaagtcatgcctctccatcttcaccctatgtgagtgtgtgtgtatacttgggaatttctttgcttttgctttcttacgggcgaaatccttaagagaacattctttctttaattctgtatttaagcaaaaactaagggagaatatgacttgccatcctcaaaactgattttattttataaatactttcaagaaaattaagacttttctatacttaaaaatcatattctgccattcattattaccaggaaataatattggattctgttgaaaagaatgtgtgtccaatacgtgatcaagtagtttaatatggtagcaatttaccttcatgctatttattttacatgttttgctaataacaatggtgatcaactatactctataagaaatgtggtggctgggcgcggtggctcacgcctgtaatcccagcacttcgggaggccgaggcgggcggatcacgaggtcaggagattgagaccacggtgaaaccctgtctctactaaaaataccaaaaattagccgggcgtggtggtgggcgcctgtagtcccagctactcgggaggctgaggcaggagaatggcgtgaacccaggaggcggagcttgcagtgagccgagatcgtgccactgcactccagcctggacgacagagactgtgtttcaaaaaaaaaaaggaaatgtggtaagcaaatgatgataccaattatactaacaaagctgaaattttaacagcatcattgtaaaatgcttctattataatgaatctatcaagttccgatgatcatatgacttattttgccaacatcactccataagtcatagccatgaaagaataagaggcaaataaaatgtattttgcatctatgtgccatacattttgctaagagataatcacatccaaaaatatggggattgagtcacaaaataggaatttcagataatagagcaaatcactttagaaaaataatgaaaaagtattatagctcatgtttacaaccctgatattaagacttatatcacaattttttatttaaatgaaggtaaaaatatttcaagttttgactttttagtttaaacctagaaaaaagataaacctgttgaatttctgttcatgacttgcaaaaatggcatgcagaagaataaggaaaacaggtaaataagtatgaataaaaagataaactattaatacaaatatggacttcatattctattcacagttaataaaatcatcttttaaatctatgcaaggacagacctagaaaccatatgagaatcttgattttttggaatctccaagaaaataaaaattgtgcaattaactgtattataactaaataatcttataaaacattataaataatatttttatataaattgactaaaatttggtaacaaaatacctttgtaatgatataaccaatcgctatgataagaagaaaaacacaactaagtagttattaaaactgcagataattccacagaattttgctatgaaatctttattacctcaacagcttagcacaggctatagcaattttagatcagaaagtcagcagaactatgtcaggagcaccatactagagtcactggcataagtgtacttgctacatgcctgagtgacatctgtggcttgtttctttgtttttaaaggagatagttggactggatgcaagtttttgaaagctttagaccctggtcaactttgagaaaattataaaagctatggaactgctcctcagagaactctacatgtcctaaaatatttccatttcaggaacattctggatatccttgaagccactgtttagaatcctcaggaccattggttctatgaacttggggttcaacaaccttgaactgagattattttgaagattcatctatgcaatttatgcttctttgtttctacgccaagttcattctaagtaccatggattgcctgaccttatattttgaagcagagatcaaatggaatccttttacttaattatatttatgaaacacaaataggctccagcttactcaaggacaagtaaaccataaatatatataactatgttaaactctataactcttatatgattcaggatcacagattggaaagattgtgtaattatgacaatttaatttctggttttaaacttgaattttcttgatttataaaatagaatgtaaaaccaccaaggcaagatatatgtgagataactgaacacatgcatgcccacattcatatatatgtgtgtataaaagccctccaggacatggtttttcataggcaagagaatatatccataaatacatacttgtaaacatgcatgtatgaataaatgtatgtttataaatacacatgcatgcataaatatatacatgcatgtgtgtatgtcctgttgggggtgcaggacttagcataaatgcctgctattgaagttccctacataaggtagcttctgttgttttcagcaaagtccctgctagcatataaaacacattgtgcataataaaaaaaagagccccttctgagtgaatacaaaatacatcaaaagatatctgtttctcctagctgatacaggccagtaccaggggtcagaactggatttcagctcttactcatgccttgagctggccattaaaaaatagatctgcaaaacagtgagctactgttgctctggttcttgctatttcctacatcggtaatcctcaaaggatgggccaggaccagcagcagcatcacttggaaagttattagaaatgcagttctcaggctccacctgtcttactgaatcagaaacttggacagagcccagtaactgtgtttaagagaccctctaggtgattcaaacagctgctaaagtttaagaaccactgccctacatcacactccactccccattacaccaacaaatgataagtagttaatgaaagcagactctctccttcaccttcctcctcttccttcctactacctatatttctcattcaaaaaaaatttaccatgagctgctaaagagaggtggggatatatatgcattataaataaattataaataaatacatgttaaaatatagttaaaataaaatatgttttattatataaaatataacatgcgtctcagcttaatgttatatattttatttcttctaagttttacagcccctactgactacattagaatagtgatagctgattataatttcatggggacccctcagatgaccttctgaccctatgatttttatctgtgtctttctgagcccttctaataaagctctaccagtgtgcagcaggatccttactgtcaagttactcaaatccccatctatagagtaagtcatttaggtaggactgtaatttcaggttgatcccaaagtttcccttccatggtctggtgtcctgtgaggtgtacaggcaactaggttgatgtcttgaagacatgcaagaggtgtagtgaccaaggtcagggtgatgactgactgaaagccttcgaggtgtgaatttctttcataaagctgagtggaagagatgtgccttcgtcattgattctgaaacccctccatcctcaatgagccgactctaaagattgctgagtttcaatttgcattattgatgttagctcctatccagttttcttccctgtcatcctcatttgttataaagaatataaactaatacgagagtatagcttcaataacacaaaatgaaatagaatgaaacataaggagaatgctgtgttttttctaaaactcttgttggctgaaagaaacgtgacgtctgtctcctcaacaacagaatgttacaacagcaggatttcagaagaacccatttattaaatattttgtatattaaactaggattgtttataacatagaaatataaatgagaagtacacaaagcccttcgatagaaaaattgtgaaaaaaacctcttactcctttatttttaatgtatgaaatgtttctggcactgcttgtttttagtaagcgtttgtgtttcagatttctgtgtattattctgtattttggaatattgataatgggacttaccagttctctctactgttttattctaaaataactttttaaaagccaggcaatacaatgatatgagctacaaatatgtagtttaagtgcagtccattcttaatattgtctaatagtctagaaatatctgatgttttatgttactacaatcagtaagtttctgtttgaaaggatttgggaagctcttctttacagaatgctaaaaaggaaagcttattcctggcttcatcaccattcctgttgcctttcatatcccacccctcatgctgcttgttaattccacagagaacccattagggtgcctcactgtgcgcggccttcaggttcaacctctgctctgcccgttccctgaatctaccatcttcttatcctagccttcatgcatcttcagttttgattatgattctttaatttaagacagtggtttaaatgcatcagttttatcaaggtgataagtctttggtacgttaagtgtaaacagttggctcgagactgggttaaaagattcaccaggcacctccaagtagatttcaagcaaggtgtctcaccctaacctgggaagttaaggatgttaaattatttgataaattaagtcattagtacatcctggaaaaacttaatgtccattttcattaataatcagtatttttggtcagtgttcccagagttgtctaaatttctttatatatctagatgctgtgctttcaatgattctgttcactcagagtctctactcaaagagctgataatcttctcatttaccaaagttcctttaatgtatgaaaaaacatattgccaaacaaaaagatgagactccaattattattgaaatagcttttatctgattatagacacttagccatttggtccagtaaaagtcgctttatagaaaatttctgaactgttcaaatattaccattcctaaaatttcaacagcttaacttaggaagaactttaatatattaaccttcccaaatgacatgccattttaaaaagggattttaaatgaatgcctgagatgagaattgaagaccatgtggcaagtccataaggaatacgcatttgaatagttggactgcccattttccggcactcacagctgtaattgttagtaactttttataaaaaagtaatgtccatttttatcaaagggaaacactcacatccttgcctatcggtgatcattctctttttacctttatatttcttatttcctgtttagaagcaaatgaaggattatggagttttgcaatattaggactaggtgacagctcagaaaatatctgttccaagtgtattaagtcccaggggtgtattgcccatggtcagagaggaaattaagactgctgacatagcaccatatcttctccataggtccatttctctctcctttatactttgacaccttttaagttttattgaataaacatgaaaagccaagtgactttgtttttctaactttgaagagttattcagagtgatgtttgtttacgttcttggtgttaatgacaatgtcggataatactactctagaaattccctaagtaactttaccaccatatatagtgcattgtgcatcacttcagttgagagaaaagtatgactaatgcagcatgcatcaaaattaattctgtcaggaactactgtgtatgagtcacagaagccacaatactgtatttagaataataataagacaaggaataatggcatcctaaaatttaatgaggtagtttagtttaaatgtacactgttagtttgtgtcaacctactgcccattgcaagcagcacatttttttaacaaccttgtgcaatggggctgtaaattactataattaaattaagccataaccgtatccaggcaatatgaggtatttgtactttgtttctgtaatcatattatctgctcagaacagaaattacaatgaaaaaaagaaaacaaacattatcatccatgtcatttgtaatttttcaagaagaaagcaaagctatgtttgagattatccacccattttccaggtacatctatcacaaatcccttgccttatcatttaacttatcatttaacacatctttaactggttcttaaacttgtaagcaaagcacaatggtggagggaaggtttcttcaaataagcatatctatatgccatttgatttgcttccaatctcatgttgagatgatgagcagatggagagagattaatagtttgatttcttgggatggtagagattttgatagagaaaaccatgaatcctgcaagcaatataataaagctatcatcttcttgttattactgtcatagcttctctaaaatttgtgttgtgctgagactgttttatgtggattattttattgagtatgtgatggtttccccagggcattatcatggaaattagaaggaggtgctttttgaataaaatgggaagaggtattagtcatttgatcctttctattccttctatcttttgtaacatctgataacacatctgatatagtttaataaatattggtttcagccctgacttcccactagacaataaattcttgaaagttagagctacagtgtattccaagaaagtactaattgtctagaataatacaaggtaaaatataatcggagcttgataaatatttgtttaaagaatacaaaattaatgtaagagatgagatgtgttttgttcagacatattatgctttacaaactctaaactgtattttctcactttcaatccccctgtttacctctttgtgtgagctaaaggataaatggttggaaatgagaagtcatgaaacttgccatgtcatttgtagcttcaacaactattttcactgttaagaaaatatgaacctcaaatgtttatcaccttcaagatctggtttcctaattcatcactgttgccttccttgtctaattcacttatagctcatgttctttgacttacatggtagttacatcacaataactcatcataagttgaaaatgtatttaatatacctaacctatcaaacatcagagcttagcccagcctaccttaaatgtgctcaaaacacttatatcagcctacagttgggcaaaatcatctaacagaaacctattttataatgcagtgttgaatatctcatataatttattaaagacaattctgaaagtgaaaaacagcatggttgtatgggtactcaaagtacagtttctattgaatgcatattgcttttgcaccatcatgaagttgaaaaattataaattgaaccatagtaagttggagtccacttgtattgaaaatctggatgctggtgtcaccaaacatattcataatatattcactaaattttttaacatggtatataattgtgattactctaatttgtcccctatcctctttctccataagaaatagtaagtagggtccagttcatgacctgatcgtcattgcatttccctctttggtcatatgtagggctataattatacaagaactgaaatggacaatatcaatagcaagtgcacaggcatttctagaaagataattgaatgtttggtatggaattgtgaggggacttttatcagttaatattaatatatactgctcttacagccaagttacatttgctttgttagttgatcctgcctaaaccttgaccttattcagtagaacttcagatgcatagagttagttgtaaagagttgcagccagagtgttcatgaatcagccaagttccttgaaacattcaggaaagaaaaaaaaactaagccaattccctgtagggtatgttatcaccaccaattacagaatgtcaggatgtcatcaccaccaattagagaatgacaccaagtaaacactttctagatggaattacatgaatgtggcaaagggttgtggaatttccctcaaaggaaacagaccgtatagaatcatagaggttttttttttttttttttaagaattcttgttcatggttcactgtttccttgatatcacattaatagctaatggcttaaaatgtgaaaaatgcatttaaatacaaatacccaagtatttagtagaggagttatgttgctttgtacattattctttaatgtggtaaaatagcaaatagcaataccattaatttcagtcatgtgagctaaaatgaaccatgatatactatttatttttcttatcactgaatatatcaggcaggagtctacttagtttgaaaatctcatttagaatatcttctactttataatccctgagcatagaaattgatagtatttagtaaaagagaacacagtgtaatacaattagaaaataaatatttttatgtttatcttcctgtaaatgagagcagagggctagagtgcattttatctaatcactgtattattcaaaattgatgatgttttcaaagtcctgaagattttatcaaacatttagctgaactctaggcagaataatattttctagaaacaactcatttattttagaagcaacattattttctgttgttttcattagacacataccaagtatcagtacataattttctatatttataaatttctggttgcaagatttagataaatatttcttcagattaatatctttagagaaaatagatatcatttttaagagaattacacacctgcattctatatgccaagcacttgctaagtgctagcacatgtgccatctattcattgttttaaataacatttaaagagttaccattgtgcccattttgcagatgacatcagagtcacatgctagtgaatggtaaggaagggattagaacctgttagtatgactccgagagcttgagctctgctctactgtgctctctttaatctctaagttctttgttttgtccttggatctgctaccagtttattcactgaagagtaatttacctttgtgaatttcaattctctgattattaatatggatattttaattttgatcacttcagaaaataaatgtcattgaatgttgttgaggtagctatgagaaaggtactaccatgtaccttatttggaataaaaatgaacgcaacatttttaaagagcaatttggaaatatgaatcaaggctcttaaaagtatgtatgcccttttttagcttggcctcccacagctagttatgtgtcctgaaggtatagtcagaggtgtgaataatgatttatgtctagattatagctatctttgaagagaatgttcagcaaaatcaataaatctaaaatttgcaaattgctaggtaagttgatacgatgtggcggaaaatgttctcaattccaaaacatgcaggtagtaaagtctgtagttgaattagtgacagcctatgaaattcaaagtgttgaatattttaattggttgtatccagtaaactaaaaagttactttaagaaacagaaacaagagtagtatctgcatagggatatgcccacctttgtgtgagaaagtcctctagaatttaagcttacaacagaaatgcgttactcagtagtagcaaagagtcacagtggctgaaaccattgaagccaatgacaatggtgaatttaaaaagaatgagattcaaatcagtaaaattgtaagagaataaaggtaaaagaagacctattggctattattgtaatagctaatcttttacttgcatttatagctcacagaatattttattatattttcttcatcttcactaacctttctaaaaaatgatatttatttttctctaaagatattcgtttgaagaaatttttttctgaatatggcaaccagaaatttctaaatatagaaaattttgtgttgatacttggcatatgcctattgaaaacaacagaaaataatgttgcttctaaaatgaatgagttttttctagaaaacatcttcctgcctagagttcagtcaaatttcctacagttcagttaaatgttcctacggttcagttaaatgttagataaaatcttcaggatttagaaaatatcagctttgaataaaatggagtgaattatggcacctaataaaatagttgttacagtgattaaaatagtgtctcttagataatggttttattagcaccattaggactaaagtcagatttctcaggactagatagataatttataactgataaataatatgtttgttcagatatcttggtattatgctttggtatcttagattttaaatgaatgtattattataatgccattgattcttacaatagattttccttacaaactatgatatacttaatgtaaaataaccttatttaacaaatgctagattgaaataatttaagaaataatatttttaacatatatgcataaaatgtaacttgaaacttcgaagattaactcagataaaaacaaacatactgaaaattttgccactagtgaacttctgaaattctgtctctctggtttttttggaaacagcacaccatggtagtcaagaggtatattctggagtcaggcagaactgggtctgtgcactagttagatgagttcaggcaatacactagccactgtaagcctgtgtcttcatcaataaaatggaataagttatggcacctattaatacagttgttatagtgattagattagaaaataaatgtaaagggcttagcaccataattagcacacagtgagcactctcattaaatattagatattatttttattattaatatttgaagaattaaatctacacattatgatattacattggggctttattaaggcatcatgagctatatcagaaatacttgaaaacatatttagcctagatataatatcaggccttcagatgagttcaatgtcagtgaaattgacaactttagcctgtagaaatgtcatagagttatttctgctttgtaaaaaggacaatcataagaaatacactttgagcattatctcagttgggaaatactcctatgaattcagggtaatataaattgaaaatagattttatcatgaacatccaaaccatattagacgagctagcatataattgactgataatgaacaaatgaacaggaagtgtgtcctctgggtttagcctgctaacattacatgaactaatttctatagttaagaggtaattgtcagttgaaactatcttttctttgtacttcttgggaattatttgatcattacatacaggagccattattttatatctctacatctctccactgtatactgtcttctatgctagaatgttatctttctgcacaccaacccccccctccaaaaaaaaaaaaaaaaaaaaaaacagtcaacatcaccaattctgtgcactctcctggacaaaccttaccactgacactggccactcatcttccccattcccaaaacccacaactcatgactggttgacacgaccccttacttcaaaagaaaccaactcaagagcatcctccaaaatcaagctgaaacttattttcagagggagacttcatctttacttagcttccccatttctataatttttctcattgcctttcccctgagagcactttctcaggaaattattttctcaagaatttctgtctcagactctgctttcaaggactccaaccataacaaccttcctgattctccaaaccagttcttagacagcaaactccatcttgatatatctgttccgctacctctattgtaatgcaaaatgaatcgtattgcatggcttaggtgtctttcttccctacaaggctaatcttcttgagaaagggatgttgttttattgtctgtggattatgaaagtctttcacatagtgcctgacacatatcagatgctaaataaatgctgttgaacgaataattcaaaatatgctgctctgtattagcaccaagagtgagttttttaaaaatattctaatccaaatgcacaagaatattcacaaaaaagccctttaaagataagcggcagtatttcaaatataaggagattctagttttccaaaacatcttacactgcatcttaaaatcagaataattggcttttatcaaacctgtgtcattttaataagggctctcatgaacttaatatgattcttaatagaacactgcatgtgtaattagataaactgtaacagctaaagctttgtaaatatatttaaaatcataacagataaatgataacaaagtgaattgtgaattccactgaggtcaaaatacaatgaagagaccaagtaaatttaattttaaattgaactcctttagtattttctaaacaatgcaaacagtgttagtacctaaaagtcatttgattgccacctcagtgtctttgtttaagtcgatgcctatttatttttattagtggtgctttgattgaaaaattcctaattttgcaatccatatttaaacttcagaaaaaacgaaagcaagcattagtggtgataaaacaagaaagtaaggaactcatcatgtgaatacttttctgaggccattttgttctcactaatattgtgaaaaatactatacttaggattttaaattttctctataattgcaatagaattaatattctacagtcattggttaattctatgctttatgataatgttataataaatgcctattaactataattgactagaaaggagcaggcaaccagcatgtctaatgactaatttgggtattctgagcaagtacttatgcactttcagtaattctgtatccacatgacatttttggaaggaaatcaagtacattgactgtcaccttagggtaggggtttatttcctcttttgtttccatcttaattatgcagctttgatttctgcagttcttaaagacattttcaaatttaaaaaattttcttaagagtaattgaatgtgagatttttgcttctatatatttctaagctttttctaatcacagtgaggtgtgaaagggctttttgtttgtttgctttgttgttgttgttgttgttgttatgttttcccttgaccatcccaggcctaagggcagtgcctctcacagtctactatgcgtatgaatcacctaggatcttgttaaaatgcaaactctcactgagcaaatagggagtatggcctgagatcatgtaattctaagtagctccagcgtgatgccaagcagttggtctactgaccacactttgaggagcaaggtctgagctctgagctgcatatcctttgtagtcccagacttagtctttacactaagacattatactaattttcttcaaccaaagaaaattccaaaggattctaagagatgacatttcagagtaattgtcacattctacccagcttggaccttcaaacctgactgtcagcttcagcattccaggatccatctctgattcttttggctttccaccaggggtagagccaacccatagatgacttcagcagtgacattctagcacattagcactcagcagtggccttttgagatgttggtgaaattttctgcctaccaagaaagtggagttggcacgatgtacataaacttcatgatgacaagaaggcaggatagttagtggcagtttgacaagtctctctgcatgaaaacaaattaagatgccgtgacagctctgaaaaaaactgttctttttggcatttccttttttccaatgttctctgagcatgctatctcaatttattataaagctacacatacagcccaggaatttctttagcagccaagtcacacctcagagttctgtcagttgtgaataaccctcaagaatttttactccctcgtcaaatgtgcttgtgtagtattccagccatcagtcctttcatttcaataaaacttttacattcccaagtgctttcacatctttgatcttatttcatcttgccttccgactgagtaaaatagtatggataacctttttttaaattcattgacacaataaacattaattaaattcctgctacaggcaaggctatatgtatggtaggtaccaaggaagatataaagattaataagtcatggcactgccctcagagatcctgagcagagagttaaaatcatgtgcataaattgcaaggtagagaggcataagtgcttcagtgtgctgtagatcacatgggagaatttatcaaaacatgtgatgagttctagcccagagcagtgtgtgagaggcatagaaggcaccacagtatgataacttcataggtggcctttaataatgagtggaattttgaggtgaggtgtgggctgaagctatagcaacacatcacggagttcagaaacaagagatactgcttgaggaatacatagcatatcatctttgtgttgtgcatattgttatttttgtatttaaaatatgaagaaagtaggttgatgttgaaatatggaaagattatattgaaaagatagggtttagacttccattgacgcccctaaacatcctcttttacagattaacagtatgaggtatggaaatgagatgacagatcaagggtcagaaatctcataagtggcaatattgttgctaaaacctagtatctggacctgcggttctactctgaaggacagtgatattctgtatcctaatgccaccatctcactgcggccagaagcccactaaccactccggggtgcccagagggagggagaaaggttcacttcctaccccagggacaagaaggttgaaggcaacaagttacttgctttgatctgaaaacatataaaagatagaatttaatgctcatttagctttgctttaggaatttttgtactaaaatacctggatttttatgtgactttttttgatgcatttttacttttgtaaacattttatctatattcatgcttcatgtgcatgctttttacaagatgtatgacttgccactaaaaaataaaaatgtgtaaattgcattcggctagccatcatatttaatttttttcttaaactgtgttattacctcctaggcactttctgcagcacagttgttcaagatagataatacatcgctagggcttttcacagcgaagaaggggattttaatgaaaatgccacttttaataagaagcctcaataatatgtggtcttggttgttccagctgagatattaatgtctggcacttttttttccctataaatcagtaacaaaaagatggaaggaatttggtttgaaacacaatgctaaagaagttggaaaaataattatctttagaaaggacatatagcctatataaagtaaaattctcaatatttactacattatacactatttcttttatttttcatttctcattgctacaaagcctcaaagcttacataaaaaaaaactaggagttgtcaggcagattttaattaatgtatttctactttttcaaatttcacagttttagatttgtttctagagtaaggggtaaaaaaaaaaaaaaaaaaaaagacaaaaagatttaaagtgattcaaaatctccagaaaaagattcaaaattcttcaaagtgtttcattctgtaggggctttgatttcacactaagggaaacctgaccatgtctaaaatgtaaacataaaaaattattaaaatgcatatttctatatccttctctccccattcctaccaaatgcccaaatcaaccatttgggaagaatatatatagttgagaagaacagggtgagtaatacaccttctcattttttaagcccaaaagacgaagaaaatcgagaaagtttgaaatctgggaaagttatccaagagttacttattcattcctgcactcttgaatacgaactgtgagtcaggtgatgtgtagcagggagacccaggtggaaagattggcagggggcactcatgatgtgctttgtagccgagcaagcagatcggattttattttcagtctagagccctcagcgtacagaaatatccttgattatttgtaaaggaaagggcctggaaggaaaggacagggtggatgtaagcacagagatagcacaagcaactactgaagttagcaaaattgaggtgcagaactcggtgagggcttagctaactgttagcatacagaaacgttgtgaggttaaaggaaaggggctatgtctattttatttaatgtggccctgtctccattaaagcacatggagataattatatcagctagattatgacagaacccacagaaatacatcatacactgtgaaacagagcataattttcttagtgctgtgataatgcaaaacaataatttatcatgataaaaatcaaagaaaatgtgtcttcttggtgaaagatttttctattatgtctgagattatcttatccattcttattttcttttttcactgtatgtcattgcaagagggtcttgtattttacatcagtgggtagtattttgaatatatttggtaattaataaacattttaaagtcatttcgttgtccactaaagttctgctaaaacatattattcttaaaagggcactggacaaacggtagtaaaacaatatttatatctcttttttgtagttgttgttttgttttgttttgttttttgtagagatggggttttgctgtgttgcccaggctggtctcaaactcctgagctcaagtgatctgccggccgtggcctcccaaagtgctggtattacaggtgttagccaccttatccggccaatgtacttatcttttccgtaaactacctgtcagttgttaatccaatctcttcatgtaaaaagggattggattagatgattgctacaagttaatttaggtgtaatatttttctaatcctaatcacaaataaattcactatatttccaaactctttttgaattttttattttatatgtttacagttagacatatgccctgatacttatagacaggccctactggaaaatgttggtcctacagcctgtgcacagttataacagaaaaataaacaaaacccaagtttaaagagctccatatcttaaatagtcattctgggcttaagaaaagttaaatattgacctattattaagttaccaattcattaaaattctttttttctgataattattccagctatatgattgctcttgtttttctggatgaaataaagaccatattatctttggggcaactcagaaacataggtcagctcacacctattagagccaatagttgtatggtaggtgaagggtagaaccactcaactaaagcccaaagaaaatctttatgcattttcacaagactttgagatcccacaagataaaagagattagaaaaaatgggaggatccttggtctcagatttaagagtctctgtgatcatatccaaagctctgtgaggatttatatggcatcacttatatggaaggaagaaaggctgtctgagccaggaattcccaatactgcaatttattttaaaaatactctgctttcaagtttgggggcattaatgatacttcatattctgcctacttggagttggacaggaaaaaagtatgcaaatagaaatcagaggctgagtgtctttatgaatgtatctggatgagcttttcctccaaactatctttctgaaagtagtagtatacattatgcggaaaatagtccatgtgcaataaatattaccaatctattgctattactatgtttcactttttaaagggtgatggagatttgtgatgaaaccaaatatactgtagcctatctccctcctcattattggcatattaaagattctgaaaaaactatttaaatttgttcaactaaatattttccaaatgtaaacagaacttattttcatgaaatgagttaggagccaagttttggaaatatcagtctagcaatagcctgtgagtaaagccatttcagctaactgttaatgtactgacttccaaatgtgtgtccacattgcactaagaacagcagggtatacaaaaaaatgagatgacaaccctttttttttaatctaaaatgggaagatatggccaggtgcggtggctcgttactgtaatcccagcactttgggaggctgaggctggtggatcacttgaatccaggagtttgagactagcctggccaacatggtgaaaccccatctccactaacaaaaaagtacaaaaattagctgggcgcaattgctcatggctgtggtctcagctactctggatactgaggcaggagaattgcttgaacctgggaggcagagtttgatgtgagctgagatcacgccactgcactccagcctgcgtgacagagcaagactctgtctcaatcaatcaatcaaataaataaataaataaataataaaataaataaaataaaatgggaagatagggctaatgcacaaaaaataaagacaacaatgtatagtcacgtgctggattgtttgatactgaatgcaatagttagtgagacatggagaaaagggtttttagatcagtcagaggatttgacaaaaatggaagcagaaaaataaaaaagtttagactagaagtcagtcataagagctcatgaaaacagaggccttgtagaagaggttgaatttgagtatgcctaaaagactaggagacttaccacatgcaaagataagatgtagaaaagatgctaaataacagaagaaaacttctttaacaagcagtgcggagccattgtacaataaaaagcagagcggtgaggtaataaaagcaatgctttaggcagataactttggaaagagtatgaccattgggttgaatgtaggagtcatgggagtcagagaggatcattttgcctttgcaaatgttctggcccacagagaaccactgcacctctacagtgtttctggacacagataactgatcacactccacttccatgacttactgtgggaacttgagcaaattcttgaattttctctgacagttttttcattcaataaatgaggacaggaatgttatctatgtcatgaagtcattgcaagtcttaaataaagtgcatgaagccatgttagaacagtgcctgccacataattagtgtgcagcaaataagttagctcaaattagccgtaatggaagggaaagaaagaaaaaaaacaaaacaaaaacatttcgcggtgttaatggattttgtaacctactgtagcgtggaaggtagttcggtccactatccctcagcccctaactgttccaatgttgccatcttcccagccctttcattcagttttctacactgcagttagagttatctttttaagatgcaaatcagatgactccactgcccacttaaaccttttccatggctctctatagccctcaagtttatgtccaacttccttgatacattatagagccctgacccaccttcgcctctctagcattttgtctcatcgctccctttcccacagtctgaactcctaaaaatgcattagtttcccacctctgggacagcttccttatggtaatattctccttcccttctttgtctagtgtgcatattaacatagaacacataatacaaatttagaggtatggaaacattttcacaatgtatgaagattgtgaaaaccccatttccaattaaaacaaattacaaaaaatagctgggcatgatagctggtgcctgtagtcccagctacggaaggctgaaacaggaaaatcacttgaacccaggaggcggagtttggagtgagccgagatagcaccactgcactctagcccgggtgacagagcaagactgtctcaaataaataaatacaatacaatataatataatgggaagatagggataatgcacaaaaaataaagataacaatgtatagtcacatactgaatttcaagaggtaacttgaaagagatagtagcatgccaggagaggagtttttctttcagacttgggttatcttggttacactgaaaattaaacatgcaatcattccatgttatctcaaatgtgtatgtgcattttctcttaagttactttaaaaaataagtaatgtattcaaagaacaaaaggatgtacagtgaaaagtcttcctgccacttcttgagtgtcctgcaaccactcacgatcaatttcttgtgaattcttccacacatactttgtgtattttaagggaaatatatgtatatgcaaatctcccatgtgcaaaaatgtataatgtgttatgtaatcaaatttcccagtgttttctgagtaatggtttgtgtgtagactttatttactccaagattatagaaaagaattcatgatatcagctggtatatttacgagttattttttacatttaaatttttgatactggagtcagatgtgagataatgatcttccctcatttttttcagaagtctttttctatttctttattaatccattattttgctcttcatttgaaatgttcccagaatcacagactttaggcttgtgtgtactggggctacttatggactttatgtgctttcacagcaatctgtctattcatgtgtgtcatcactctttctatgatttgtgcatcatatctgctgaggatagtggtttcttgttatttacctgttccagaattgttctggcaattcttgtttcttgatttttctatataaattttagaatcatcttgcctgaattagaaaaaaatcacatggcatcatttaaatggcattgcatttactgattaattttgagactttcaatacctttatgatgtttaatctttgtatccaagaaaatagtacatctttcttgtttttttagtcttcactttacgttttctacacataaatgctgcacaagatagttggtattgttactaattttaatgaggcatttaataaattataacttttaactaatatttgtacattatattgaattttaactccgccccaaaaagcaaaagtaaaggaaagtctaaaagaaaaactagaggaatctaattcaagactactacttttaggaatataacttggaaaaagctcttccaggtacattcatagagacatctctgttacagtttctgtttggcacactctttttttcataatgtaaataggagtgttaaggttacttgtgctgatgtgaaatatagcccgaaagtagcttaaaatattttctacttacacaatattgagtcatgcaagacctttcacaaaacaaagactgggatggtgaagcagtctatataggttaaatattgaattagataggaaggggttcattaatttctaaatatttccttttagagttttatgccaattagaagttctgtttctctcttcaaagaatagttcttcaataggcagatatttaccaaacacctacaacctaccagtcactctctgaggtgctgaaggcacaaaaataaaactgactcagttattgccaatgagcattttgcattctaagaacaatagtctaagccttggaaattgttttaaaagatttctgtgtgctttttcaacatcaaagcagaacattgtggctcaaggaaatttgacactctaattgggaaggtaattttgtttgatttactatttactactgataagggcacagactatataaattacatattaatgtgagaagattgataatagcaagtgatattcatccggcagaaatgtaaatggtttctaataaaatcatagaaattgtagtgttattcttctgtagaacattagcctagtctgtatttaactgaataaacttatcccaccattctttacattccacttaggtgtatatatgtatacacatatatgaattcaaatatgtgtgtatatgtctattcacatgtacaccaacaatatacaccagtatagcagtcactaccagtttctcctaccctcttttgagccagctttaccattactgtgattccttcattaataaactaaataaatctttgctgtgttctcactatatttttgcataggagtgatgtttttaaccttattaaaattaaactttaacaacatctataaagtttcctttgttcttcttttccacacttgggctaatttccaatgccattgtgagacagtgatggccctttatttgaagaaacttgactttagctttgcattaaagtgattacaaaatactttaaaattctcttacttctttttgaatacaaatagatagtagaagaataactcatcaacagcatactcacattttattgtttctcaacactgaattctaaattctaaaacaagaccattttaaattattttgagcacaagctagtcatttttcaagtaatcaacaatgcctcatcggattagaatagaaaacattgaattgaagtaaattgaattgaaagtatcagcaggcattgaacacagcaagagtaagcaaatatttctacagtatgtatgtattagatcttttatactgggtttacactcagaaaagtttgaaagccggtggtttaaatattttttgctcagattttagaagatgagtcattgtggacatgtgagtttattctagaaagtatgaactaaatggtcatccatagtttaacattagaatactctgggaaaccagatatttgtagtagcagcagaggcaactgtacttctctctacattcttgtgtattcttcgtgcagacacatttcactacaggatgagactgttgctgaaggactgctttccaactcagttatgatgtgttgatcacagaaatgaaaagaaaggctttataaatccatccctaaaccctatcattacatatcagaatcaaattcatacaagataacatttagatctaaagcgaaaacaaaacctaggccaaagggttctgaaataagcattagagaaataaaaactaaaataaatccaatctcaggtgtgagatggaacaaatgcttttgcttatctatgttttatattcagtgagtgtagtgcagaatactctcctttatatcactttcttaacatatgcttgaggttcaagtgggcatttggccctcttcaatctcgagagctctgtgtagctcctctaacaaattcactgtatttaaatgaagctatgttataaagccgactaggaaaaagacatctaaatgcgttttaactccagaacctcttccatcaaatttccattcgtaactgtggcaccaaattttagtattgcagagaaagaagaagcttttgctgaaataattccatgctgagacagctctttaattgggaacttctgctaagctagaaaatatgttcgaaggtcagtacaaggttccagctggtaaatgatctgcatttttctaagtgactgatttttttaatcacaatactgcatctatctgatactattaaatacaaaaagaaggggcataagtttgggtcctcttttcatccagaacgcaattttattctattgtcactctctagattagtgactcaggatccagagagaagtattgtggatgcatgtgggtagagtgtcctttaattgagtgcctgcccccaacaggcaacaccacacctctaatgacagacttagtgagccactattaagattgtttcccgggccgggggcggtggctcaagcctgtaatcccagcactttgggaggccgaggcaggcagatcacgaggtcaagagaccgagaccatcctggctaacacggtgaaaccccgtctctactaaaaatacaaaaaataaaaaaaattactgggcatggtggcaggcgcctgtagtcccagctactcgggatgctgaggcaggagaatggcgtgaacccgggaggaggagcttgcagtgcgccgagatcacgccactgcactccagcctcggggacagagcaagactccgtctaaaaaaaaaagaaaaaaaaagattgtttccttcaggtgtatttaggtataaaacggaacctttcatttctctgatatggaaggtgttgaattcaaaagttattctggcctttttatattgccctatatctgaactacatccttgtcaagttcaaacttgaaagtggtcaaaagtagtgttctatgaagcattgctgttcagagtgcagagcaataagggctgatcaagagcaccttaaaacgcagtctctgcccaggagtgagaatggattgggctcatccccgaacggtcagtgagttgaagagctattaaatttgccagaatggccccaattgaggttttcataccttcctcctctcccagacagtagaatttaactcagtgatggcggccaggtttaagagtgtttttaggacaattgcaagtggaaactttcccagggcaaagaaataatgagcactaaagcccaagagacattgttttagtagaactattttctctgtaaactactggtatcagattttcacttaggaagaaaaaaaaaagagggagaaggttaagaaataaatgtacctacactagctagttagacttcttatgaacatggctaaagacataacttgagcctttgcaaggtgtctttggcagagatctaaaatgcattgctgatccccaccctcccctctagggaaatcgcttaggcattgtctgtgtagatatcacctggaagctagtcaaaaatgcagaatctcaggccctgtggcaagcctcctgaatcagaatctgcaatcctgacagaagctccaagtgactcatgggaacattaaagtctaagaagctctagttttagtgacatccctctcctattagaatacttgctcaagttaagagttccaaatttataataacaaagaagaaaggataagcatttttaaagttttttgcacagattaccaaatttcactttgggaaggttttactgacttttatttgtaccagcaaagtacgcgagggtttgtttcactgcacccttgaaaatgtggggcatattattctttgagttgtgaaatttgcatttgtagtctatgtgatgtgtgagataaagatctaggcttcctaacaaggaagcagttttctcagaacaagtaaatgactaaagcttcgtttctatattgaattgaaatgctaccttatcctatatttctattacagagctttagaacttcatatttttcccatcagtatgggaaaatttttattcttacatcaggaccatgatattttaattatggtggttttttgcttggtttaaatatatgcttttggtagtcagcgtatccatctttaattgcatctaaacatttctctctatcacaactatgatataaatccctgcagcattttgtgtatgttttcataatatagatgtacaggaggggcagctttacacatgactttttaatagacatgtaataataaaagaggacacttaatcctaatactcaaaatactacatttttctgccattctgttatgtgctgatttatctttacaatatttatgatatgaggttcagtgggacagcaagaactgttgagtccctgcattcagcatggtaccaaacccggggacataatagaaagacattagaaatgagaaaaagtaaagaaatagaattcaagggctccactcttaaagactacaatataagtgataatttatgtttaggaaacagactcaagaatttaagtttagaacacatactaacaaacaggtaaaaacacccaattaggccaggcacaatagcttacgcctgtaatccctacattttggcaggccaaggcagaaggatcacttgagtccaggagtttgagaccagcctgggcaatatggtgagaccccatctgtaccaaaagaaaaaaaaaaaaaaagctgggcacgatggcacacacctgtagtcctagctactagagaggctaaggtgggaagatcacttgagcttgggaggttaaggctgtagtgagcagtgatcatgccactgcactctagcctgagtgacagagtaagatccggcctcaaaaaaataaaaaccaaaaaacaaaaaacaaaaaacccactcaattagtcagagaaaatgaaatgagcttgtattagtcttttttttttcttttcttttcttttttgagatggagtctcgctctgtcacccaggctggagtgcagtggcttgatctcggctcgctgcaagctccgcctcccgggttcacgccattctcctgcctcagcctccctagtagctgggactacaggcgccaccatgcccggctaatttttttttgtatttttagtagagatggggtttcaccgtgttagccagaatggtctcgatctcttgacctcgtgatctgcccgcctcggcctcccaaagtgctgggattacaggtatgagccaccacgcctggccatgagcttgtattagtctttaggctgctgtaacaaagtaccacaagcttaaacaaccaaaaattattattatgcagttctggaggctagcagtgaaatcaaggtgttggaagagccgtattcctgctcctggcttctggttgttgcagacaatcttcgattttggtttgcagctgtaaaggaagctctgccttcatcatcacatgaccatcttctctctgtgcatctatctcatcatatagcattcttctctctgtgtgctttctccttgttttaaaaggacaccagtcatattggattaagggtccgtcctgttccagtatgacctcattttaattaattacaactgaaattatcctacctataaataaggttacattatgatgccctgcggcttaggacttcgatatatctttttaggaaacacaactcaattcataacagttatctttaagtcaaggggtgagtaaataacactgtagaagtagtgtgggatggaattccaatcgctgccttcccaacaagtaataagtgcacattcagtttagaggaagttatctttcactgggcaatcagctttgagacaattttatctgatgattaagattcaagagactatgccattatcaataggacttagaaagggtggatgaaggaaagaattcataattaactctgcaaagtttatgatcctagagaaccgaaagaagacaatgccagctacatgaatgagtagtacactttacccatgactttgctgcatatatactcggttttgttcttctatcagtattagtaatagactgccttattataggtcatcgttgggctaatgtaaattatttttcctgcagtttatcttgctagttagacgtctttatttcgttctaccacaacacttgcatctgtgaacaaaaagtgtttggtgagctcatgacttgtctgaccatctgccactcactcaggaaattgctgcatttatgcaaatacccacccagtaatttgtgagcaagaagccaaggtgtttgattaaagtaattaattttctcacgtcatccttaaaatgagcaagatgcagaaccaggtggtttggctagtaccttctaagttgaccctcacttttcttggtttgtttatctcatgcgattgaacacaattctaagaggcagcatattacaaaggctgtatatcataataaaatggtctttgagaagatatggccatataaatatagacattagttttatgcttatttcaaaatgaagacccaaataaatggaggtttggaatttgaaaatgttcctttcagtcagaagaaatattatctaactgcttacatatacacaaagggatgttattctaaatctattcaaaccaagagcctctttaacacatgaacaattcatttaatttctgttatttttcccactgttccctgactgggaacaatgtcctcacaggaataattaccatgatttttgaaatttaataaaatccttagtgctttgggaaaaaaaaaagataatatttatttttacatcgaatgttggatttcatagaaccttagagaccaagtctaaacactcttatttttaaaaattatggaaccttgttcctttaatttacttaaaaataaattttcattttttctttaagagaatttgaatgggatcttattttccatgctttaaaaattaatttgagaagatatttgactttttttctttaaacaaaacctttaatgctatgttagaatctgctgtatgacattttgactttcatatatgttcgatcaagaggggtccagtgtaatgcttaaatgcgtgctttctcataaatgttagtaagttacttaattttccccaaatgttggaatctgcatgccatctttataaagttaagagattcatgctgttctttatgcatttgatatttacagttgaaaggcctgtatcataagcaatctggttcacagttaggcgtttaacttgacattttataaagcatggacatttgagtcctcaatcctttcagcttgttttgagctaagtgtgaattaaatggtgggtgtagaggctgtgcatgatgttttaattaataacccttcttgttacaattatttttatctggctactcagaaaatgcattttattaaacaacaattctatttttactcacatgtagaaaatatatcaggtaataacttcccacaaaatatcaagggagaattctaacttcattttttctaacattacctacctatcagtaaacctatatatgtgtttttaaaatatacatttttatttggtgataaaacaatacattcatctcaatatacacatagtgtgttattggaagacctggaagcaaattgctgcatatattctgataactatgtgctacccaggacagaattgacattactagtttcaaatgagtcacaaccagcagtaatatgattgaaaaaaacagagaccaattatatatcctgagtccttggcaagaaaaatgtagttgacttataggttatttccagagattggttttaatctgcaaatttatatctattacatatcttgagcattttagttcagagattataaatgcagctttagatcaaatagagagaaaaacaggctaaagccattttttaaaaaatatgtaagcctgataaaaacatgatgaattctaccctagaggagttctgagagctgattgtgccctgggttcaggatgtttttcttcaaataggagaagaaatcataggtcactttgttccttcttccatggactgcccacacatgagagcacaaggcaattaaaaatagaaaaaattattccctttatcgagtttgtcttcagtttactgtgcttgtcatttctatacatttgtaactcttccttcagtcaaccttgccttcagattttctctacctgccattttcctacaacctgtcctgagaaaatatctgacgaaagtaatgtaaactaatacttaaatgcttaataagtcatcacttttctaggttgtggtttaatagagtaaagtctctatgtctttgtggatttcaggcattcatgttccaggtggaggaaatatttggggtgactaagggctcatctatccttgtgctccctaggtttcaccagtcaatttaaatcttgccctcttttcaagcttctggctctcctaacccagcagctgagtacgattaaaagagaggtgaatagtcatttgctcatttgacacacttatgcacccttgctgaccctcaaaaggcctcaccacttttgaagtggttctttcgatgtatttataaaactattcataaatatgagaaaaaagctatagaggtcaaatatcatttccttttgcttccctcactgattttattcttgaattttctccagagaagattaatgtcaagttctactttaatttaaatgggacataggtgatcatttggctaacacagttacataaaagcattttataaacacatattcctaaaatcatcctttggagactaatggaaaggatgtatatttgaaacatccacaaatcatggtacatgttgcagctacacaggaatcacaatggcacccaaatacaccatggggtgatgatcttcctattttatctctgccggaggctctacttcttcccaccaatttcccaaatccttgtctcttattggcaaatctgagaaggatttaagcaagagtagatgtcatttatgtttcaataagactaacattaaatgtaaaaggaggaaggaaaaagacccatatacatttatattgaatgatacacagttacttcaattatctgtattttaaagagtagaacagaaaaccaaccatgagtcacagaaaagtggtcatgaagaaaattaaaatagctctaaggacataaacactaaaagagcatcctcccaccgactaacaggtgcaggactcaactcaaagtagtcaggctgttgccatatggtgtccatttagagccacagcctgtctggcccacggctgtgcaacacagtataccaccacctgtacccagacctctgcaagaaaatgtggtctgtatctcattttgtgggggaatagaggaaatctttgggagaactatgagcaaatagatgatagttgaagggctaccctgataatttttctgggtttgtatattgtgtcattgttactgataggagggacggttagttagaagtgcagaaaaatggtagttccagacttgtaaatctacatgatgtttaaaaatagcaagacattatataaaatccaaaatagaaagaaagaaattatgacatcctgaggctgttgaaaaaaaaattaccaaaatgacaggtgtttttccaactgtgtttcctcttctgagaatgcagaaatgtcctctaggagataaaggcaaaatgaatcagtggaaaagactcacggactctttactgtggtactgaggccacacggactccttttcatcaacaaccaaaatattatgaaaaacattaaactaaaataatgtgaaaagtttctaatacgtgactaaaagcatgttggttcacacttatatatggaatttccatttcatattaaccttacttatattttctactattggataaaattaggactcttattaaaaaaggcgggttctcttgaatttttttcttacaatgtgcctatgtaagaaagtgcttcatttggtaaatgcaacaatatatagcaaatagaaaatcctcatccttgtgcataatacctaccattttgtggcaatattgtatccagaggctattaggatctctggaaactgcttttaactcttctatttagcccttggtagggatactctttttcttctgtttgaagtaatggtcttgtccaagaccattccaatgtaagcagcagtgtcatactatgtgggttatagcatcaagaaccatgcttatcaatagatagatttgggcaaaccatattgtacccccacctccaatggttttggtgggttaaatgaagtttgaaagccaatagtggaaatatgtaatagtaacagaatcaccaaaagtctatttgagaggcatatagaaagctgagaaccatttctgctttggtgagcttttgagctgattataaaaatagatgttgttttaagcagtgctaattctatatcctttaacctaaccggattccacatgaaatcataacccataatgtgggaaccatggatgttgtcatgaataatttaataaacataaaatgtgtgcttgatgttctgcaatgtgggactttgaggacgaaaatcttaggccttgatccaagcagtgcaaaatccagcaagggtgagaaatactagctatgctatatttgtgaagtgtatgaagagagatattcatgaaccaaatattatcaaaacacagaaaggactaaatttccctctagcaatcagaaacagttgaaaacacatcacacatgtgcacaaaactggcatgggagatgattctactggtcactcataatggatttttgactgttccagcctacagttctttcaaagtagttattctcgacctgggccactgttggaggttttgagtcccctaagatttagagaaatcagtttttgagattcactggagatccagaacaagaagtttgaagtaaggattggacaataccccactggatttcccgctgggctatcccagcaagcctgatgagatctatccccaaatccctttctctagggcagtgactctttcgtttacaattaaagcatctggacgtttattagaaagcaaattctcaggctccatcctagacctactgaattagaatctctaggaggggagccagggagttcacatttcaataagttcttcatgtgattcaaggtgtgctaaagttagagacatactgctagtatttagttatgcaacttcagtgttgggtagatggatctaccacaggtaatcattagcccccagattcagaagggttctccagtaagtagaaagtttcaaggactgacaaatcttaattcagtagttcagtaaatatggaattttcagtagttttccaacttggctgcatgttggaatcaacttgggtattgaaaaaaaaaaaaaaaagctcatgcctggatcttacccacggaattctcatttaactagtcagttttataagctacccagatcagtccaatctgcagtgaagtttgagactactgcatcagaaagtggtggttcactgacctttatccactaaaagcctatgggagatagcaaaggaaacaatttttgacagaaaagaacataaagggaaataaaatttttaaatatgtcaaactttattctaggtttaaatcacatttttgagattttctgtctaggaagacgttcttaaagaatcttcctaaataatgactgagtagcacagatatttcagagagactgcaggtcagaatagagaatctttattcacattatatttaaggatatcaacattttgaagcatcaaattaaaccatgccctctgtactttaaatcattctgccttggtcactttgtgttgctgtaaaggaataccttaggctgggtaatttataaagaaaagaggtctatttggctcataattctgatggccagaatgttcagaattaagtatttacatccggtgagggccacaggctgcttccactcatggcagaaggtgaaggggattctggttgtttaaaagagcctagcacctcccacctctctcctcctttctttctggccagtgtgtgcagagatcacatggccagagaggaagcaagagagaggtgagaggtgctagcgtcttttaaaaaaccaactctcggatgattcataagaatgagaacacactcaccagctccccccaggaagggcattaatctattcgtgacaaatctatccccatgacccaaagaccccccattaggctccacctacaacattagggatcagatttcaacatgaggtttggaaggacaaacatccaaactatagcacttccctacttcatttttcttcgctttctctccgtctcgctctgtcgcccaggctggagtgcagtggcgcgatctcggctcactgcaagctccgcctcccgggttcacgccattctcctgcctcagcctcccgagtagctgggactacaggctgttctcgtttttaatctcctgattgcctctacctttagcatctgataacctccttctaccatcaaaaaatgctttcatttagagtcttctgtatttaattaatgcacttttaaatatttactgagcaactgttttgggggtcacagcattttcatagttatgcgatgatttcttcaaattgttcaaaaatgtttattgcattcctactatcttcctcgcactattctaggtacatcacggagcaaaacatccaaaaatcttgccattgaaggagcttaattctagtggagcaaggaataaacaataagcaatatgtaagacagtagatagtgttctagaaaatagagactatgataagtgctataaaaagagaaagcagaatagagtaagggaaattgatagtgcagggctagggaatgagaattttacaaagagaaggcaacatttccatcgaaacttgaaagagatgaggttatttgagggtagaacatatcaattagtatgtttcatgaaatactagacaataacatttttaaaagattttgtgttattttttttcagttaaaagaagaaaaaaagcaacgctttctcctaaatcgagactgctctactttcatctttcagcctgtttcatgttaataggtgtttttagttaattaatttcttccttaggatattcatgtttgttcatgaagattgtaaaatcacaaagttcatgtgattattgttatgttattagggaattatctctctgcagacatttacatttgcctctcactaaacacatttgtgttcctcagcattccaaggttgtgtgtggatatgtctgcatgtgtattttagtcacacaacctgctgtgtatcttaatgagacctgtaccataaccaattagacacctgcagtagaatcacactgtgctcccaaatactcattttctctgctcgtcaaagagttcaaactgagtcaccttcacttcaagtctatgcagctttttactaaaatctcaaagttgcatgggggctttactcctttgctcaaaccaatttttgtgaatgttgggtacgtaaaaacatcttcaaagtaaacatttagtaattaatcaatgctataaatgtgtaatgagtctgttctgcaagggacatcttgttagcttttgagggcatataggatactatttgaattggagtaactttctgtatactctaaagaacagctgccaccctcagttctagatatgtcttgggaggcttatcgtgattagattttcacattatattttcttggtaattatatcttaaagcccttaagttcaaatgaaattcgaacaagtcacaggtgatgcaactaaattattggtcatgagcgtatatgtcacatccgaaataaatcttgttatatcctcggaaattagaagtggtccttcagggagtcactccaaaactgaagagggagcaatattataaaaccattgttagggcagaagaatagtttaatttatagttcttttttatttgatacaataactgatgagctctaaatctctcatacacaaaaatctgatcttttttccctgcaccaatttaacttttacttcccagatttgccctcaaagtactccacacagcagcttccataataatgccctccacctccatcaatgtgctaatcagtttccttactcaggctttaagggagacacagacccttcgaggcaaggcagacaggaagaatagcaaggcctctactctgctcctcctccttcttttcagtcctatcctttgcctcctagagagcccctagttgtcttgtaatattcaccaaaataagttataaccgtaaacttctatgttaaatttttttctgcagaagaaaataatcatattacaattgattctgagtttttaaaatgttaatatgactaattttaaagcaaaatgttgattgatatacaaataaatgttaaattcagatggttttattttctgttatatttccaagaacgtgctaattccaatatttactatcttccattaatttatattacataaagctttctaggagatgtaagtaacatttgatttgaagtaatttaaaccttcatgttacattgactacacttttgcattgtcaagtattttaatggagaaatattgaaataaatatactcaaaatttatcaacatttattttaggatttcaatgaatgtgatttaaaatacatatgttgaatttttatttctttcaaaaatttttattgtaccatgaaagctaagattttttaaaaaaaggaagaatttattttattatgccattacattcattacactatctgtaaaagcatgcgaaaattctctctgcacattttgttgagctagccatatttatataattggcaatatataaaagttcataaagcccacagatcattacagtagtaatcagtgctgattctagttaaaaaaaaaaaaaaagatagaaaaggaaagcaaaagaaaaaaagaggcatagtacaagtgtattagaccatttttgcattgctatagagaaatacctgagactgggtaatttattttaaaaagatgtttgattggcttagggttctgtaggctttacaggcagcattgtgctggcatctgcttgacttctagggagacctccagaggcttacaaggtgaagcaggaggaatcaaaagagagagtgaggaggtgccacacacttgtacataaccagatctcctgagaactcactcaccattgcaaagatagtaccaagccatgataggtctacccccatgactcaaacacttcccactagtcccctccagcattggggattacaatttaacatgagatttgggcagagacacatatccaaactctatcaacaagttacaacacaaatgagattaagattatccccattagtgttctgcatatgtacttctttctgccactgatcgttttgactatattcacatgagcaagaggaacaaattgaagggattttgaaagatatcatttgacttaatcgatgtaatgacatatacatttttgtgatcttaagtactttagaacatgtgaggtactttatagagcaccattcactccacaaacatttaggaattcctaaaagacagtgattctttctggaataagaagtacaagaaccaggatggacttgcctgatgagagcagctcatcaaggcagatgtggacagataattggctgacagtcaagttgggaaatagagcagagtgagtgaagttagatcactacttgtgagatcagttagaaaaaatcaggaaactcgttccatttcttgttcaaaattagctcaagatggggcaaagattgaacaaaacaggaatatgagagaaggggaacctgaccaaaaaacagtcatgaacaagaaccaaaagaagtgtaagagttgttataatatttttggtggataaactaagaagcacactggctggatggtctctcagtaaggtgtagttccaggctgaccatcaatgaggattgaccatgaattgacagaaattaatggaatttcacactggagttagaattccaagacaatgaaaatagcacacaagaattacactactggagaggatttgtgaaatttgtgtgtgtacaagctatgagttaaaatcttatattcgagatatagaaattataaccttactttctacagcacatttagaacaaggttactgtagctaagcaactcaaaatttccaagtgagcgtaatcatccctacagattttgaaagcttaatgcaagtttccagagtctgaattaaattaaggatggctacaatgttgaagaattaataaatacctattcagaagaagatgaattccatattcacaaatggaatgtttaagaattttaaaatttaagcagcagatttgaacattggcaattctattttaaaaaataaaaaacatgtaagaacagatctataatacactttaatcttaatacttgcatgtcttactacttagaccatcaaaagagacgaaattatgtgtaaaatatcgtgagcttttattatgtgcccagtaccgtaatagactctttacagtcatgatctcaattaatctatacagcacctctattggggtaactactgctatccattttagagataagaaacctaaggcaaacatgctcgagcaaggtcacagacaagtaagtatcaaggcacagatgcaagcctgtctgcctctggggtccaggcctttaactaccacattcagctgttgaggcggacagataaacagaaaggccaatacgaaaaggaatcttccctatgtactctcaaagtgtggaatttagcttctaggaagaaatgggaaaaaaaagaaaagaaaaagagagagaccataaagcaagctaaaccccttcttacttttgtttgttttttctcagtgatgcgtgtgatcctgttaacatcatacttgatttaaatgttttgttttactgttatatgtaatgaaagataaacttcttcccattggctatcatgagacccccagaagctgctgcacaagagaatattcttattaagaattttgagtaggctattaataatttctagtaattataaaattgtttaacatttataacattgaggaatttatttcaaaactgcaatattattatcaacattaacgactagtttcacggtcatttttaaaagatgacagtggagagcaagacctaaaatgtatttgccagctttaagaaggcacataagaaaaggaaacatgccaaagaatacagagattcgaatgagtaaaactgtattttaggctctggcactagttttgtgggcttgctaaatcactttaccctctgaattcttattcattatttacataaatggaaatccctatgtgctacaaatttctgtgactcgattatcatatttcaacccagaggaaactagaaattacatagtctgagcaatgactatatatgccctttgttggcatgacctgaattaaatcacttcaaactctcaggagaagataaaagggttttttaaatccagatcttaaatattcaacttctaattgttcattgctagtatatagaaaagcaatagatatttttatattgaacttgtaatctgggtccttgctaaactaatttattatttctagtagcttttttgttgttgttggcagaccctgtgggattttccttgtaaacaaatcatgaagtctgcaaatagagttttatttccccttttccaatttgtatgcttttttgttgttgttgcctcattgcactggctaggacctagtacaatgtcaagcaggagtagtgagagaagacatcgtcgccttgttcccatcactgttccccgtcttacaagagaagcattcatcgttttaccattagtatgatgttgactgtaggtgttttctatacatcttttattaagttaaagaagtttcttttttattcctagtttatggcaaattgcttttatgaagagatgtgaattttgtcaaatgctttttcaacactaattgagaagatcatatgatttttcttctttagtcatcatattttaattattcatgtgcattcatttatttaaatgttcctgtgtcatctagccttgtatttctcacagtgtctgaaatacagtatataattagtaaatatcttttcagggacaaatacgtgaatgctggatactgtgctaggtgctctactgttagaattttctatgttttatgctttatttctcttctctataagtacaattttcatttctgcaatatactttaggttgcaagaataatcgattcttttcatgcgtaattgatggtatgagtttactcttataaccctgaaatcaagaacaggtaaaatatttggggcatgtgctctattactcccttgatgtgttcagttgtaatgagtgaattatggacacagtatatctgtaatactaaaaactccatacagataaaacaccctttctcagcaaataaattttttagatatgtctgtttatgtctcggtgcatggatatatattttcctatccttaaaatcatttccaccctctttaatgatccatcttatgcttagtttcctaatcactaatagaaaatgaaaatgtatcttgcttagtgaaccatcctcagtactaaccctaccgggtatttgaactgcttcttggccttctactctctgtatttccccctctgtcttacaattcacttgcttgtgatggttttatctggaataatggattgttttgtagaattgctataatctattaaataaaattttctggaccagggttcggcacataaagccactaacatatatctgtaaagttatattctattctctgataagaatgatgctatgttcatgtaaaactgctttcatataatatagaatatgttactattcagcatgtatttcatataatatagaatatattaccactcaatcatgtacacactcttcgttatacacatcatgatatttggtgtaattcttataggactccttataggagaatttggtgaaattatagtggtgagcattccttcacgagtagatgtatcaataattagttttagatgaggctgtgtatgaaataaatataaaatgcctcagtgaatggatgttgccattgagcttattctccagctgggtactgtgattttcttgtcagcttattgtgtcacccacttacgtgacagaaaacctgtggtttcctcttatttgctattgcaaatagaaaactaggaagacacaaactgtccacagattttatcttatatatgagtttgcatttccataggactctagagttgatccacgttccaagttttcttttagtccatcactttaaaatagatgcttccacttaaatcaagatggaaaatctatattgataaaaccctatgttacatttcaggggagaaagggtatatatgttttatgaggtttttttgtaggttaagaaaaaaagatctttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacagcactcccgcctgggcgacagagcgagactccgtctcaaaaaaaaaaaaagaaaaaagatctttaactgaattttttttctatctaactattcatttcccgaatcctcttatttgttaagatagccagcttctataccatgagttcagaattatgttcatatgttttacctgcctcatcaaaatgaatggaatttgtccttccatattgtctggtatacgaggatgtttatcactatactcctttgttctcattccttaggccatgatttttcggcaaattatccttgggaggagccatgttgagtgtggctatacttatcagaattttctgtgtaagatgccattttcgcacttttccccaaggattcaccgagaaaaatcaaaagtgaatcacaatggaaagtaggagagaaatgaaataaatatcacagacacaatggcatcttatcactttatcaatgaaaattacttatggtgagttagatcttggcaaaattaaaaactttaataaaactttatcattttgacgtatgaaagggagactaccaaagggatatatgtagagaggggaaactatgctctgtcctctcttcatgaagcctggccaactaacaaagacccagaaagctaaaggagaggaggagaaggaacaatgctcctaaggttttaagcatggactatggagaccttcttatctcaatcagaaggtcttcaaagaagacacaaatcttcatttattacctatatttaaaatatcctattttaatatacctatagtattgtatgccagaaacaatactctggttactaccaatggattagtttctcagcttcagaacacatcagtaggggataagtgagtgaatagaactctattgaaagtctaagaatggcatgctttgattagaatgtcctggaaatgactaccaatttaaaagagcttagtatttccactaagaaattactactttttcagatgttgtatgtggaagaactgagtctgtcttgacaatgttgtattgatctggatgaaacaagatcaacaggcattagttactcagtgactaggctattaaaaaataaatttgaaattatttttctggcaaacaaacacaaatttataagaaatgcacaaatttgtttatatgttatagtatgtttattgttcatttgcaaataaaaatagtcctttcctcatcttgcaaatttatttatcaagtgctatcattatatagttgctaactattactaaatatgctgaatatatagttgctaaatattaaccttatgtaattcatttactataccttcagtttgcttagcatatcaaactttattgttattttaacaaaaataatgagaatagtaacatgttcatagtctttttatttaatttttaccatccatacttgtttctagctactaatatatgttttccaaatattttcacatgcattgttgcatttgcactccagaaaacccttaagaaaaaagtagggcatatgttgttagccccttgtctgatgaataaatttagatgataaaaattcaaggaaatatcccaaactgacagagccagctggtgacaaaagtagactcctgtttcaattttttgaatttgcatgtgcttgtctaactcgctaacttctaacatatcccttttatcaagatagttctctgtgcttttgaatcaatatgcttttttcacataaaactgattaccataggcaattttgacattattacaagtggtctgtaggtgtaagatgtaaaggaactagatataccttccgtatatgtagatgtcagataaaatccccacggaaacaagatggcactgctgaacacccgtacagccagggaagattcctcagcatggaatgcacaattttctacactgggaagataagaactgcagtaaagcgatacaattggtttctgaagaaaaaagccaagcttctttttagctctgtgggtgtcttttgtagctcagtgaaccgttgacagaaactgagacaatagcttagggagagataggaaaaaagatttgaagggagtatattaatatgaaaggtcaccaacgagacctgtgcactgtatgtgtgtctctctttggacttagaattgttttttccaaattcagtttttaattataactgtctatcttatataggcagcgggagtttaacctttttttttcttagatgatgtaaaagcaataccaaatgaggtattgataaaatttgtatctattattaacggtagaaaagttttatgagtgcagtacttgcgattttcatgtaacgtaatgaagacagcaagactagaatctagctagaatgtgaaattagctctttatataacttttaatttaatgattctaacaaattcataagtcataataacttagtaaggggcagaagcaatgatggaaaaaaacttatatgggacaggacgttttactttacattatcccattttataaacaatggattatggtattatcccctgtcataataatgtataaatagagattaattttaatttcttcacaacaatgtagagttatagaatgaatataattcagaattgtattgttgttttgttttatactattaaattacatatgtagaaaagacaggattaagagtgagggctttagaaagcaccacattattggaagtgttctgagaatgaaaaaatgttaaggacgtagaatctgtgattccaaacctgagaagccttttaaaaaagacatattgagaagataaaataagcaaacagaaaatggccttaagaaaacttaccaagcttcatatcagcaagtgcatatcaacatagcacaaaataaattccagcatgtttacagcgtgcagagatacagtagttaaaaaatgtatattgatgatgagatggatcaggcttacctgagaggtaaatttcaattcaaattttgaggagggcaatgcatatgaagtagaatatgcaatgggaatcttctagatagaagaaatgatcatatatataaaggtgcaaaagcaagacatggcaagcaatatgaatgagatcaacaaaagaagctggaatagaggagtggttctaagaaagaggtagaggtacagaaggcaagtgcatttagcagggcaggaggtggggagaatagcagctggccacatataggatggataaggagtttggagttaatgtggtaggcaagaagaagcacttaaaaagccttccacatagcaactacatgggttaaatatatcttacaggttaaaaaatgtactgggtaaattgaagcccacatgaggttatttctttctgccaaatgaaaatggtgaatgcttccaggtcttccacatgttaattgctactggggtataagagggccaacccccaccctcagatagaaagatatgtatctcagagacaatcatcctgaaaaaaagataatagaacttaatcatgggttatctctcatggactcagagaaaagagaactgtaaagaaagaaaatgaatccataatttttgagcccagggaaccaggaggaagctgcaagtgaaaatgaccagaaattataactctcttaactagtgagtttttattgagcaccatcttgtaaaaggcatagtcccaaatcccaaacattatttatgagtcaaagaaatgtcgaagctagtgttattttttttacatcactatcagggcagtgggagtagtggggtagtgtatgtgatgagtttatatgttaatatatagtaataaactgccaatacaagagccaaaaagatctatctccaggaccagctttctggtctgaatcattttttttccttattagcctcagctattgtaggaataggttttgtgtactttgtgtcttaagtaccacagtacttaactactatgttacctagaaacctggaaaccaacaccataccataccttcttattgaaaaagtacccaactcagagtgatccactgtataacccccactgtgatgtaattagagcaaagaggcaaatcaatgcaagtcttgtgtttacaaaatcactggatgcatagtcaatatggtgcctatggaataagggaataacaagccacaaagatatatatactccgtaacttggattattgttcctttgtgcttactctggcaaaacaccacataacatttaagaatgtcaggaaaaatattatttcaccccctgccattacgtttttattttaagccctgttcaaaacaactgctctgaaataactgaagtgttactagttctactttccaaaacacactatactttttctgaacatctctaaataataaatatttctgaacgtgtatcattaatattagaatttgttcttgactttagtctcatgttacacactttcttattgtgggggtcaaagtgatgaattctgcattcatctgctctgtgaaaaacttggtaagatcaaattattcatttatgcataaattttgctaatggttgagcacctacaataactcacataatatagagtcatgtgcttatatgggagagacaaccaagtaagcaacatgataaagcatgataaatgttagactgaggtgaatagagagctattgggacacttggatgcaaatctcctggtctgagtcagtggaaatttgcagagtcggtggaaatttgcctgtgtgacccaaatttgggtcatacaggataagtggaggttgcataggtgaagggagttgaaaaggcattctagaaagagagaagagcatgtgcaaatataagaagtctagttagataacttcacaattactttggtatacttggcacctagaacataaggcagagagtggcaaataatgaagttggaggactcaggaaccagcagatgattaataccttgcattccatacaaaggagttgaaactctatctgaaggtccttggtgatatgattagctctgtgctgtggaagatcagcagcaatgtgagattcacttggaggcaataaagactggagtagtgggatccatttaagaggctattaaggcaacctagagagagatgctggtcgcaaactaagggagtaccaatgggattgaaacagaaagatgtattcaaaagctgtaagaaatgagaatcaaaggaatctagtttctgccttggaaaacattatgttctccatttaacttcagcactttgttttgccctaaggttctcttatttatgctgattgacatattttctgtttttattaaccagtgggtcacatactgtagtgcagtgttttgtctttttaagtaaacattcacaagaggtttgacagcttgcagaaatgtgttaagtatttgcccacctaatgcagttccttgaagataattgactgtcattggatcattttagctcattgttctacaaaaaactagcttataatagtttcaaaaactgagattaccacatatagagaaatatgatcaagtccttggtgtagcaattttcttcagaatcagtgcttggagcaatatgaaactatctaatttggggagaattaataacactgctgcatctttaaagaaaaaacaagtatgtaaaaatccttaaagtgaaacaatatattttaaaacatatcatttcaactgtacctattacttaaacaagtgaaaagataaactgattttcaatatgcagaacctagcaatgaaaatcaacaaagccagataagattatttttaaagcaattaagagatgccataaaggataaactaagattgcatactcttagaattttacaactagaagggactcctgaaatcaaggtttcagttagaaacatttatttaggaataaagctacagcttctttgaattttaaggtctagacaacccagagaacatatccccctctatactaaaacatgtggcttgaggcatgtttcaatataacattataattttctttgactcaatataaatatcatgacaatagtcaattatgtagtccttccaggtaaagaaataatttcttatgtcttttactaacattagtttctagcatcatcttccaccttaacatttgacattgatgtatacagaacagaaacctcactcaaactaagatgagcaaccaaacaaaagtaggggcaggggatagaatgaatgataacgttactaaaaggtacggggcccaccctgatgtaggctgggcctaaacaatgtcaccaagacttcccttctctttctgtttgtgcattggcttcacttaggcagattttctcttcagttgatcagctcaataacccagcgaacaaaaaccagcttctctttctcagtagtcacagaaaacccttataatttagtctcattggggtgactagagttatatttcatttccctttagtccagtactcagtccactttgcatggtggttcggtctcctcgactaagcattgtggtctgaaggaaggaaaaccctgctttggccaggtcggatcacatgcacactactggtcagcagcccagaatcacctggcccgaggcttaggagaaggtggttcccaagagggagctgtggtggtctttgcagaaaaaggaggaggacaggatgaggcctagtcaagaatagcagatgttttctactcttgaatttcataattctcttactttcttacttttactactcatgttataattttttccactcatgtaaccattagagacaaagagtctctgtgccaactcttatcaaattataatgggctgaatgtttgtatccctccaaaatgcatacgttgaaactgtaatccaaatgtgatggacatttgggagtaattggtcatgacggaggtaattaagtcataatcactgaagaatgggaatagtcctctcataagaagaggccagagagctagctagttttcttttccccatgtgaagatatgtattagtgacagttcttcagagaaccagaaccaataggatatacacagttgacccttgaacaatgcaggggccctgcactgtcaaaaatccacatataacttttaacttccccagaaacttaactactaatagcctactgatgaccaggaaccttacagacaatataaacagtcagttaatgcatattttctatatgtgttatatactgtttgcttacaataaagtaatccagagaaaagccaacattattaagaaaatcataaagaagagaaaatatatttactattcgctaagtggaagtgaatcaccataaaggccttcatccttgtcatcttcacatcgattaggttgagacggaggaggaaaaggaggtggtcttcctgtctcagggtggcagaggcagaaggggtagagcaggtagaatgggaggcaggagaggtagggacattcaatggaactcttactgaaaaaagtctgcacataaatggacccaaatcattcaaaaccgagctgtgcaagggtcaactgtgtgtagacatataaggagagctattatgggaaattgcttatttggttatgaaggtcaagtcccaccatttactctctgtaagctggagacccagaaaatctgataggtgtaatttagtcttagtttgaaggcctgaaaatggtgggagctgccgtataactcctagtttaacaccgaagtctgagaatagggattggtgggggtagggcaggtcgctgttataatttttagagtccaaagctccaagaaccatgaactcttcatcgaagggtcgaagaaaatgaatgtcctagctccagaagaaagaatgaattagcccttcttccatctttttgttctatctgggccctcagtggattggatgatggctgtccacgttggtacaggcagattttctttactcagtccaaagctaatctcttccataaatacccccatagacatatccagatataatgatttaccagctatctggatatcccttaatctagtcaaactgacacataaaattcaccaccacatgatacaaagaaaagtcagcagcctgtgactcagaagaggaacctcattagaacctgaccatgctggtactctgttctcagccttccagtctctagaactgtgagaaataaatgtttgttgcttaagccacccagtctgtagtattttgttatgaaagcctgagcagactaagatgcaaactaggcctcaaaacagactttttttttggttagaccttttctaaccaaaacttattccttgttgaaaaatgtgcctcttggcctaaccctctttgcatccatggggtggatgcaaatcatacttgatcatagtgaataatcattttaatgtactatttaattcagtttggtaatgttttgttgagattttttacatctgtattcatcaaggatattgttctgtgttttccttttttgtagtgttcttgcctgactttgatatcagagtaatgctggccttgtaaaaatgaatttggaagtattctctctttttcaatttttctggaagaatttgagctcactttgaacttggggagataggcagtgaatatttgaaagtttttaagtcattttttctttctttctgtttttttccaagacggagtctcactctgttgcgcaggctggagtgcagtggtatgatctccatggccacctccgcctccctggttcaagcgattctcgtgccttggccttccaattagctgggactacaggcatgcgccaccatgcccagctaatttttgtattttttgtacagacggggtttcaccatgttggcaaagctgttgttgaactcctggcctcaggcaatacacctgccttgtcctcccaaagtgctggggttacaggcgtgaaccacccagcctggcctataagtcacttttaaagtctctggtctagaagactcaggagtgcagggctcagtctacacccagagctgtctgatttagtagccagtccctcaggtgaaggatgtaaacgttggggtgcttgatgtgtgcagaaactgcttccagggagaatgtacagatctagatttattgctggaacaagccgtggaagaaggtgcagggagtgcctactctctcgttctagaaagcagaacttttacaccctgttagcagggacagacttacaatgtggagttaacactgaagcaagctagggaggaaggcatagggagtgttcactctcctgttcaagcaagcaaagtctcatacccttcttgcaaggggaggcttcttttctggaattatggctgaagcaagctgtgaaagaagatgcagggagtgcccctctccttttcaggcacagagaggtcccccaacctccccctagtgaaagattgcagaaatttatctcatctcatatccagagcaagccaggaagacagtgggggaagtaccatccagtctactcttattgacagagaccttcaacctctttccatgaagagatgacaaagctgggattgtcacaggagcaagccagggaagaaggaatgggtagtatggtcccgcctatttaggctccaggaggctaattcgttattttccatgtagactcccagatgctggctcgtcagaggccagaactacaggaaactgctggaaaagcttgcagccaaacctttcctgtaagttggagactaggctgatcctgggagctacagctgctgggaatgctcccatggttccaacgtcctctttgttttttgtgcttgggggaaatcctctgatgctgtgttcctgctgttcctcacctgggtgttttaagagccaagctctccagtagagtctggaaaagttgggaactatatgtgtataagagtagccccttactcttcaggaaaaagataggagctgggtttgcttcctggtgatgaggcgctgtgctcagggtggggttagtgtctgagtgcatctccaattttcctacccgttttgatgtaggtgttttctaggttgtttgttgtgtaggaggatttcagttggtttctagctttctcttggagaaactgatctactattttttatctaggacagtagttaccacgtttacttggtgtgtctgtgataaaaggaagaggcaggagcctcctactctgccatattctcacatcaccccagaaaaatggtaatttaaaaattcctgctgcttggagatcgagaccatcctgactaacacggtgaaaccccgtctgtactaaaaatacaaaaaaattagccgggcatggtggtgggcccctgtagtcccagctactggggaggctgaggcaggagaatggcgtgaacccgggaggtggagctagcagtgagccgagattgcaccactgcactccagcctgggtgacagagcaagactctgtctcaaaaaaaaaaaaaaaaaaaatcctgctgattgataatccttccttggggcaggggagatgacgggcaggatttatgtcctcttccacctctctgtctatatgacacataaatatctcaggatctttatctgcaagtggatctaataagagtacctaactcagaatgtgaagaataaatattatacatgaagtacttagcccaacattcagcatacagatgttcattcctatatttatgggttgtctaggtatgcttaggctgctctaacaaattactatggaatgagtggcctaagtaacaaacctttatttcccacagtttgggaagctgagaagtccaacatgaaagtccccgcagatctggtctagtgaagggcctattacaagttcatagacaaccatcttccctctgtgtcctcacacgtatgaaggactgagaggctctctggagtctcctttataaaggcactactcccattcatgaggatttcaccatcatgacctgatcacctcccaaagatccacttcctgatgccatcaaattagaggttaggatttcaacgtatgaatttggaagggacacaaatatttaatctgtcacatgacccattataacttaaatgtatgactgctagtgcctccacagtgtatgagtagttttgttttctttttttttttccttttttggggggcattgggggacagagtctcattctgttgcccagactggagtgcagtgacacaattttggctcagtgaacttctgccttccaggctcaagctttgcttatgcctcagcctcttgagtagctgagattacaggagtgcaccaccacaaccagctaattgttgtatttttagtagagacaaggttttgccatgttggccagactggtcttgaactcctggcctcaagtgatctgcctgccttggcctcccaaagtgctggaattacaggtgtgagccaccatgccaagcttagtagttttgttttctataacaaattttttaagttgaaactagcccaacgccttgtggggatcaatgctggttactaaatgcacatgataccaaaagttgatatgtatgtttgagtatgacagatagtcggttcgaatttcagaatactttagtgtttcatccaaggaagcaaactttgggatatgtaagaatggtgcttggacttcattgatcttattacttctgcccagagtcttctgccttctttccttagcttgtttcatttggcctctctttttatggctaactccttcatgaagctttctcttttccaacccacattaatatctctcaacacttatgcacttgaaaatctgaccataaggtctgtttttaaatttttttttctaagactttacatgtacagttgtcccttggcatctgtgggagattggttccaggaccctcataaatacaaaatctataaatgctcaagtcccttatataaaatggtatagtatttgcgtataaccttcatatatcctcctgcatagtttaaatcatttctagataggttataatacataatacaatgtaaatgctataaaaataattgtcatactatcttctttatggaataatggcaagaaaaagtctgtgcgcattcaatacagatgcaaccatatttttttttctattttcaatccacagttgattgcacccatagatgtggaagccatggataaggagggccaactacacttattgtatctttccaattagattttaagctgccttaaggcaaggatcatattcaatctatttttttatctaggacagtagttagcacattgctgagttcacaagaggctttgagaaaaagactggttgattggctcactaattaagtcacattgaatttttaaatttgtagttcaatttactagtttatttgtagtctggcactcaaatcagtagttttctttttcagtattacaccactggcctttaaagcatgacaattatgttatagaatgtcagctatggtgtggaatctctgaattgtttattgggatgaaagagtaaacaaagccaacgacttcctttaattagaaggcttttgaaattacagtgcatgaattgccaggttgcccttaagaaatactggatttttttgccatttaaatgctccaaaaccaatacttcattagacttactgtcacttccatgtgtctgtttacactgaaaagtacaatgatagcaccagtgacctgaaataattgccatgtaagtttgattctgatgaaagttcaatttttgctgagagatgcctggagctcaactcactgcactgacagcagcctgtaagtttctctctttttctgaccttgtaaagagggagcaggagcagttcaggaagacagacctgtgaattccctcccttcctcctcactgcttccctcaggcgtgaagcaacagttctggcttcagaatgaaatgaatcattattctacttttcgtgataaggtatgggatgccgatgagcaatctgctgccgatgggcagctagccatggcaggtcagagagcaggcctgcggagactgcccttccgtggagccacgcagaagaggccatccctggactttacaagcagaaaataactactgaactagaaatcgctcaaaaaattcaaacgcccaagtaatgactattgaacacaagaaacacataacaggagaaatgagaaagaattgtaaaaatgtagacatgaaatggtttctctttagcaaggcttcttaactattttctgccctgaagctctttgcaactgagtctttattgagtatgatttatttatttgtttaccccttcagcaggccagccctaggcaaaactcctaaagtagaaataatcgcctcctatgtcctccccagaacctctatctggtctcatattaagcttcctccatgacctcttgttgtccactggataaccaaaccctgcatagggattttccacagatgttctagggggtctcatgccctcagtctttgctacctcctgaccccttccaagcagggcaatccccttcccttgcctgaattacttaagtaattcccttgcctgaattacttaagactcgcccaattgctactaacagaaaaattcatgagctagctaacccaaaaggagaatttatcgtaaggatgcaggggtgtttcatgcacttcaagggctagaggctgctaggcttcaaacacagactggaattacagatgatcagaacctctctcacgcttctttgctgcttctcaacggattttgagtttcagttttttctctctttgactctaagaaatgccttccattctgtggggttcatgtggcaaacaaacaaataaacaataaggcaaaacatgtgaaacaaaaagcaaataagcatgactcacagcaaaagtccacacgacacagccagcaatctggagcaagatttgcttatgtgaaatttcagctttatgggaaaaagttgtatggactagctttaacaacatggataacccaacccaactaatgtaaacacagctgcctgccaccctgtgaccacgtggaagggaagaagcagttcctagaaaatgggggcaaaaagccagtaggtgtccacttttctaccatcgtcttcaaagacaccatgcagtttctcttccccaggcatgaactctatgagctcacagctgcttcactcctgttaacaaaccatatctcagaagaaaaattggaaaattctcctaaactgagaattagaatggtggaagaggaaattaaagttcctcaaatcacagcaagaagctggagagttaatctgatgaccctgaacttagcttgttctacatgtgatgaaattgattttaagtaataaacttccacaaagtcattattgtcctctccttggtgaaagctggttgttagtgtccccagttatagcaccacaagttgttttcctttttcctggaactctgttgcttgctttagtaaatgttttatttatacttttaaaagtatacatatttactttattgtttgcagtatttttataaacacacacagtatatatctatgtctatctctttaggtgttaaaacaggtttgttgtttaaatctgtatgtttactatcttttgtgtatgcttgatttatcagtttctgacactatcattgtgaacttgtcaattgctttgtcaaattctgctggattctgcttccctttcatgcgtgctctctctctctcctctcatctttgtatattaggctacattgttagaaataagctcatgattatctgtgccttttgaatattttcttttgttcatatgtagtatgtgcttttatgccagttgatgctttttgcttaaattctgtatttactgagtttcacactgctacatcttaagggtcattgtcatagttactagtatttgcctagtaaatctttttaattacctttaatattttcatgtaattttgtttttagataaatattttctaagcagtaagtgtggaatgatatctcatttatttgtccattctcataatctctcattttaaatgtgagcctaatccaattattcattgtcattatggctgtattttcactaattctaaatagtttattcaatacattcagtttcctatccttttatagtcaatagttagtttaattttgtatgttccttctttttgtcttacagtccatcttttcctctgtgtctgtttttcatctcggtaaattcaccttttaatttattattattattttttttggtaagtatctgtagggaagactaccttagttattttctgagggtgtctttatttggcctttattctaataacagtttagcttggtagaaatgtcttggttttcttggcagtaggaaaacatctttttcttctaaggtcacttgttgcacgtgaaagaatctgctctccatccgattggtattcctttgtaaatagttggctctttccatctaagagctttatttatttatgtttgtttgcttatttatttatttaatcctaaaagtcattctgatatgtttacatgcagcattcacctaatgcttgaaaagcacttttcaatttaagaacatacccattttgaaaattttcaactattattcagatagtttatctgccattgcctccatcatcttcagtgagaactcactgttttatctctgaaaaacccctcaaactaataattgtgtcctttatctgacttttagtataactttaaagattaaatcgttgggtgctgcactctgaatttatattgcagggctatattctagtatactaattttctcattcgctcggtttaactagactttacccatattttttccccttttatttaatgattgtatttttcgttttcaaaatatgtaattgcatatgttcatagtcagttactcttgttttatttctgcttgctattgttttgtaaacttgctcttttttaatggaaagtattccttcatctatcacatcaaacttcttaaacatacttttacataatctttgtcagactcatccatggaattaatttcatttgaaatgaatggtaaggcaagaattatgtctatccatacattcctaatgtgtagcacatatttgacactaagtagagattcagaaaaatgtttaatgaatgaatatgtcagtgttcactttttgtataatcagagatatttaatggtcatctagagtttagaggttatatgtagttcactactactcttgtccaatgatgagagaactgaaactcagaaaaatattatcacttctctaattaaacaaacactcctttggaaaccaccagtggacctcaggttgcataatatctctcctgctgccttcattctattccatctcaaaatactctctcttttttttttcattcagtcatttacttattcattcatacatgtatgctctcacttaattttaggattttccttttgcatgtatacaagttaatcaaattaatcctcaggaataaatttttcactcaggatggtattttataacgtgcaataaattcagacaatgtttgtattactataaataaaaacctcgttaaaaacaagtaagaagaattttattacattttagttaatttatttaacaaatatttttaatagtgattaaagaaaggaaatggcaagatccattatagatttttaagccatgttgtaatcaaccttaaatatatattttttgtttgttcatttgtttgtttgtttggagacagagtctcgctttgttgcccaggctggagtgcagtggcgtgatctcgtctcactgcaacctccgcctcctgggttcaagcaattctcctgcctcagcctcccgagtagctgggactacaagtgtatgccgctatgcccagctaattttttgtattttagtagagatggggtttcactgtgttgcccaggctggtctcgaactcctgagctcaggcaatctgcccacctcggcctcccaaagtgctaggattataggcgtgagccaccacgcccagccaaagatgtatttaaacaccaaagttttaaaatatttatgcattaaatatgcttagtgtcttctgtagcagaaaggatgtggattttacattttgatttctaagcaaattaatgatgtagccataaagcatagcaggatatagtgggctataaagaaaccaatttaagtaatttgtgcaaatactttaaagttttatgaattaaatttcaaacaaattctctatgacaaggcaacttcctcatagagcacagctctagtcattttgatgtacagataggaaattaaaaaattcaaattaagaaattaagtctcatgggtctacatcagctgatttgtaatttgctttatctttaaaaacagttttcttgaatttaatatgccagcagttataaagctatctttctctctgctatctactgataattttgcgtatctgtaatgatctatgttctttttattttaaggaaatatagttcaccaggatggttgagaacaaaagtattgtggtgaaacaaacctaggttttaaccccactgtagccatgtactactatgcaatagcatgcaagttacatcacctctgtaagactcagttaacaggtctgcgaaactgggataagaatatacagacagttcctgacttacaatgatttgaattatgattttttgactgtacaatggtgagaaagtatggtttcagtagaaactgtacttcaagtactcatacaattattcggtttttcactttcattataatatttaataaattacatgagatattcaacactttattataaaataggctttgtgttagatgattttgcccaactgcaggctaatgtaagttttctgagcacatttaaggtaggctaggctaaactatggtgtttggtaggttaggtgtattaactgcatttctgcttaaaatatccccttttcaacttatcatgggcttatcaggacataaacttgtaaatggaggagcatctgtatatgccacagttttcctctgaaaagaaaatgagataatgtgttataaactatttagtactcagtaaatgttacacagttcttactagagttatttccatttttacatacacacatatacacacacacacctccctctgtcagccagtatttctaaaatatttctactgttattattgatcatttaaagtactttttactgattcattaaaaatctccccagtggggaactgtgcaatattttagggtggtagtctctatattattgaagttaaaatattgagtgttttggtcagataagcaagggtgagacacaaaatagcatgagcagctaacttctctaaactccagtttccccattcatacaacaaaaaggataatagcactatataagttgctgagcgtataatttatatagagggttagtccattgtatggaacatattaagtactcagttaatataacctataattatggccataataataaaatacaatttggagcatgtacacagaaagacagatttgaggaaaagtatgtgctttccttggtgttagagcattggcaaatgtctttaatactgtgacattcaactgtgaaaaccaattattacacaattagaagcatcctcaattagggaaagattaggtcatgtttttaaaacacccaccaatattttctgtcaatcccatctgtgacacgaataagagagaccccagttagcagttgtttaaatcattttcctaatgctggcatccgtctccttggagacatccatcagagacttgtgttaacatctttcaagttgcatctggataggaccagtatgtgatcagtgtattggtacatttcactgacagacaatacaacatttgctttcattctatctttaaacttgtttgtaatatataaatacttcataatatatatgcctatttttattggtgtaaccataaggacacagcatgttgattatcaaaagaaactaccatatatttagcaacttatcttctggatgtaagaaatttatttaaaaattaaattttagtacatgaaactggctatgaatttcaaaaagtaagggaaatagataaatgctataatgtacatttaaggtaaaaggaaaatgggatgctatcaaaaatctttattatctatatttttatatctgtttataatttaaatatgttgcattttacaactataccattcattctgagctaaataaaactggaatttaagaagacaaaatactctagaaatgcttgttatctcttaggatcaaggaagagaaagtctggtgatgggtgggaggaaaacataaaaaataaaatacttaacactgacatccaattctgtagttttaatgtaaattatttcattctttgaatattttgtatttttagcctcaactaaataaacagattcgaataggtgtcttggacaactgctaagtgggcagttgtctagagccaagacacataggcagaaacagagaagaaagactaactcagatcttctgattacaagcactgtttgaagacctccacaactgcctaggaaaaattaaaaagaacaaggtacagctttaagtttaggttaggtaaagacatttctcttaaaatcctcaaagccataacaacactgatggtctaaaatgctaaaggcaggagatgagattggatgatctttaaaggctctttacagacccaagattccatatagcacctgttggcttcagaattgtttatcataagctcatggtcatcaatataatgcaatagttactaaaatttgcacgttcagtaatgaataaactaaataaaaacctggttagaaaaagataatattcataacatttcgaacattaaaagaatgaaaagaagaattaacaaataaggaaaaatttgtgttcaccaaacattttgatgaatagatagtctgaatttctaaatacaatactactagattggtcccctttctgtaagtatttcacagcacttgataaacattaaattagagctttgttcagcatggctgcttggtgaatattaaataataaaaaaaatcaaaacaccactatgaagtcgaagggaatattccttttttctggatattttccttcatgtttacaactttaataaaatttaagtggtatatgctatgcctaccaactgcttaaaaattaaaaaatgtggttgatgttttgtcatcttaatcaaaatttgcattccagtttccttgggaaactccacatgctgttatacaactaatccttccactacctagccaaataattaatacctttacaagcacatcataaaatatagattagtaaataactcattatacacttaatttcgatactaattgcctacaggcttaatgagctcttcattgtaataagaaaactgatgtttatttttattagatataacttctaaacaaaacacactgtatcaatctatgacccaatttgatgtttaattcttacggggaaaatcttaccattgactagtgttaaaagatttaaattattattgtataataaggtgttaaattagaaattttgactgacacaccacaacacaaaagatgatgaattctaaaatggtgcaagattaaatttacacacacacaaaaaaagcagggtaaaactagttcagcttaagtggataagagaatatgattgtgggagctgagaagagaaagtgaaggagatataagtggaaaaccacagacaggagtagagtgggttgtggcatcctccaaaacgagaagggccttcagctgggccactttgaaaacctgaactatgagctctgagatcactggccacaatgggctaatatctgacttgcctataagtataaaaggtagggacaagccaggtagtgcagaccaggtaatgagagaagttactattacatttgaatcagcctgtttcccactgtttgtcaggacaaaacttgttcatcaaggagcagatgcaggctatccctgagagagctatccaaagatcatgttagaatctgtcaaataatgcctcctaaaggttaatagttctcggtagagaagaaactacatgtaggccattaggtttctgagatgaagtggagttcatttgctctagtcaagtgaactttcttgtgagagacccagcagggactgggatccctgaagaaccttcagggagccaatcagctccaaatacctgtcaggcttggagagcaggagccaaccagggacattacagtcgagaaggaaattttcagcctcccaacttcttttccctccacccccacctcccaactagatctccaaccacagaagcctcagaactctttgcaagatggaggagaaggagctgtggaatactggccttcagctctccaccttaccagcataggtcctcccctttagcaggtacagctgtagaaactggaagcaacagcaattttggataaatgtggagcttttgaaaatgacatgaaactaggccttctagttatagaattaaatttgtgttttaccacttagagtgagcttttcagaggttaacaaagagcagaaatgtcacagaatagcctaggttctaaactaggggcaaggaatgtttcccgaacctcaatgcatttgaagtgacactgggaggaaaaaaaaaaagatgatgtctgattaaatacaatgagttctgtctgttcaacataatagttagacatgtttttaaattttaaaaattggtattgataatttgaaatgccccaaaacttgagatccctagcttttaaattaaggaaaatgaggcaatagacctaactttttaaaaaatgcactttaaattttagaacttccccggaaaatttttttggggatctctagatgaaggtaaatataatttgatgataaaaagtcacatgggcagatccttctaaatttgtaaatggcaaatcaagcaaattatggaagaatcaatgattcttctctgggcagtgacctaaaactcttctctgggcgatgccttaaaactcttttcttattaggaaaccgtaaggcctcacttcatttaaagggagagggaaagtattcaaattttacctcaactgaattgcctccagagatctgggattgaattctattcactaaggcacattttgtgcagaattgcttcaatgcctgccctgaaaatagcttaattttaagtcatttgctctttaaatggaagctggaagctttttgacttgaaaataatatcaaacacgtagaaaggagagctagtttcctgattagaaacaatgaaaaaaatcatttgagactgtctcccttttctccctattaaaactataataatccctttgcccataaagacaagccatagatcaaatccagacaagagataagtcattggcaaggtagcatcaaaaacattttggtaacatagctagtttatattaaccaaatcttatggtgagaatctttggatgactatgacaatttacagcataggttattttgtcccttctaagtgtttattatttgaccaacataatcttaaatcaacttatgtatctttttctccattttccaagtttaaaataaataatgcagaaagaatatatgtctaggaatatatatatatgtatgtaatatatatataatatttattattgtagcttattccttgcctttgtgtgcacccatgaaatgctaactactttacttgatgacaccgatatagttgtttatgtgcagtgtactaaatgatggtaatataattggtaaaattggctttcacttacccacaatgcaactacaaaatgaaatgacacaaacattagtctcaggaattctgccatgaaatctgattatttgattctgtgttagtgacagatactgtatactctaatgacacattagaagtaagtagcaacattcagagactgctgtctctgcttcaacttttttaatgttttattttgaacaagctctcctagaaaaaaaaaaaacagtgaagaaaaacaccagttttgtttccgtatttctttttaatcctaatttatggttaaagttccgatgttgttatcgacaaaaaataatatatggactaatgtgcaagttatattgttaacctcacgtacatttctgatttactgtgccaagaatctagaacttaatagaagcaatgttaatagaacaggagtggaggggcataccctgtggctttattagtttcttaatttcctttagttcccagatatggtccctcagttcccaaacatggaaagcagttgctggtgacatgctccatgcagatattgtccacccagagttagaaaaactgctgagtacttgttgaataattgctctttatacgtcatcaaaaaggacatgtcctcaaagttagtgctcaagtgtccttgaacataaacctctgggattcattcacctcctgcttcagagatgcttagcatggtgcctgaaatattatctatccatatattacatatataagatataatattatctattaagatagatagatagagataaaaatagatttatatatatatatctcccctacctcatcgaatatatactgagcctgtctttgtttattgaatttgttgggacactacaaaggtacatcaaaagtagatatgcttccccctcaagaaattttataaagtcttaggagaaagtggaaggacttattataactcaagaaatcaagtcatccacaagcaggaaatatttaaactgggttttagagaagtaatgcttttggttgtgaaagtaggcacggacattggaagtgatagtgaataggagaagaacatctcaggcagagagataaacagagagaaagcagatggcccattacaaaagtgtctgaaaacatgttctcagcatcacagtcctgatacgttgagcactaaagtttctgaatgtgaagtgcacagtcaacctttcctttcctaatgggcaagtcaggtaaactcagtacacagaatagctgaatataaatgaatctctggcaagttatagaactactataaatgaacatcaaggttttttttttcacatttcctttggacacatattaaacagttccttttggaattaattatgtaaagaaaaaagtattttcttttacattttaaagacaaagtgagaaacggttattcattgcaaatggtgttagagaaaattaaatgtctaaaatgcatttgcacaaggatgctataaactgttaaaatatcaccaggttttttttttagcctttgctaaaattcttgatttattagcagttcaagtaaaatagaaagagcattctattgttttttgatggaactaaataatcaccacaaactaattgaatgatatgaagtattcagggtctctaaattatgttttactgtaacattttaaatatgtaataacattaacaagacttgaccattcaattataaatacatacagaaattactttaaagtctagaacattacaaaacaattatcctttacatttgttcagccagcagcttaaaagcaaacctatttggaacagctggagcctaaaactgacatttgaaatcacagaggcagtgttttaaaaactgtacttaaagaagccccagttttatactatttcttcatcaactaccctgtttaatgtttttgtctcctgaaaatgtgggtcagaatttttctttaagaattaaataaggggccaaggtcaatctgggtgattaatttcagatagtaggagtagtgtaatatatctgaagcatttgttcctattttttcctgtttatggtgccaccagtccaattctaacactattgcctaaactaattgcttcttattcctcttccccccaccaccctacacacacgtcaatacaagcaaatttgtagccattcaggtcagtgcaaaataatgaattttgtttcaatactgtcatacatctgtttctaatatgtctcggattcagtattattgttgtgtgaaatttgcagtaaaatcttaaaatggaacctccttgcctgggatatgaaccgtgtagtatttcttttctcttatgaaagcagaaggtgttaatatattgccacaattcttaagcaaaactcaccaaggaattgatctagtccagtctgtagtatatctgtaaatcatcacttgaggaataaagtataaataatctcatccttgaaataaaaattcatttgttaaggaattctactaacttatgcttttagtatgtgtggcttcctaaatatattagctaggaaaatgtttctttgaattttaaatatagtaacaggaagaaataacataatttaccatttgaaagtcttaattggaatgggcagataacataattaagattttgcaatggcatataaaattcttagtggatcaaatcacccttttcaccaaaagggaagcgtggtgcatgatattccagtgatatagccagaaaacccagatgctcctctgtccttatccagcactcattgcgaaggagaaaactaggatccttcaggcaagcgaagagtgttaccttcagagagggaagaggaaaggtcttcacaggtgaagcttgtgtacaccttttaaaacaagagtagtggataattaaatggagagattacagagaaaagaagacagtcaaggactaaattttgaaacttctgaatttacagagaaggaaaaaatgcattctaggagatggggaaggagcacacagtaaatcacatagaaaatcaggaatgtgtggtgattaaggaagccgagagaagataatgtttcatggaagagggagttactgactttgtaaagtacactgagaggtggaggtagattaggacaaagaaggaaccatccattttgccaacatgaaactgaaactgattggtgacagtttttgagaaagagtagaaactaaagcctaactaaagtggtgtggaaaatggaaggtgaggagctggagtcagaaaccacagacaactcttttgagaaactttgatgcatggtagctagaaggagaaatgaggtcaaaggtggcttttaaggccaggcgcgatggctcacacctgtaatcccagcactttgggaggccgaggcaggtggatcatgaggtcaggagttcaaggccagcctgaccaacatagtaaaaccccgtctctactaaaaatacaaaataaattagccaggtgtggtggcctgtgcctgtaatcccagctactcaggaggctgaggcaggagaattgcttgaacccgggatgcggaggttgcagtgagcggagactgtaccactgcactccagcctgggtgacagagtgagactccatctcaaaataaataaataagtaaatagtggctttttaatttttttgaggtaattttaggtttttcaaagaatcacagaaatagtacagagttcccatattccttttgcccatcttccccttatgttaatatcttacttaactatagagcatttatcaaaactaaaaatcaacctttgtacaacactattaaatagagcacagaacttattcagtgttttcactactgcatttttccttgtcccaggatcccacatctcgtttagttgtcatgatgccttctctcctcgaatctgagacaggttttcagtctttccttgcttttcaagactttgaacgtttgaagaatacaagtcagttattttgcagaatgctccttggattgggttagtctgatgttttttcatggctagacagagggtatatgttattgaaaaggatatcacagaagctatgtaccctacctcagtgcttcatatcagggggtatgtggcattgaaatgaattcttggtaatgttgaccatgattatttggttaaggtggtgtcttccatgagtctccgtggtagagttactgtttttcctattgtagttactaaccgttttggaggagatactttgagaccacgcaagtttctgctttctctttatgcttttgcccatgaagcttacctccattggtggatcttgtctggggcaaatatgactgtggcattctaatgctaatttctactttcctcttcattatacatttcttacttgaaagtaaagaagagatatcatttctctcctgtttatttagttagcaaataatttattcagttatttaattacctatttatatcagtaagaactccagggtatttcttggtattcttttgtttataatccaatactatctttatttattctcttgctcaggttgctttaactttggctattgggagctctttcaggtttcctcctatgaccttttcatatgccttcttttaatttttcttctttttgttttctattcttttttttcctgtgtatattcttgtatgtgtatacatttccttactttctggcaccacagatgctcatcttctatcttccctgacccagccctgggttcaaacagttctccaaagggccctggttacttttattggaaaatggtatttagaaactgccatctggcccctggtgtgctcgttactagggcagtgtcagtgcttccagccacaggggttgacttttaagatgaaaggtaaggattttgtatgatagtgatgaggatttcaaagagagtgaaaaattgactatgcaggaatagtgatgcttttaggaacacagttattgagaaggaagtggtaataggttccagggcacaagtggaggggctgtgctttgatagaaacttgagacactattcattgtaacagggaaaaagagagaacatggctcagattcaaatagattttgatttcggtagaaaatgaggaagtttctgtttgtttccctggtgttgttaatgagtgttagtcaagatattagctaagagtgaagggaataaaactgatggaagtttgaagatagagatgatattagagagtagaattcaacctaatagtagaattgcaaggctttatggattggcatttgggaaattcgggggtcataaatataaaatgtgacagcatgcttttctggtgcagatgtggagtaggcagatgtatttgaccaacctagaactgcagttttgccagctgactataattgagaagaaagtgagcaagagaaataaaagtatttgtcagtgttttagtgatgtaatggtgggccataaaattaaactggataagggaacacacaggggaaatggtgttagcattattagtctattgtcatagaaaaatataattgagtttggtttatggtttcaaattcatttatataacttagggatattgcaactgcagctgagaaatgtagagaacttgtagagcattattttgtgttcctttaaatcgagtccacaccagtggtgttgccatcttctctacgtttttcttccctgactttttcagttgacctcctacctcttatacatgtcttggtctctaataccctttttctctcatcgcccttcttttctaccaaatcccaatatttcaagaccacttctaaggtgggaacatctgataatttcttaagcagttaagcaagcaaaaaaaaaatgtcattactgcttttgtcagggaaaaggtgatttttaagcttaaggggtcaaagtgagcttccacaaggtcactaaaataacaaatttgagaatcactgacagcatcattgtcaatcttttatctgaaaacatttcctgtatcccaatcaaggtcagataaatgaagccagaaaagtaaaaataaaacctattctgtaggagactccattaacttatctgaaaacaaattgatgcagggatgtggtttaatttttcactggtcagagtcattactttgtgagacatgtttggtcacctttgatgtgtcagctaaatgactgtttctaaaattactttgaccattattcatgagagtgttagtaattactcagtggttaatgaagttggtttccagttgataatcgttagaaactgagcatgacccgttgcacaacagcatactgaacagaagtctcagatgtggcttccctctgcacggtggacttggttctgacctaaaagcactgataacagctctgaaaagagaacattttctaaacaagacattccttgacatgcagaaactctcatttcaatgacctactatgatactatgagtatcatcctcaagctctctctgtgctccaactaaattgtatacaaacatgagggtaattattagatttacatgtgcctctcaactaaattcaaagcctatggcagggatagaagatggcttgccttggaatcccaaagtctggccgatgctggacacagagcaggcactgaaatctgaatgaggcaggcaagcatctctctggcatccaaagtgagtgaagttggagcaatcttcagctcatatcctttataatccagtagctggtggccaactctgaccgtttctttcgccacatagactggtctatggagattcatggtgttttagatgtagaagagacatcgaagtccatctaatctggcatattctcttatataaaggaataaaaaaactctcccaaaaggttaaatgaatttcccaatattacacagctagtgtagccaagccaatgaagtcactgagttaaatatttaagcaggaaaaaatcttttcaatgtctgcttgttgaacagggggaacaaagctctcagaatcaatgtctaagggttaaaatattagcttgttgggaaaaataattaatcactcagttcccagtctacagagcagagcctgagtatctcagtcgttaaatttaaggataattggtctccaaactagtacacaactagtaattcaaaataatttaaaagaaatgctgctttggcaccattatttaaacacttttattttttgttgtcgtgtactccaaaccgctcaaataacaattatactttaacaggcaaacaaaaggtttttttaatccaatttttcctgtttcttgatttaaagggaaaaacaaaactttcctatggaatttgtttaaggagacagaaatgtctatacaattcttagtccttcttttgtgctcaaaaatgtttaatagcttgtggatgaaaaatttcaaaattggagttgcttgggtaaaatatttttatgtttagcaatgaatcgttattggaattcctcaaaacatttcagatttattgccacaacattagccaattttatattatggtagataaaagggacagaactagcatttattaaacatctactatgtgccaaacgtatacaggatttttattttttggtttttgtttttgagacagagtttcgctcttgttgctcaggctggagtgcaatggcacaatctcagctcactgcaacctccgcctcccaggttcaagcgattctcctgcctcagcctcccgagtagctgggattacaggcaggcgccaccacagccatgtaattttgtacttttagtagagatggggtttctccatgttggtcaggctggtctccaactcccgacctcagatgatccacctgcctcgacctcccaaagtgctggaattaaaggcatgagccaccacaccaggccacatatagaggttttcatatatttttctcacttggtcttcacagaaacccgaggaagtattggaacattaaccccatttttcagctatatttacatcagagaagtaacttgaaaaatgtcatacagcagcgtttaattgaatcctagtctgtccaactccaaagctttacctgcatttggtagaaataaatttagattcagcaaacattgttttcctgggggttgtttgaggaagggaacatatcttgacaggtgctttctataacattattttatttaatcacccgaagcccatcttctctttatcacacacttttaataagctgataatttttatgtgagtcttgagtatgcccttttacaacagaaaagtgggaagataagtgttcacctttatgccaataacaaaatgttattatcataaaccagaagcgttccccagaggcagtcagtcttagtatatagctacaaacagatatattagctcaactttaattcatgcaaaactaagattattgtctttgctaaactttcttcaaaattcagttggtcagttccaaataactctgtcaagcaagtgaattcattctctttcctggaggtacgtttcacagctaactattcttggcagacacactgagaatcaatgctgctttaaatcagacatttcgtagaagacttgctacagtttttctgctgccagtgtgggggactgttctcccggtgtgaaatgtttttaagccaaaaccttttctattgcattctgtggtataatgtgaagtttcagtaaaatgtttatcaaagagcctaaacatatctaaccttcttcctgcagaaggacccaaggttgcttctaagtagcctggctgcgtgcagcagcatagaagatgaaaagagcatttcttccaccggaaatgagaactactgtttagtcttcttgacttctctgagtccataatttatccacacaactcacatgttttaaggagatgaacatttattattttttataattgatcccaactttccttatgagtctcatcacaatgggaagttaatttaaaattgcaataaatggtgtcttgttttggttaaaaagctttggatttggtacaacttttgtcatttcaaaatttaaatcaggaccagcactttttcctttttgttctttcttcttccgagatgtttctgagcatcagggagggaaagtgtgaggttttcaggcatgccaacaagcccgtggggaatctggtttgacactggtctgtgagctacaaggctgaagtgtggcctttctgtgcaacctgctggcatctgctgctgaatccctccagctaatataacccagagcctcctctctgtcttcagggactttggccatcatctcttgtttcctgcactccagatgcccttgggtttgattcccactaggaccctcggacaactccagttaaaccttcagacccaagaccacttttctggcaggacctctagcatgtttcccagccagaatctcaacttctttctaggcccttcctgggctacatgggaatctctagattacttccatgctgggcacagtctgttggtgcaaggttatgccaggtggagtggcaattggtccctgatgccaagcagagaacatggcaaaagttcctctgctcccagctttccactgagcctatcaaacacctatcacatctggaatttgaagcatgaatgacagcctcctgactgtgtctcacaatccccagagctgaagaagttgactttatcccccgttccccaattcctctatgacaagaacttacaacattccctctaactatagcatacaataaaactctatgatatacttggcaaagtctcactcttagtatgaaaatagatgattaaaacaattagaatatcatgttcccttatgttccctttctctaaattatggatttgaaaactagatattcttgtgactcacgaatcctgttttgtatacccaactcttattaccctttctttgtttctcattgtacttctgcttcaagtatcccagtttttcaaaggcaaatggatgatcctgattgattagaagacaaatacagtaaaatacaaaaaatatatatggagatattcaagagattattacacttgcattatcaagatagccctatctaaccttatttccagattatatggacaaatatgctcttactagggtaacaaaaacttatcttctctttagctcatgtcaaaagcagactgagaaggaactctttatccaagttaagtgaaggttggtgtcaccacacctctagtctttatctaaagtgttaagtcatcaggaagttgaatcacacttagtttaacctttactgagttattgaaatggtgcccttggcttttatcaatagaaaagccacataaaaacttcttccaattctccttcaattattttgcccattatattatagagtttgctatgcaaaaaaaaaaaaaaaaaatgaagaatctgatagtaggaaaacatctgtagctttcaagaactcagcctacttttatcctactttctccttatcctgttagactgtataatttttcctatttccatttttgtcctgtcatttacatctttctttggaagatgtattcatattattctgtgtatatccttcttatccactgcaaactcttgacatatagatagggtgctgtggtttaaatgtctcttctacaactcatgttgaaatgtaattgccattgtgatggtattaagaagtggcacttttagaggtgattaggtcatgagggctttgacctcgtaaatggatcaatgttattatctcaggagtaggttggctatcacaggagtgggttcctgataaaaggataagttcagccctcatatgctctgtcttatgttcttgcttctcctttctgccttccaccattggatgatgctcactagatgctggcaccatgctctcagacttcccagcccctagaaacatgagccaactaaatctcttctattcataaatcacccagtattttgctaaagcagcagaaaacagactaagacagtagggtataattaatgtaaaattagtccccacaaaactgtatgagttagttattacatgttttacagctgataaaactgaaatttatgtggtttcatactttgttgaagtcctaaactagtcctataattggtgaggccagggtaagaatccaactttcagactaaatcaaatgctccttcagctccaccaagaacatttccattttaagacaaattaaatccctatttaatcaagtaaacattagctgtttaatttgtaatgtaaaaagtagtactgagaagtgattttgaaaataaagcattttatataatgtaaaactgtctaaaccaatgcattagttaataataagctttgataaacaccagaacaaaaattttgtcactattattttagatgtcaatgcaatgtgcctattattgaacacaaagatgcagaatatttgcatataacattaacataggcaaatattgatgattgttattatgatattatagattgtttctaaaaaataacggtgagaataattctattatggagaaatgcttctacttcttgactcatcaaacagtgtatagtgaaaatataatgttaacattgggaaatttcgtattcaaagtacaaaaaagtagagatttttctaaagatgacttgcctttccctaaaaaaaaactctttgagttacatgttgctttatagccctgcgctaaaaaggcacaattttcctctttcaaggtaatcctacttttccaattgtgtttgtggaaaatgctcccttttgattcaagtaactttgctgattaaggaaaacaaaacaaaaaaagtccctaaactactgtaactgagttttttttaacaaattagtactgtccctatagacaatacagaacctgaaaggaaaagaaagaggaattaagcataccagtgactgttccccacgttttcacagaattctgtttaatctgagtttttattatttactttgcttctcctttgagataatcctgccttatttgaggtcagacagaaagcataatttacgatgcctgactgctttaagaaaaccagaagcttcctacattgttctttcctgtacaattggcttaaagaagaggttttctggttagaaaggctttacttcatgttttactaacagcgcatcactttgacttaatactattaggtttctaaagtgactcattcagatgaaaaataaaggtgctgtgattttaaattatcatagaaatgtgagtttaaatattagtaattacctcaaacttgcacatgacctagtaacccatgtattacatgatatacaatgcattgctttttagatcaaacaaaagagagtgtgttatgttttgcactttaaaatccattaactgttctctctcaggagaatgtagactaaatctcaacctttctctctgcagtttatgatggtgatagcagctagatgggggaaaaacaataggtgatgaagttattttaaaaaggccagacagaatgctttttttccttgtatcaggtttcagtctccttcatgatttatgtgtagcatccatggtttctgtgaaggtattcaggacatcatgggcatcaaatacataattaagacataatggaaggtcttggattgaatgggtgaatgtgagccaaggcttgtggcaacatttatagattctaggttagtcagtctcacccccggactcttctttctactccattttttttcatcgttgttttccttttgaaaaagctaccttcagactttctaagtctctctttctataaaaccaggaagggtttactttgattgtaatttatgttgataaggtaacactcctggccatttgtatctttattcctttaaggtctatttttggaatgaaagcctgatctgcttttcaagatgccctaagagttggtgggcaggaaggagaaagaaacttttctttgcctcaataattatgccagacctcagctggatgtggtggctcaagcccgtaatcccagcactttgggaggccaaggcgggtggatcacttgaggtcagtagtttgagaccagcctggctaacatggtgaaaccccatttctactaaaaatacaaaaaattagccgggcatggtggtgtgtgcctgtaatcccagctacccgggaggctgaggcaggagaattgcttgaactggggaggtggaggttgcagtgagccaagatcataccattgcgctccagcttgggcaacaggagtgaaactccatctcaaacaaacaaacaaacaaacaaacaaaagaaatcatgctaggccttacactgagaggatggttctatttaatcatttaaggtacctaatggaaactggctcagaaagccagtgtataccaggtatagattcgttttcctgtttactcctcgtattctaatacatattttctgccttaataaatatttattggactgatatgaatcttgaagtagcaaggtggggtggaggatggttgaatacagcagtgtcaaagaataaaccaatacacgtttattctctgccttcatggataatatataaaatcctgtgcagaatagaatagataatggccaatataataagtgagaggaatggagactcaggggttttgagagtgtgtagcagggcttttagctgagttttgagtggacatacaagttgtctcaaagaagtgacgagctgaggctaagtgactcatttgtcatggatcaatgttcctagccttcagcgatagacgattccttaccgtctcaactacgcacttctcaacattatggctgaccctgctgggatagtcctgaggactgcttctatatatcccaactttcccttcattctagacaaggagatgaattgtactttcatgccacctcagagttaagttgggcaatgtgattctctttggctaacagaatgtaagagaaatgatatatatcatctctaggcagaacttttaataactggctaatgctctgtcacattttttcctccttctatcatgccacatagaggggatgccacgtcctgggtcatcctgggttctggtctgaggactacagaaagtggagcagagccccctcagctaggcaatgatagatgtggaaggcgagtaagaaataaaccatttttttttttttttttttttttttttgctttaagccatcaagatcatgagatggttcacttccacaagataacctagactattctgactgatgcatctgcccacacttcggcttatgttatctcacattcgccagcacaacgttaacacccagtcaaagcacctttaggtcaaaatatgagattagttcctgtatatggtattaaaatgtggcattatgtttttgaggtttgtattatttatcgacaaggaaatatatagcattgatatggcttggctgtgtccccacccaaatctcattttgacttgtagttcccataattcacacatctcatggaggaaccaggtgggaggtaattaaatcatgggggcagttacctccatgcttctctcatgatagtgagtcagttctcttgagatttgatggttttataagggacttttccccttttgcttggcacttctcctttctgccaccatgtgaagaaggactgtttgcttccccttctgccatgattgtaagtttcctgaggcctccccagccatgctgaactgtgagtcaattaaaactctttcctttataaattacacagcctcaggtatgtctttgttttgcagtgcaagaacgaactaatacaagcatcataattaaaagcatgtaatctttgccattctgggtttgaatcttggatcttctacttattacctatgtagccctagtaaagttatttaacttttctgtttctcactttcttcatctttcaaatgaatacaacgatgaggctaccctgtatgtatactataagaattaaatgagaacagtgcctggcacatagtaagcatgatataaagatgagcaattattatcataatcctaagattctatgtgaaaaaattcaccttcttagcgagttttgttgcttaccacattatatctcagaggaaaagttgaaataatctactttaaatattattttttgtttaaatcaaaacctgaaaaatgaccaagagtgagtttatcattactatagtgcccagatcatttgaaaactttcacctcctaaatgtgactttgcttcctggaagatgctgcagaggtaggcagatgattaaggcaccagacattctagtgaagcccagcaatcttctagacccagaggtgatagaaaagcaggaatttctgggcaggtcacctaggaaaagaggccaagtcctcagcagtgccctcatcagccctgatgtgagtcactgtcttgtttcagggcacagagcaacagtgatgtaaacagaatgattactgaggggaaaagtccgaagcaggagaagtgatgccactgtaggagaccttaggatcccagatgcctacaatacaaaaagccacatttcatccaaatctgtagctaaaataatcagttttaacacatttccttcaagcagtttcgtcaacatatctatacagtgtatataaatatcccacagccattcatcatctctttcccatgacatttgcaatctcgtgttttatgcagccagctattatgttaaacctggccaattttgcatttaggcagcattgtgaagtgtcatagcatttgatggaatggcaagattgtaaattgcaatctggtctgtgggaaaaaatattttaaaaacattaaatttgttttagttgcttagctttctccctccccaacccaccacctcaattcttcatataacaagacttaatgagaggaagatcgcagtgcttaagatgtattgttttctttccttttcttcttcttcttttttttcatctataactggaaaaagaagagtagcagattcaccttccaagctggggtggatgggagacagtctttgcataattccattgcattactttaatggtaaatatatcctaaaagaagaccagccttatactgtgttcggctgaaatagcccgttttgaaaatatactgggtggctcctttgcacttgtggactattaacagtgggaagatccatctgcagctgtcagctctctggatagcagtcaacaaatgcatggccatgaattctctacataagtcaaagcaatgcatatggtaccttacattcaagtgaactgacttcaatctgggcagatctcatattttatctctgtgctgttttagcgtctgtcattgtggagaaatttaccattaagatttaagtctccgaaatctggtgcctttgggagttttgtgaaagctcagttcatagtcatgtaaatgtgtagtgacttttcaagttacttttgagaatctaacaatcaacataaattcctttaaatttcaggacttgaaaattcatataatactgtggaataaatgctgtatatgctacgtcaccaaaaagagaaatttaccattgtaaaaagagtaaaaaggtttcttcctccacactagtgccattgagacaccatctcattcaaataaaaaaatgaagtgcaaattcaccagtatattcagactctcttagatcaacagacttggcctgcctgcaatagctaaggcatacatgtgaaactaattttttcctgtggtttagtttatttttcatagaagaaaataaacagatagtgtcaaatattgaaagctttatctggctagaacagaggttcttaaactttttgttctcaaaacttctttactgtcttgaaaattattaaggttctcaaagaattttggtttatgtttgttatatctattgattaccatattaaaaattaaaacttaaaatgttcaaaatttttatttatcaattcatttaagaacaaaaataaacctactacaagttactgtaagcaaaatattttcatgaaaaataactatttttccaaagcaaaaaacttccatggaaggagtgccatttgttttaccttttgcaagtctccttactctgatttaatagaagatagctcatttgaatatctacttgtgcattcaacctgttgtaatatcatatgccatatagcttcggaaaatgccgctgtatactcaaggagaaaacaggaaaaggaaaatgaaatgttagtattttttgtttcttttttttttttttttttgagacagagtctcacactgccaccctggctggactgcaatggcgcgatctcagctcactgcaaaatccgcctcctaggttcaagcgattctcctgcctcagcctcccgagtagctgggattaagacgctctctaccatgcccggctaatttttttgtatttttagtagagacggggtttcactgtgttggccaggctggtctcaaactcctgaccttgtaatctgccccccttggcctcccaatgtgctgggattacaggcgtgagccactgcgcccggccaaaaatagttttgcatagagttactggcttacactttgagacttctgaactcaactctgtacagatttccaaaaagatctgaatacctggataatttttgaacattagtattattttgattagttgtaaactgagacctaaaacaatcgtagcactaatcaaatactttcaaatattttatttctaattaatttatagtttaaataaatttgcattcaaatgtccgctgctactgtcagtttacctttgcttctttgcgcctcttctcagattgctttcttttggttcaggctctccttttgtactttccaggacaaccctgctatttccatgtccacagggtctttcacaattaaatgcaatcaaggttgtgttccctgtaaaaccagggttcgtttgcctggaaagcagcaaacaactgtccatgagaatgcaggttttaattagtaggagtatttgattgtttgtttctgagatggagtctcactctgtcacccaggctagagtgcagtggtgcgattgcgatctcagctcactccaacctctgcctcccaggttcaagcaattctggattctcgcgcctcagcctccggagtagctgggagtatctccaaagtggtgtctccccgagggaaagtgacagtagggcttcactgggcaatgaagaggggacagggtgtatcatcacatgtagaggaggggtcccagtggcgggaatgcagcgagtcattatgccagcacataggtcgcatgttatggtaatgatgctatagtttctctcagggtggagactttagcatggtaattaggaaagatcactcagtttcatctataaagttcctagggtctgtcaggagctgcttcaaactaaaaaagtaaccacattccacactgggtttgaggaagtgaccggtgaagccagctggacttcctgggtggagtggggacttggagaacttttctgtctagctagaggattgtaaacacgccaatcagcgctctgtgtctagctaaaggattgtaaatgcaccaatcagcactctgtaaaaatgcagcaatcagcactctgtgtctagctaaaggattataaatgcaccaatcagcactctgtgtctagtaaaggattataaatgcaacagtcagcactctgtaaaatggaccaatcagcactctataaaatggaccaatcaatgctctgtataatggatcaatcagcgctctgtaaaatggaccaatcagttggacatgggtggggacaaataagagaataaaagctggccaacccccccctcccccaccagccagcaggagcaacctgctcgggtcccattacacggaagctttgctctttcactcttcacaataaatcttgctgctgcttactctttgtgtccttgccacttttaagagctgtaacactcaccgcgaaggtctgcagcttcattcttgaagtcagcaagaccaagaacccaccggagggaaccaatcctggacacagaagaacaggctgcagggcaggaggctgtaaaagaggatgattgcacaagttgattaaattcctataagccctggaaacactccctgtatgtttacagttgatgtgtttattatcagcaaaatagttgcagaaaggcaagacccgaatcatcttagagaatgattctctactttaaataaacgtaaggtaaatcagacctaaatatttccactccagttactgtttccccttccatttttttttcaggcttttattgtttaacaactaataaaaacttttcacatttcaccactcagttttatcagtgtatgttaaagcttctacctttcccatttttctaactgttgccattagagcaagagcaagagatttgtctgggattggggaggtggcggtgaggggaaaggggtgttgttgaactcagggagagtctcacagggcaatagaggtatcatagccaaggtcttaacccttaactttgcatatccagaaacttgattcttagtgctcaggcagaatgagcacaaactaattggaatgttttattctaacctccccaaagagattggacaacaaccacaatgtcagtgcattacattttacttggtaatatgacttccaaagagacttcaataatttcattaactggttggtacatttgctcaccttaatataattcatatgagagggcaaaatataatccaaacaaaggaaatcagtgggatggtctaaatagacattttatcagactattgtaatgtgatatgtcgattgccattctaaatagctattttatctcaatatggggttaagaccagttttccctggatagtgccagagacgtaatctcctccttttggattcactttccccctgattccgtgcgaaacaccacttagagttccttgattttataaagtggtttcatgcctctgcacctttacagatttaggcactgaccccggatgatttggccttgtgtgggctcttttaggtaaatttaagtaaccaataaagaaatctgaggtgagtgagacaggaaatcgttctaataatggctggatgcaggatttctatgcaagggtcttagaagcttcgatccaagggataagtccttcatatcttatttacagaaggatgggaagtgtttctaacatgttttagccaatcttgaatacatttaatttcactgagagcctctctttcacattcctcatgataaataaaaaccactaaattcaatactaaacgtagatttgctgtgctaagcagtagggcttatagctttgaccaagttacagataatggaagacttagtggccacctctggaatgaggcctttcacatgaaatgctaaccaccactggaaagagatttgcaccaattccgattacctccagaactgaaacttaagccaactggcaattactattactctgtctgtgttcaattattttaaagtcaactacagacatggcaaactaattttagtgttactttcctctaaaagcgttttcttatctttcttttagctccaccataccccaaccacaaaatctggtagagatattggtctacttcctgggagagaagtcagtatgggcctttatttgtcctcaccattccttgtgataatttttcatttgtttgtatctctgtctctctagttagctgtgagtagaggtgatgtcttattccacttcacattcaacggtgagtggcaggtagcaggggcccagaaaatgttggatacatgagtcagtgaatggattgccctgggtctcctcttttagattccatgaatgcttttttcctccttttgacacactgtttcctcagctacattaatacaattaattagcttacaccactgtttactaaaatgtttttctctgcaggatattaatgggcactatgcaataaaagattttggtactcaaaaagtctgtgaaatgctgagttaagcaaagtttcataagactctactgtggacttcttaattttaatatactaatatgcactttaaatattcaagaattaaactaagatgagctcctagggtgacataattgagtactaaaaaaaccttaatttagtatttcacacacacacacaaagatcttccaagaaatgtgtatactgtaacattcagaaagaaagaaatcagaggaggctagagagagaatgaaagagagaaagaaagaaaagagaatgtccataattaagtttgtaaaacactcatcaatgcagacatatgttctgaccacaaactcaaattgttctggcttcgatgtaaaccgcgcttattcaacctgttctttaaattctttagtacttttcagcctctgaccttttaacattttcccaattgaatgtctcttcttggggctcagattccattcatatcgcaaaaactcttgacagtatgctaagttattgtatcgtctggttctgttatcatacccttgctataaaattcaatcctggatgaaaccaataatgtgctttcacccttctacctacccagactgcttacaactatagtgtaaacggcacacaggacgcatgactattattctaaattcatgatcaccaataattgggctttcaactctgtccagtaattctactatgtatttctaatcatttcactctctattcatttcagttactatttcaaacaaacgatttccatttttaacctcctatctcccttatctgtgttcatcgcatttatcttgaatttacccatttgtatttagcagctctccgtctcctcaaccaaaatgtgagctccgtgagggtagggaccatctatattttctctcagcgtttctaacactcagcttttgccacaataatgctgcaaaaacaattaaccatagtgagatacaacaataagcatttagttctctcatgactggaagttggcaggagcagctctgctgatctcagtgaggatcactcatggtctgctggttgtctggatgttggtgatttagaccaagggtctgcaaaccttttggttttaattcagaaagtaaatatgttgggctttgcaggccatatgcagtctttgccgcatatacttctcttttttttaatttttaacaactcttttaaaacacaaaaacttagcttgtgagccatacaaaaacaatcacaagctggattttacccacagcccatagttggctatctcctgatctagcgtgtgttgactgggtccctctgcttcaagctgtgggtctaatcgagcttgactgttagatgcaggtgaggttctagtcatttgagctctggagccagggcaagctctactagtgacaatataaaaagcagaagagagcatatgatgcttatgtttcttaaggcttaggtttggaactgggtcactgacacttcagcccaccttttgttagccaaagcaagccaagtggctgaccccaaagcctcagtggagaggttcactttgccttttgtagaaagcacagaaagatacatagcaaaaagtatgaacatagtgaatagtaaagaattgaaaccaataattcaatctcccatatcattatatattgggtatttagacgagcaattagtgcccactaggcccttacaaatttaacaaatgaagggaggattactgcaataattacaaaattaacaacaggcgtgatatagagaacatgtactcagttccaggagccatgctaaacattttacatatatcatatttttcaattcttacatccgtttaggatggctaatattattttcatttatagatgaaaaaactgagtctcatataaggtaagtaacttccctggggtcaattaatattaagttagacctctttctttcactctccaatttctgggttcaggttattctagccattgatatactgaatttatcattgttaatacaagtcaagtttatcacttctagctggccaccatgaaatccatcagtatagctcattacaaatgtagggtggtcatctagtggtgaaagaggaattctataggctgtccactaaagaaaaagtcaataaaaatgaggaaaaaagactctggttcagcttttgttttccattattattgctagaaaagcactgtggcaaaaaaaaaaaaaaaaaaaaaaaaggaactgcctggaaaatctttattagaagaaactcatacatgtttaagcacttttaaagggtgaatatttctgaccaccatctgttaatctgttctgtcctccctttcctaacatttacacaatttcccatttttggctttattcccatctctattggttttggaatcctaaattaatcctgtcaatattgccctcactggcagtctagagtctcccacttatttgataatccatggcagttcctaccatactactcaaggtgacaaaacgttttgaataatttcaataaactgtatatgagaacacaagtaattcacactaacaagtcttaaattggccttctttcctgctttctatcttggaattcttttctcactaattccttgtaaaatatcctcctgttttatctcctgattgagatagatgccatctgatgccacctctcacagatttttttctacctaaaaaccagaagaaagttcttacttccctatttttccttatttttgcttaaattactttttttcttccctaacagcttataatgtgttctacttgcatcttctgtacaccctccacttttgatatggtttggctgtgtccccacccaaatctcacttagaattgtatctcccagaattcccagttgtgggagggacccagcgggaggtaattgaatcatggggactggtctttcccatgctattcccgtgaccgtgaataaggctcgtgagatctgatgggtttatcagaggtttctgcttttgcttcttcctcattctctcttgttgccaccatgtaagaagtacctttcaccctctgccatgattctgagacctccccagccatgtagaactgtgagtccaattaaatctctttttcttcccagtatcaggtatgtctttatcaacagcataaatatggactaatacagtaaattggtactgagagtagggtgttgctgaaaagataaatgaaaatatggaaacaactttggaactgggtaacaggcagaggttggaatagtttggaggactcagaagaagacaagaaaatgtgggaaggtttggaacttcctagagacttgttgaatggctttgcccaaaatgctgatagtgatatgaacagtaagttccaggctgaggtggtctcagatggagatgaggaactagttgggaactggagcgaaggtgactcttgttatattttagcaaagagacaggtggcaatttagcccctgccctagagatttgtggaactttgaacatgagagcgttgatttagggtacctggcagaagaaatttctaagcagcaaagcattcaaaagctgacttgggtgctgttaaaagtattccattttaaaagggaaacagagcataaaagttcagaaaatttgcaatctgaggatgcagtagtaaagaaaagcccattttttgaggagaaattcaagctggctgcagacatttgcttaagtagcaaggagcataatgttaatccccaagaccatggggaagatgtcaccaggccacgtcagagaccttcacagcaacccctcccatcacagtcctggaggcccaggaggaaaaaatagttttgtgggcttggccctgggtccctgcgctgtgtgcagccctgtgtctcatctgctccagccatggttgaaaggggccaatgtacagctcagactgtggctttagagggtggaagccccaggcattggcagcttctacgtggtgttgaacctgcaggtgcacagaagtcaataattgaggttcgagaaccttcgcctagatttcagaagatgagtggaaaagcctggatgcccaggcaaaagtttgctgcaggggcagggccctcatggagaacctctgctagggcagtatggaagggaaatgtggggttatggggttggagctcccatacagagtccctacttgggcactgtctattggaactgtgagaagagggccaccatcctccagaccccataatggtagctccactggcagcttgcatcatgctcctggaaaagctgcagacactcaacaccagcctgtgaaagcagccaggagggatgttataccctgcaaagccacagaggcagagctgcccaagaccatggaaatccacattttgcatcagtgtgacctggatgtgagacctggggtcaaaggacatcattttggagctttaaaatttgactggctcactggattttggacttgcatgggccctgtagcccctttgttttggccaattgcttccatctggaacagctgtatttacccaatacccgtaccgccattgtatctaggaagtaactagcattgcttttgattttacaggttcataggtggaagggatttgccttgtctcacatgagactttggactgtggacttttgggttagtgctgaaataagttaagactttgggggactgttgggaaggcatgactggttttaaaaagtgaggacatgagattcggaggggccaggcgtggaatgataaggtttgtctgtgtccccacccaaatctcaacttgaatttatctcccagaattcccacgtgttgtgggagggacccagaaggaggtaactgaatcatggcggcctgtctgtcccctgttttcatgatagtgagtaagtctcatgagatctgatggatttatcaggggtttctgcttttgcttcttcctcatactctcttgttgccaccatgtaagaagtgcctttcatcctgggccatgattctgatgcctcctcagccacgtggaactgtaagcccagttaaccctctttttcttcccagtcttgggtatgtctttatcagcagcacgaatacggactaatacaccttcctcacatatgcttaattttagccacgcctctccagctctagagatttccatcaacaattcatttttcttacattccattctctctcctttggcttcttttcttttgcctataaacattcaggtgtatttttaatctagaacaacataattcttcacctcatcactcccacaagctactgactcagaatttctcaatacacttctcaaaggcagatcatttatttcttattcctctcttcttctcccactcactctgcccttccaatttggcttttgtctctagcactctattttatctgttcttttgaaattgatcagtgactatcccatcaccaagtccagagacattttcggagtcctctacccagtggcatagattctaatctgggtctgaaagtctaacaaccaggccttaatatcccagttcatgccatcaagctgagagtgaattcatccttcctccatctttgttctatttaggctcttaacttattgaatgatgctcactcacattggggagggccacctgctacagtcagtccaccaattaaaatgctaatttcttccaatatcctcacagattcatccagaaataatgttcaaccagtatgtagacataccctgctccagtcaagttgatagttaacataaagttagccatcatactaaatgtactaaattatcgtgagaagaaatataatgaaccataactgagcaaaaacaaattagaaatttcctctcaataaatacttctcaaaaaatgttgaatcccagttaatctttccggtaaattatttattttcagagagcagcaaatactgatttcttttgcaacggtagagttcaagtatccaaaatgacaagggtggcgcacacaaaaaagagaagctgcctatcatatgaatagtcacacaaagatatctataaagtcttaccaaatgttatccaattatattagaaggagccataatttatcatgactgtatagagttcatcccagaaacataagtttagatcaatatcaagatattttataaaaagaggttaaattaaataattatatcaattaattccatataaatatttcatacaatttaattctcatttctccaaaaagttatatttgttattttatttatttatttatttttgagatggagtcttgctctgttgcccaagctggagtgctgggggtgatctctgctcactgcgtcctccgcctccccagttcaagcaattctcatgcctcagcctcccaagtagctgggattacaggcgcgtgacaccatgcccggctaatttttgtatttttagtagagatggggtttcactccgttggccaagctggtctcaaactcctgacctcaggtgatccgcccaccccggcctcccaaagtgctgggattacaagcgtgagccaccacgcccggccaaaaagttatttttgaactgtgaatagaaagcatattggttaagcccctgacagtggaacaccatacacaaaagcatgaagcagtacatttgcatgtgctttcactgttatacaatgttgtttggatgttcaggcagcagcatacgcctttccttcactacttcctattggggtggtggaaccgagagctagaagaccaggcaatcttactcaattatttcttccttattttacgcaccaagacctgctgattccctctctcctgatcttctcactattcacttctctcttttgcattcttgttgaactgttgagactaattcctcatatcttatctctttttctgggtattttaagtggtcttcttggtggtggagccttatctccatctaattattaaattcttcacaaattatttttctaaaatgcaaacctgctcataattttcttctcattttaaatctttttacagcctcacattaaattttttttaagatgcaatttaaggcagaataatgtagcgcagcccccactttcagatctgaagctgaagccaggcataatatgtaaagcacccagcatagtataacatggactacatatatatgaatgatgtatagcagactagtgatatatagaagatgttgcacttacgttaaaatctccttttaggtaaaatgcttcactcaaatcctctgagagtgcaactgactttattcagagtcaggctgcgtggaaaaaccacttgtgtattccagtttggataatcaagaaagaggcttatttgctctgctaacagaggcttttccactcatgtgcacttaaagctacaaaaggtagatataaccagaagcagttccttctgcttggataaaaattggaaaagctctgtgcattgacatgcacaatcttaggcattgggggcaatttttaaaaaaagaagtggaaaaagcaagtagcagatgttggactcgcagtggcatgtagtggaggcagctgcagggcaactgttttctatctggagagccctttggaagagcttttgaggttcttcaaatatttgattagaatttcatggatgccaatgctatatgagaaagcttaacattttagtgttctgcctaaagttttattgaaaataaaatcctgctaaggcaaacaaacagaaaaagttaaaaaaaaaaaaataccagtgaggttgggcacagtggctcacacctgtaatcccagctctttgggaggccaaggcaggctgatcacctgaggtcaggagtttgagaccagcctggccaacgtggcgaaaccctgtctctactaaaaatacaaaaattagctgggcatagtagtgcatggctgtaatcccagctactcataaagctgaggcagggagagtcacttaaacccgggatgcagaggttgcagtgagctgagatcgccccagtgcactccagcctgggcgacagagcaagactctgtctcaaaataaaaaacaaaaacaacaatgaacaaacaaacaaaaacaccagtgaaaatggcaaatctatggacttcagagtctgacagacctggtttaattccaggctccaattgcaagtgccatcttgggctacttaacgtttcattgcctgaattttctcatctataaaattgaacacttatccccactaatttttccaagtatacagaatgcctagtacctaggaaagggtgctagtcttttctctactcctcaactgttaccatcgtaaaacatgtaagatgtactgggttatacattcattcagaatatctctcaaaggcagaaggactagaattttttctgtgaggatgaacatatcagagtgccttgataccagtgtataaaaatctaccacaggtttatcttagagatacaagatttaaatgccaaaatatttctgtgtttaaatcacctgtagttaaatctcaaaattctttttctgaaaagaatcaaggaaagcaacttccttttgtaagctttttgtttaaaattggactcctaacctttaggggagatggtggcccttaatttatcctgtcctgcaggatttggagacctcctcagcactggcaaggtctgtcccctatccctttcattatatattctcttagctgtctgaaaatcctctatgtacaatgtatgttatttcaggtatggacaattgtcatactttggataaaataataaattaatcccagcagactgtcttctcttttataatgacatttataaattgctgcctcgttgcaacatttagaaacccacaatggtgcaagcctagttctcaagtcactccaaaggtgtttggccttctgaaacctccttacttttcattatgaagcttctttactttccattttcctttgagtcacaaatttctgccaccctgcttctgcatgaagtgtgtgctctgtctagtgacatagctctgctaacccttataagcaggcattttcagtcttgtgccaccaggcctgcatcctgtgccttctaccggggaattgcttaggccagtgaaaactgacttctaaggaaggttttttccttggctatattttttttcatggactcaagaaatgaagctccaggtgatgttttgaaagctagtactgcttctctcttaatctccttactttttcaatatctcaaagtgtggtccatgaacccctggaagtccctgagacctatttaggaggtctgtgaggttaaaaaatattttctttataatgttaagatgtgacttatctttttcacagtgttgacatgtgcattgaaagtgcaaaagcaatgatgagttaaagtgttgacaccttaacacaaatcaagacagtggcactaaactgaactgttgaggtagaaattgtgttctttaccaacatggattcacatgaaggaaaaagaaagccagttccacttaaaaataaccttaatcaagcattaaaaattactgattttattaaatttcaacccctaatgatacacatttttatgatttcgagtgacaaattgggaagtatgcataaagcatttctgttccatactgaagtatgatggttgtctgtaaagaaaacatttgtgtgattgaattgcaaactgaactagtaacttttttcatggaaagtggtatttaccttaaagaacaactgtcagataaactatggttttacagatttcaatatttggcagatttttttgtgaaaatggacaaatgcgcctgtcatttcaagcggtagaactcaaatttgatgccagtggtcacacttgaacttctaagcaaaagttagaattttggaaaagtcatgcgaaccacactgggctggacagcttacaaatatatgaagatattttatgtgattcttagcactattaagaatcgttttatattttataaagtagtggggcagcgtgttaacatttggaaaatctgcacagctcagtgaaccaatattttccaaatgagtaatacataatttcaaaatatcatgccttggcaaaacaattatgccagatagaccaataaatttcaatgtaaaaaaaaacaatgaaaagttcactgatagggttgtaaatattggcacgttccaaatactctttaagaaacgcacttgtagacttttgtatagtgtcaaaaaagatccatacctcaaactgtatacaaaaattaagttaaaatgaatcatagacctaaatgtaaacccaaagctataaaactgctagaacaaaacagagaagaaaacttcatgactctggttaggcaaagacctcttaaataagacaccaaaagcacaatccgtttgttaaaatgatacattgggatttgtaagaactgaaacctctgcttttttgaaacatgggtaaggaaatgaaagataaatattttcaaattatatacctgataatgggcttaccatcagactatatcaagtattttcaaaactcaaaggaaaaatattcagttaaaaaatgagcaagaaaggagatggagcaagatggctgaatagaagccttcaccagtcatcctccctgcaggaacaccaaattgaacaactatccacacacaaaaattaccttcataagaaccaaaatcaggtgagtgatcactgtacctggttttatgctcatattactgaaaaaggcaaggaagaggaaaggaaagacagtcttgaattgctgtcaccacccctcctgcaccccccagcagcagctgcatagtgtggagcaagaatctgtgtgcttgggggacagaaggcacagtgattgtgagattttccattagaacttggtgctgccctgtcacagtggaaaacaaccctggccagaactcagccagcactcacagaggaagcatttagaccagccctcaccagaaagaaattgcccttcccagacgtcagaacctgaattctggtaagcctcaccaatgcaagctaaagtgctcttggattctaaataaacttgaaaggcagtgtaggccacaaggactgcaattcctgggcaagttctggtgctgtgcttcgctcacagccagtggatttaggggtatgcaacctaatgagataatagctggggcagccaagggagtacttgcaccacccctcccaccacctcaggcagtgcagctcacagctctaggagagactctttccctctccttgaggagaggacaaggaaaagtaaagaggactttatcttgcaacttagataccacctcagccacagtaggacagagcaccaggcagaatcctgaggcccgcattccaggccgtaccttctagacaacatttctagacatgtactaggccagaagggaacctgctatcttgaagtaaagtacttagtcctggcaggattcatcagctgctgattaaagagcccttgggccctgaatagtcaacagtggtagccaggaagtactcaccatgggccttgggtaagactcagagacaagctggcttcaagcatgacctagcatattccaagccatagtggctacagggagagcaaccttctgcttgagaaaaggggagggaagagtgaaggagactttgtcttgcagcttccttaccagctctgtcacagttaggtagagtaccaagcaggatcttggggtccctgattctaggccttagctcttggaaagaatttctggacctgctctgctctgggtcagagagcatcctactgtcctgaagggagagtctcagacctggtagcattcagcacaagctgactaaagagcccttgggccttgagtgaacattggcagtagccaggcagtacttgctatgggcctggatctatgccagccacagagagagactcctctgcttgtggaaaagagaggaaagagtgggaaggacttcatcttgtggcttggatgccagttcagcctcagtagaatagagcaacaggtagatttctaagggtttcaactctgggccctgctcctgtatggcatctctgaacctactggggccaggggcaactcatcaccctgaagggaagaaaacggcatggctagttttgccacctgctaattatagaaccctagggccttgagtgaacgtaagtggtagccaggcaggccttgggtgagactcagtgctgtgctggcttcaggtctgacccagcacagtcccagtggtggtggccagagggtgcttttgtcacccctcccccagctccaggcagctcagcgcagaaagagacagaaagagagatagcagggtggagagagagagactctttgtttaggagaaaataagggaagagaataagagtctgtgcctggtattctagagaattattctagatcttaactaagaccatcagggcagcatctctatgagtttgcgcaagccacagcattattgagcttggggtactccctaatgcaaatatggctgcagtgatcaaaaacttagattacaacacccaaatccctatgaatacctggaaagccttcccaagaagggtgagtacaaacaagctcagactgtaaagaccagtaaatacctaactcttcaatgcccagacactggagaacatccacaagcatcatgaccatcgaggaaaacagaatttcaccaaagcacttaaataaggcaccaggggccaatactggagagacagagatatgtgacctttcaggcataatttgaaatggctgttttgaggaaactcagtgaaatgcaagataacacaaagaaggaattaagaattctatctaacaaatttaacaaagacattgaaataattaaaaacaatcaagaaattctgcagctgaaaaatgcatactgaagaatgcatcagagtctcttaagagcagaattgatcaagcacaagaaataaatagtgaacttgaagacaggctatttgaaaatacacagagcagacaaaagaattaagcccacccaccagatctagaaaatatcctcaaaagtgcaaatctaagagttattggccttaaagagaggtagagagagagataggggtagaaagtttcctcaaatgataataacagagaacttcccaaacttagagaaagaccaatattcaaatgcacaaaggttgttgaacagcaagcatatttaacccaaataagactaccttaagacatttaataatcaaactaccaaaggtcaaggataaagaaagaaccttaaaagcagcaagagaaaagaaattaataacatacaatggcgctccaatacatctggcagcaggttttcagtggaaactttacagggcaggagagagtggcatcacatatttaaagtgctgaaggaaaaagaaaaacttttatcctagaataatatattcagcaaaaaatatccttcaaacactcaacagaaataaagaccttcctagacaaacaaaagctgagggacttcatcaacaccagacctgccctacaagaaatgctaaatggagttctgcaatatgagagaaaaagacattagtgagcaataagaaatcatctgaaggtgcaagacttgcttgtaatagtaagtacacagaaaaccaaaaacacagaatactgtaacagtatacttgtagcatgtaaactacccatatcttgagtagaaagactataaagtaagccaattaaaaatagtaactacaacaactcttcaagacatagacaatacaataagatataagtagaaacaacaaaaaattaaaatgtggggaacaaattcaagtgtgaagtttttattcattttcttttttgttcatctattagttgttagcttatgtaatcaatattaagttgtcaccaggttaaaataaaggattacaagaaatcctttgcaagcctcatggtaactgtaaatcaaaaaacatacaacagatgcacaaaaaattaaaagcaagaaattaaaacataccaccagagaaaattaccttcactaaaaggaagacaggaaagaaggaagataagaccacaaaccaaccagaaaacaaataacaaaatggcaggagtaagtccttacctcttatcaataacatcgaatataaaagaactaaactcttcaatcaaaagatgtatagtggctgaatggatttaaaaaacaagacgcagtggtttgttgcctatagaaacacattttacctataaagacaaatatagactgaaaataaagggatggaaaaagttattccatggaaatggaaacaaaccaaacaactaaacaaacgaacacaaaacaaaaacaaaacagaaatagctatacttagacgaaatagatttaaaaacaaaaactataaaaatagacaaagaaggtcattatataatgataaaggagccaattcaacaagatgatataacagtttaaatatatatgcacacaacactggagcacccacatatgcaaagcaaatattattagagctaaagagagagatagaccccaatgcaataatagctggagttttcagcaccctactttcagcattagacagttcatccagacagaaaatcaataaagaaacattgggccgggcgcggtggctcacgcctgtaatcccagcactttgggaggccgaggcgggtggatcatgaggtcacgagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaagaaacattggacttaatctgaattatagaccaaataaaactagtagatatttacagaacagttcatccagtggctgcagaatacatattcttcacctcagcacatggaccattctcaaggatataccatatgttaagccacaaaaaaatcttaaaaatgtcaaaaaatatcaaattatatcagctaacttctctgactacagtagaataaaactagaaatcaacaacaagagaaattttggaaaggatacaaacatatgtaaattaaacaatatgctcctgagtgacctctgggtcaatgaagaaattaagcagataattgtaaaacttcttgaaacaaatgacaacggaaacacaacacaccaaaacctgtaaaacataccaaaaaccagtgaaagcagtactaagaggaaagtttatagctatacgtgcctacatttaaaaagaaaataaacttcaaaaagacaacctaacaatgcatcttaaataaatagaacagaaaagcaaaccaaacccaaaattggtaacagaaaagaaataatagagatcagaacagaaataaatgaaactgaagagaagacaataaaaaaagtcaatgaaatgaaaagttggttttttttttgcgacgataaacaaaatcaacaaacctttagccagactgagaagaaagcaaggaagatacaaataaataaaaccagagataaaaaaggagacattactactaataccagaaaaactcaaaggatcattaggagatcattagtagctcattagtagactcattagtagcttctaatgatcctttgaatttttgtgatattagttgtaatgtgtcctttttatatgagcaactgtatgccaataacttgctcatataaactggaatatttagaagaaacaggttaattcctagacacttgcaacctaccaagattgaaccaggaagaaatccaaaacgtgcagaccactaacgaatgacaagagtgaagctgtaataaaaattctcccagcaatgaaaagctcaggacctgatagcttcactgctgaattttaccaaacatttaaagaagaactaatatcaatgctactcaaagtattctgaaaaaaatagaggagggggaattcctccaaactcattctacaaggctagtattgtcttgataccaaaatcagacatgggcacattaaaaaaagaaaagaaaagaaaactacaggccaatatgcctgatgaatgtttatgcaaaactcctcagcaaaatactaggaaaccaaattcaataacacattaagcaaatcattcatcatgatcgagtgggatttatcccagggatgcaaaaatggtttgacatatgcaaatcaatcatgtggtacaccatatcaatagaatgaaggacaaaaaccacatgattatttcaattgatgctgaaaaagcacttgataaaattcaacatccctctattataaaaaccctaaaaaactaggtatagaaggataatacctcaacacactaaaagacatatacaaaaggctcacagctagtatcatactgaatggggaaaaaccaaaatcccttcttctaagaactagaaaataacaagaatatccattcttgccactattattcaacataataatggaagtcctaactagagaaatcagacgaaagaaataaaggtgtccaaattggaaaggaagaagtcaagttatctttgtttgcatatggtatgatcttataattggtaaaacctaaagactccaccaaaaaaaaaaaaaacattaaaattgataaacacattcagtaatgtggcaggatacaaaatcaacatataaaaatcagtagcatttatatagccaacaacaaacaacctgaaaaacaaatcaaaaaagtaatccaatttacagtagctataaataaaaataaatacctaggaattgacttaaccaaagaaatgaaaggcttacacaatgaaaactataaaatattgccaaaataaattgaaaagaatacaaaaatcaaaagatattctatgatcatgtattggaaaaatcaatattattaattatctatactacataaagcgatctagagtttcaatgtgatccctttcaaaataccagtgacattcttcacaggaatagaaaatacaattctaaactaagtgtccatcagcagacatatggtatatggaaccacaatcgacctagaacagccaaagctatcctgagaaaaaggaacaaaactggaagaatcacattatttgatctcaaattatactacagagctaatagtaactaaagcagcatagcactggcatgaaaacagacacatagaccaatggaacagcatagagaacccagaatcaaatccatacatctacagtgaattcattttccataaaggtgccaagaacatacattgaagaaaggacagtgtctttgataaatgatgctgggaaaactggatattcatatgcagaagaatgaaactagacccctatctctcaccacataaaaaaatcaaaccaaaatggattacagtcttaaatctgagatatcaaactatgaaactactaaaataaaacattgaggaaactctctaggacattggcctaggcaaagatttcttgagtaatactgcagaagcacaggcaacccaagcaaaaatggacaaatgggatcacatcaagtaaaaaatcttctgcactgcaaaggaaaccatcaacaatgggaagagacaacccacagaacaagagaaaacatttgcaaactacccatctgagaaggaattggtaatcagaatatataagaaactaaaaaaattaaataggaaaatatctaataatttgattaagaaatgggcaaaagatctgaatagacatttctcaaaagaagacatataaggccaggcatggtggcttacatttctaatcccaacactttgggaggctgaggcacatggatcacctgaggtcaggagttcgagatcagcctggccaacattgtggaaccccatctctactgaaaatacaaaaaattagccaggtatggttgtgggtgcctataaacccagattctctggaggttgaggcaggagaatcgcttgaaccggagaggtggaggttgcagtgagccgagatcgtgtcattgcactccagcctgggcaacaagagcgaaactccatctcagaaaaaaaaaaaaaaaaaagacatacaaatggtaaacaggcatatgaaaaggtgttgaacatcactgatcatcagagaaatgcaaataaaaactacaatgggatatcatctcctacttaaaatggattttatccaaaacacaggaaataacaaatgctggtgattatgtggagaaaggtgaaccctcatactctattgttgggaatataaattcataccatcactatggagaacagtttggaagttcctcaaaaaactaaaaacagagctaccatatgatctagcaatcccactgctatgtatataccccctcccctaaagggaatcagcatactgaaaagatatctgcactcccatgtttattacagcactatttgcaataaccaatattttgaagcaacctaagtgtccatcagcagacaaatgggtaaagaaaagtggtatttatacacgatggagtactgttcagccacaaaaaagaataagatcctatcgttggcaaaaacatggataaaactggaggtcattataataagtaaaatatgcaggcacagaaaggcacacttcacatgttgtcacttatttgccaatgctaaaaattgaaacaattgcactcatggggatagagagtagaacaatggttaccagaggctgggaaaggtagctggggggagagggttagtggaggtggttaataggtacaaaaatacggtgagatagaatgaataagatctagtgtttgacagcacaacaggttactacagtcaacaataatttatggtacatttaaaaataactaaaagagtataattggattatgtcaacattgaggtgatggatttactctgatgtgattattatgcattgtctgcctacatcaaaatatctcatgtactctgtaaatatatgcatcaaacatgtactcacgaagattgaaaatgtttttaaataataaaaataaatgagcaaaacatctgatcagacattttttcaaggaagagacacctgtgacaaattagcatataaaagatgtccaaaattattaatcattagggaaatataaaaagcataagttattattacacacttattaaattttttgttcttttaaatgtattactaaagtataatttacatacagcaaaatttaccctttttagtgaacaactatgtgagttttgacaagcagaggtttaagtttggacaaaattcaatttatcactttttaaaagtgggttgtgctttcattgtctaattatttaaaagatctttgcctaaagaagaggcatgaagcttttctcctatgtattcttccatcggttctatagctttaggttttacatttaagtctatgatttattttagcttaatgtttctattcacttctatctattgtcttcaagtcaatagatagaagatttccatcgcctgccccaaaattcccctgtatctctttgtcaaattccttcttccatcatagcccctggaaactatggatctgtgtttttgccttgtagttttgcctttccagaatgtcatataaatagtaccacatatatagctaaaatgtttaaaataaagaagaaaagacaacagtgacaggtactggtaagtatgcaaagcaaatggaactctcatacatcagaatgcatattggtacagccactttgaaacatgtttgttgtaggaacagaaaaccaagtgctgcctgctcttacttataactgagagctcaacatagagtacacacagacacaaaagaacaatagacactggggcctacttgagggcgtaggctggaaggagggtgaggatcaaacaactgcctatcgggtactaggcttattacctgggtgacaaaataatccgcacaccaaaccctcagagacacccgattttcccatgtaacaaatctgcacaggggccttctgaacctaaaataaaagttggaaagaaaaaaaaaaaacagtttgagagtttcttaaaaaaaagttcagtacatagctaccatatgacccagcaattccactcctagatattttcctaagtgaaataaaagactatggccacacaaaagtctgtgtgtaaatatttatagcagctttatttgtggtcatcaaaactgaaactcaaatttcctttaactggtgagtggataaatcgtgatacctctatacaatggaacattactcagaaataaaaagggacaaactgatatatgcagcaacatggatgtctctcaagtgtattatgctgagtgagagaagccacactaaaaggagaatggtcccatttatacaactcctcttatattacattttggaaaaggcaaaacttcaaggtaggaaacagatccctagtttccagggactggggtgagaggaggagttcaacaaggggaatggggaatttgggagaataatggaactcttctattaacttgagtaccacatgcacttgccaaaacactaaaaaaggtaaactttggtagatgtaaattatgccttactaaagatgttaaaaagaaccaaaactttttttgttaaaaaaggaggggtaaagtagaggtaggatccaaactcctctttttttttgagatggagtctcgctgtgtctcccaggctggagtgcagggtgctatctcggctcaatgcaacctccgcctcctgggttcaagcgattctcctcctgagtagctggaattacaggcgcatgccaccacgcccggctaatttttgtatttttagtagagatggggtttcaccatgttagtcaggctggtctcgaactcctgacctcgtgatccgcctggtttggcctcccaaagagcagggattacagatgtaagccactgcacccagcccaaactcctcttttttttacagctgaaactgataccagataatgtagtgtccctttgtggagaagttattgaagttagagactgtgcccaacaagagctggccccaggcccagggccaggtttccatatctaagcttactgcatggtgagaccagtctgaacaatgctctctgcaggtagaccacaagagacgggtgatggaagaagctgagctacaggtattctggtcctctcccaaaccctccaatcaggcaattcactccacttccgtcagaggagtagtggtgggttttcaataaatctctccttgtagaaaacagaaatgggaaagaaaatgtgtctgctcatattgccaatcaacatttctttcatgaaaaatttaagcatattggaagctaacaaagtgtaactacaggattttttttaaatttattttccagcaagtgcccaatcctcctaaatcaccatctctagaaaactcatttttctgcaagaaatcatcaaatgagcatgttccactgcttatacatgttctaaatagatgatataggttccgctgcaatattcacttgactctgtgtcatttaagtctccgtgactttttataggtacagattttatagcagccagggatcatgtctgtttaattattgatgcatagtgcctaacatagcatcgtggagatataatcagttaaatattacttctgattgatatgacgatgtgtacacatcactttaagtatgaattttttgtaatttagtttattcatccatcatctctctgctctcaagaatttttctttactaaaattctcataatttaatgcaatttttatttaaaaaatatccatgcacaactagaacctgaaaaaattgactgtaataattttaaaatttgaggcctgcgttaacatgtttttcggtaatgatcatacacttattcacctaacctatttatgttttctttggattcactatttttgaattcttgctaccattttaaatggtatattaggttctaaaatgaacctgtaggagaggtcagttcaataaatgaaattcgctttcaattatatatattaataatttggtgagctatggtaaattatttgggaatttgggtctatatattcttctcagaaagtaagcccagagatactcagaggtgctaccaattggggattgtaatggagctcttgattctattacatgcatcacagactttctggtgtacccccaactgaaagttcctttaaaataagcctcagggaccatagagagattgatcatttatctgaaataatgttatttctgtggtttagtctgtttgtgcaacctctggaaaatattttctatcttatcttataataaaaatgtattgttcaccattggaggaatctattttagtgacctattttgggtattttcccgttatggcaaataatatacttttaatgtattttttataatgatgctattctttattcatttttataaggaagtacataatctagtacataatcatttaaaagcaaaaggcaaaagattagcttatgaaccagaaaagtatatacttatatagttacatatagtacgctaacattttataaatcaatatgaaagaaacagaaattgtgcaaaaaatatgtatgctttaacagaatataggccgtttggcagagtgttttctttttacttgttaaaggagtacactgaagcactaggttttattcatcatcaagcctcatttttctgctattgtatgagaattcaataagtgaattttccagataactgaagtataattttaatattcttcactgtacttatttaccgttctaccctcaatgggaagtactctaatattcgttaaatattatatgaccttcctaataaaacactttgaacacaatataaacttttcttgataacgtggggtcactattaaaaccatgttacctcaattgtaagacttcttcctattagggaacaccactgctacaaaaataagacttccagggaaaaaaataaagcaatattaaatatactaattgacaagatacatacatctcaattgcaaaacattaaaatgtgggcgagaagaaattacatattcaaatgtagaaactgtgttgatattaattttgtttttttattttactttaagttctgggatacatgtgcagaatgtgcaggtctgttacataggtatacatgtgccatggtggtttgctgcacctatcaactcgtcatctaggttttaagccctgcatgcattaggtattatcttaatgctctccctccttttgccccccaccccccaacaagccctggcatatgatgttccccttcctgtgtccatgtgttctcattattcacctcccacttatgagtgagaacatgcagtgtttggttttctgttcttattaattattaaaatgttccctcaatatgcagcaaaattcttttgctgttgggtcctctcctcattgctggcagactctgttatcacttttcacccacatcacttccagtgtcaactcctgtccattcctttctattgtgctgctgccctgagctgctggctgtgagttgtggaaacccaaagagcaagctagtcactaattatgttaaataatgctgaataatggcagtaagattcttcccttaggccctaaggccgtactttagtgctgaggttttgcaacaactgctactgtgctcagaggtggtgcctcacatctagtgtcaggtctgtgttgtaatgaaccggaattgccaggaacttgtactttggatgaatgatgtgtcaagtgcattaagaatcttgaaatgcatcctatatagactacttactaaaattccacaatcttgcattctcatagcttgaaagaaatatacaaaatgcagatactaccacaccctcatttcagagctgactttatcaggaaacatactgagatctcaaagacaaggggatgtggcgttgaaacgggaacatgagagccgatggatactgccctttgctttgctgtaagggccagtggccttgaggccccaggcacagtcacccacatctgtggcaagcatcatggtggcatttccaggtgagtaggagagagtgagaaataagtcagagaagaaatccaagtcttaggtgactgtcagtcatgaagagaacactggcaagagttcttcataacaggaactcagttacaggcttcgcaggggtttgaagaaaaacgggaccttctgtaagcccaaaggaagtatatggcaactggcccatgtcttaaagctccagaggagcaggctggagttccagctgataattggagtggctgaagggaaactctgggaaggcccagatttcaaagtggatcaacgggaaataagtagagaatacaatcactcaaggggtacatgatgtttggatttctcccttctatgagagagacaccatgtatatcaggaacaaagatcaactgcagccatcaccaacaggtggggtttaggagcccgatttgctttttgtgagggacctggtaagtctgagcctgaagatcatgaacacatatgccaacttcccttgtgagaaattaggaaattctagagaagtcaagaagtgacaaacacttcattgttttgagcatttgtggtgccacgaattggaatgtaccatcacatgatttagccaaaagtctgtttaaaagtcaactatttgccactcaagactcttctggcccgagacaagaaattcttgggagaaagtggacagaaatgtacatgtgatagacaggaaatgaactgatcggaataagtgtgaggagtggagaagaaaattctatggaaaatgtgaaattgtatggggagaggatgcagaaaatatggattgagaaactgtgagagccaagccttcaaaccagtatgttcttttggggatatttcaaagcctagagccatttctactccctccctccctttgcttccaatgccattgatttatctgcttgctttccatttcaatacttgccactgtccactgcaaaaaaataatttttttgtacctctcttctggtatcaaagcaatttgaaagggttctattgttcatatagtttttgatgctgttgtcaaagatatcagtacaaataatagagagaaccagtaaggtaatacatattttcttctttcccttctccccatcattgtatattccacagttctttcacatattctgtgaataatatactctgccaagctttgagatttaaaaaaaggaaacgtggttatagtgtcctcttggagcttacagtcaggacagagacatgaacaggaagaaaatcttgtccttagagggagtggagcagtagagagaagaggaaagaattgagcaggatgtggtctcaggtagtcctaaccacttaagaaattatagcttagagttttagtaacctgcctaaggtcacatagttaataaagagtaaagttaatgttaggtattgatgaattaaaaattcatacactttctataccaactttttttctgcagagaatagacctaagagactcaagattttatacttactcaactatgttgatgatgaagggccattctaatgaggatgtccttgactttagagtttgagctaaacttggagtttgatagaggttatattcattagctttgaggacaaaacaaaagaaacaacaacaaaaaatacttgaggttattagctagttttcagaattttagataattgtttttatatgatcatgtattcatgcacataatattttcttcactggtatctattacaagcgagaagatatttcagagggggtttacattaatacacggcttgtgtcatcaggaaatgaaagaattgaggaaccccttaaccctggaaatttacaggccactatttaaactatagtagagtcattttgcttaatcttttgcataattattttgattcctaacacttcactgttgaaagggcatagaatgggaaagctaaagtatgcctgggctataaagctttagaaatctctcctttagataattttaaatagatctaattcaccttctgtattcatccaaagtgaataactgtagaggcagtgaaagtatttattcatcaacatttggacccaaaccatgctaacaacaagccgcttcacaatacagtcctcttatcatgtagtggttaagttgacacttggagctgctgttgtgtagctatgtaaattaggcatgatcctctgctttggttttcttgcctataaaataggagcatagtattccgtgtagagtccttgcacaagtgctgggcatggaatatgaactcaaaaatgctaagtatcatgattgctttgaacttcacgctagctgtttttccattgcagttcaaaatgcaagtctctccaaacctctctactttcttaatattctgtcaacaaatcattgtaatcttccccctactaacattctcccactgttgcccattgcccccatcctattccctttgctctttgaaacttcggtttcaattgtaaacaaacacttgtaaacctttaatatttcccctgacaatttttctacctcaatttcttgtcttaattgaaatttagatttactctaatgggaatgctttctgttcagccattcaaaggagatgagagttttgtgtgtgtgtgtgtgtgtgtttgtgtgcgtgtgcacctcatgatcaaaagacaaaatatgaataaagaattggagagttttcagcattcttcttattctgcattactcttctttcaccttacctaaaaactttttttaaaacaattatgtcatctggctggaccgctatgcatatatcctaattcttagcatattctggtcttttccctaagttcaccaattagtttgaaaggagaaagtgggcagtggaagcagaaggcacagtcttccttctcctcccctccatagggctgaggtttacagtgtgtggacctttagggatgctgaaagaggaagcgatacttccttccaaagtgagaaaattggctgagaaataggaagagatcagttcatgaatggacttcttaagcaaagaaatttgaactttatcctaaaagctacaggaacctactcaaggattttgagtaccagagagaataatcagatttgaatttccgatcactgtagctgcattttgaaagcttttgctagacatgacataaggctatatccaaccagattaggtaaaggaaggatttaaaacatattatggaagtagattaactgggacttggggaatgtttagggtaatagtgggaggggagcctgaagaggcctccaggcttctgttttggcaactaggtaaatttggatactattctatattgtcataattagaattcctaatgtatgaggttatcttaaagattaaatgacttaatacgtttaaagtcccgtaaaccattgctgatatgaactcttttatttgcagaggcactgactgtagaaatgagtttaagtacaatgtgaaggaggagaggagaggtgactaacgatcattagtttagttttaaagttgagttaggagtgggtccactgtaggacatccatttagagatacagaactcagcactcaacacaatactttagcttgcagctatgaactgaagggtcttaagtacagtgaaagtcatgaattttaagtcattaaatttattcaaatgtaacttctgtaaatagagtgcaatgatgatcgaatcaaaaaacaaatccctgagcaagtctgttttaggaaagaggcagagacagagaggggagcctaggaatgatgaaacttggtagacagaaattcaggggacatccacagacattaaaagagttgaaaaaaggagggaatgtcagcactgtaaaatgttgccaaaagttcattcaatataataagtgaagttcaattagaataagcactgaaatatggattaagtcataaagaggatgttggttaatgtgtctagggatatttccataaagtagtaagagttgattcctgacttacaggtgtgacatctgcagaaatgaagaaatgagagaatgagacctctttttccaaagtttggttgggagaggaatgagacagagatgaatgtaccgagagtgaaatgtaaccttcttattaattatcattaggtggatgtactggagtatacttatatatggaggagcaagagagaggacagtgaggggatccaggcatggaggagaggagggaaataactgacttagcaaggtatctcaaaagtggggcatgctgggatcagaggaaatgggttacattagacaggaagaatgcatccttcctgtcacaggagggaaggtggaaagataggcacaggcagtgataggaaagtgtttctaagggacaaaattgaggtaatttctccctgaagggctcagtgaagtgggagtcagagtcatttactgagagacagaggaaaagaggttgtgttggaagtttaaagggaaatctaaaagtttgaaataaaagcagaataaaagagctgtctaggtctatgtaagaaggtgtggggaccaccccaaggccctacctgagattagaaatcatgaattcctggtggcttgttttcacaaggctggttgttactccgtaagaatcttctcactgcaaacgtcccatgatcgttgctcagatgtcttgcctagatgctgatctctgcacttctccatttcaccttcagcactccctttgactgatcccagactcacagatctgaactcttcttcaacactgcttcaaagtgggactccagaccccttatctggccattttcacagaccctgcctgctcggtccttgggctaacattgcagaacctgacttctgatgcacctgacattctgacaactgcaggaaagcttttacttggtagccaggcttccaattttaatcttacttgaagatctggatttgaaagaacaaccgctttatgagcaagtgattaccaaacctgatttggtggaagcccagcttgtctctagatatcctcagggaacttgttgaaattattttttgccaagacaatgtaaaattcactttaacatatataccttgggcaaagggatgggaaattaaaaaccatagggaactcagcttctaataaaactgaccctctttttggtaatagaacattgtgaattacttattgagatattctccacccctacaaatattaagtagtgcagcgattacagcagagacagcatactttaagaatgaagatgttactgagttctgcagagctaattacacataaggtctatttcttaacctgcagttgccagggtttgcagcaactagtaaggccaaactgatttggcagctggggcttggggagcacgggtaggggatgggagtctgcagagttctccatttagtagagtgccacattgccgaagagcgactctcctctcacattacctcctggaggctggactggatgttctccttgaagagaaaaaaaagtaaattggaaccccaacagaattattaagaatgttcaggttgtctataagaaggaaacactgatgccttggtcttcatgttgatatttacttagcaggacctgcagggtctgccgaggtactgtctgaatgttggggtggggaacactgggaaggtacttagggggcatcagggattacccctggggctcccagtgctggaggtggatgtgaggtgagtactgccatgtgggccctgaatcaggtcccagagtgtggataagatccagagttgcagaattgcagtggaaaagaaaggctcacacatgagaggaatactgtgtgagagccccacagggccgccaactctagatgtggctgagggtcagaagggaccgcctgtgcttaggaaggttgcatgaattaccccagcagcagaatagcttgagatctccatccacccacaactagtcgatacataataagtgaaattagcagaacagatcaatagagggcacagaagctttgtgatcatcaattatatcaacagtggagatttctcttgttttatccatctgtattattcaggattctccagagaaacagaacaaataaaccatagggtgtgtgtgtgtgtgtgtgtgtgtgtgtgtgtgtgtgtaagtgtgtgtaatgtatatacaaataaatataaatctatatatacatgtatatacacagaggtatatatgtatgtatatctctatataagagatttattataaggaattgcctcgtggttatagaggctgacaagtcaagacccagagagccaatggtagagttccagttccagtacaaatgtccaaaggcctgagaagcaggagagctgatggtataaattccagcctgagtttaagtccaaaggcaggagaagaccgatgtcccaacttcaagatagtcatgaagagaaagtgaattctccctttctcagccttttggttctaatcaggcattcagtggattggatgaggtccactcacattggagagggcaatctactttattcagtcttctgactcaaatgttaatctcatccagagacactctcacagacacacctacaaatcatgcctaaccaaatatctgggcacttcatggccagtcaagttgacacataaaattaatcattgcaccatcccaatatgagacatttaaaaataaacaggatttctctttataattaggttgaaactttatatagctgtcaatgactaaaaacgcatttaatcaggccaaaatgttaagggagccatgcaatatttgggacacacttatactaaaatattaatattaatatactaatataaagtattaataaataatattatttatctgaaatccaaatttcagtaggcatcctctatcttatctggcaaacctactaccttcccctataccagaataagtaataatttcagttaggaaattggagagacataattgatttcattcttttgacacactatatatgaaaaataccatttcatttgctgcaatggaaaatgccttgggaatagcaaccagtaaaacatgttagtgtgttgacatttgaaaagaaagttataggattctttaactctctacctctaagccactcacagaattccaagggacctgatacccacatttctagttcagaggaaaattatagaattcaacttctggcttcctctaaccctgaacaaatggtttcagcttgtaaaaaccatggagttttagagctgtaagtgatattagagatcttcatttgattaaaaccattcttgtacttttaaatgaaaagttactggttttaaagaagtgaagttatttggatgatctttcagttctgctgcctgacattcaataaagcagaacatctaagtcttactatcaaacagctatcactgtgctgtcaagtacaactttttaaacctgtcaaacagtcattagtcttcccttcttaaaacatctaactttgaagctgtctaaccttttcctgagaaaattcaagcataagttcatttcaagaaaaatttcctagatggataatttcttcctctaaaaatacttctgagaaactacagttggaaccattttaattattacatttctaggaaaaactagttgtgaatcttgctgattagaatgcctctatgttttttagttatatcccccaaataactgtttaaaattgtaattatcatctttctctctcataagggatcaagagcataaaacttgtttggttttatcatgatccataaaagtgtcagctctatatcacttcatgaattaataaatgtccaaagtaccagtaagtttaaaactcatgagaccaatgggctttgttggcatcttttcacttcatagttaataccctcatactgtgatatatggttcttgatgcagaggaaaagggagttaatggtagaaccatgcaatgggtcttaaagtttctgctggatacagcacatatcacttccacttgcatgctattgcccaaagccacagctaacttcagtaagcttggaagtacacccctttcatggggaaagccaccgaggagggccctggataggtgagcccaatagagaagtacagtgaagattttgaaaaaaaaaaaaaaattatactatttcacatagaacactaaagcccatagcacttaagaacctaaaccacatgaccaacttcacaagttgattattaacaaagccatggttggaacatagcctcctaattatcttttcatagatattctgtgtatttgtacttggcctccttttatggatatatgcccatgtgttcctaaatgcaatgccttctcaagtttctatcttagagcccctacctcatcttttgttcagaaagaaactgagtcaaatatttcatcactttaagggtactaatattccaattcatagaccagtaaaggtaatgaggtacacaaatctatttttttttttttttgccatacaacctgatttcccactgtagttttttcaaaaaccgaaaatatcatcacagggagtgaaaacagcctcttgccaaactgcgatctcttcttggaaaacctaatgattacttcctgtctttggtgcctcatcaaacccttaaagtcctggaagtttcatcttactctttttttatttcaatgtagataatactgaaaaataaaaactcaaaaaaaaagcaataagataaaccaagattaaatcaggtaaaataggttgatgtatgaaagataataactgattttgaaatatggagatcctctgtttaaaaaaaaatctgtttacagctaaagtgattgtggattttggcaaaatgtttaattggagcaagacatcttagttgcatttagtctattccctaagcctcactatgagattccacagaaatcacctgctgaaaaagagcacaccgtgctgaagctccaaatagaaggtacttttaatctgcgtgtgagggcaaagatatagccgtgatccttgtaccctgagtacccttcaaaactgagcatctcttaagatggtggatacttcttgggtgaaggctagaaataagaaaagttagagtagttgaaatgtcgtttttataaaaggtgctctttgctcttctgtgaatatcattgaatggctaagaaatgatccacaatgcattaagtaactttcttttgcagcccaaaggaagcccagctgtgaatagcagagcacatctacctctcttgttcttttagccgtgcatgaccaagggtgatgataaatgacatccctggggtatgatgaaatggaacaaaaggcaatggaatatatgaggcctgctctgtttgtgtcagaggctctgtctaaatcaaaagtggtgcagagcatcaaatagcctgtcaagggtctggcagcatggcttctcaaatctatgccagttaaggtttccagagctcccaaatggatttcattatcttgggaaagaggtgtgaaagcagaaagtctgggccactgagagggaaccatgctacagtgagtaaaagagaatgttaataatcacttcagtgaaccaagcagctgcaatatgactgcacaccatcactacagttccgggtgttgtttatgggaaaacataataaatgactgcttatggacacccacagatatattgaacattttgaggttaacattggctaagttctaaatgccatccttgtaagtagctttttcaagtggaaacaactatttttcaaggcaagccataaaaacatgtgaaaccaacagcatatttatatgctcttataatatagaagcggtcaatctgattgaacctaaattttatttttacaaataaaatgtatttttgaattatgatttatatcgtatgaaacattttatgtgacagtgagctggcccagaaccctactaaaaatatctgttttcagggattcatgtttataatttatttcttatattcgcttctttatgcttagttctttaaaagaagataatttgctttgaaagtatttcagtattggaggaatccatgggtagcagcaaagagaatccaaagggttaaatttctctaacatatatttgatatttggaattttacaattgcagaatactttgatggattctgttttatttgtcacagaaaaatgtcatgtaaacctcctatagataaaagtcagttatagtttttttggaaaacaaacatttttatggttaaaaattgccttagggtagaagagtaaaaggtattctctcagttttgaccagaaaaacttttaatgcataacagcactctgcacttaataggccttctcgattttttaaaaaagaattgatcaagaagacttatcagacaaaatgatctagataaaagatcccaaatgccattactactggtgtctgaatcacagagtgaaagcactgaccttctgctgcaggtgctattttttaagtctccattgagtttcagtttgaaggacaaaattatcatagagataggaaggataatattgtactcatttacactagaggaaagagaagaaatttaagttgctctgatcaagctctatgcataaggctgtgtcaatagacacaacatgaggtagatccagttgaatgctaatccttccactttaaaaaggttacaagtatgttagcttcacggcttccattaaagccaatgggagttgtaccattaccatgctttggaaagaatgccctctaatgctattgattttgatcttttgaactcaagctctgatacctgtgttcgttgacaactactctgcctattgcgtacacaattctgtgctactgaagtactggattagcaagtcagctccttttttcaaattaatcagcttgtctgagacaaatgtttttatcttaatactcttagaaatgccacatatcaagcttatttcccatagttagagcatatagttcaaaagtgccactgatgggttttgtggaagtaaatgaaaggcccagcccaggaagaggaggccattgtgatatggtcagatttttactgtaggaagtgcattgtgtctgaagagtgccttatatgattaggaaatgtgtaccagcagggcaagacatgaaaccaagagactagtaagaagtctgctgaacatatccaggctgtagaaaatgcaaataatggactagggtataaacaacaaatatgtaggaaaaatgaagaaattccagtgattcctgggttgtagaatttacatgagccaggcttcttaagcaaatgagtgagaagggtgtcattagcaatcatccactgggaatttgtgggctatatagcaaactggagagcctaaccaatgtccagtaacttaggtccaaccatttatttccaagctgtcagtctttttcttttcttttttaagtgtacacttggatattgatgttaatctccccaatttttagatattataatcattgtgtaggcatcacaggacatatctgaaggctaaatctgtccattagctaccctttcgggctccctacatttttccctagcacatgattaggactcaataaatctaaatgtatgttggatggattaatgaataaattaatgaagggaatatagtggccttaaggttttacatggcctcaattggtttgtaattttaaacagagcttctatcagtccagtccatgcttcctactaactgcatttgagagaaaaattcctatttgtaagtgtgaagactaactcatcttatagcattttttacatgaaagtcccatttgtattttgtatttaaaattttttattcgggttcatttatccagttttttatttggaacaagtataaacgatgattatttaacagctagttcttttgaaaataactttcctttataatctgttataaatcatgtttggaaggactttgagaattgaaacaaaggcataggtaaaatgagtgtcgtgcatcagaaataaatgcaaattgtggatggggggacaaaaaaagagatggaaagacaaaatacttgaaggggaaagaaacgaaaaagctaaggaaaagaccagcaactatgaacgtgaatacttggttttattttacttttttcttttgttctttgttctacttttaactttctactttggaaactcaggaattgttgatccagatttctttttctaatgtatgcatttgaggtcaaacagtatacttgtatgttcttctttacctttctcacccacattctggaatgtagaactttcgttttccacaagtagcatgagaacaaacccccttgcatccccactatgtccaccatgaccttatctgcaataattgtttgctgctgaagatatttgatctaaaacctggccacctaaacagaatctccaaataccatcacatctcattaaaagatctcacctaatgacaaaaaacacagtcataagagcacatgaagattacacagcctcatgctttgcaaccagaatttatagagcatttataatatgtgctacattatttcacttgcataattcaattagcacaacaaagctgttaggagatattatccccattatacagaagaagagaaaaaaacataaaaacaaaatgagtagcccaaagccatacagcttttattcacaagatcttataacttcatgcatcctagtattttccctgttccctgctactgaaaatgattctgtatggtaacatgccatgtctgtttttaaagtaaaatcatcaaagtatatatattctcatatttctactgtcatttgaaatggttttgttgatattcagctttgatactaatatagtattccttaaattcctgcatttctattttcatcatatacatttagttaacaagtttcagttctctttggaaaaataaatcaagaattacttgcttcacctatcaggagcccatgtaattaaaattaaggaattacttccttaatttaactctttttctttgtctatatgtcagttcaaaatgattaaagttacaaaatagtagaacatttgattaactaagctgcctcagaatttactattcctcatggagctgctccacaaattagagtttttgcagttcagtttgccttctgttatatgtaaatagggtgaccatataatttattacccaaactgatacactgagagttaaagggacaagaaagtgggaaatagggctaaccagactgtcccgggaaaacccagatgtgtagtcaccctagattgaagtcacgttagaccaaataaatatggtcatttgcctttacctgagctgaaaagaactgtcaatccaagatagttctcagcaaggttggtctcaggacatgaaatgtcacaaaactgtaacttcaaggggttttgtcatcttctcaagactgtctcagctatttgggttttgctgccatcagagaacagcaatgtcacaattatagctttgagagtataaaaggacacagttttctttgagaatcaagaagatattaatagctttctcccggagggctagacaggagcaaagtattaagcagtgtttcttgaagctctcatagcggaggatgactgtgtgattgtcaacctctaacacatacccactgagttagaaactcctggacaaggcctacaaacacgaaatttcaaccaaatccataagtgaatcatatacacactacattttaaattttacccactgatttaaattaaataggaatactaaaataatgtgatataattgctaactgctcccttccttatttgctccctttccttagcttatttgctattttaataggtgtcaaaaacatctgctaatttatgttttatctacatatttgggttgacttaaagcattttcagggttttaaaaattatttctttcccagtgtctctgtctctctccctcacatcttttctattctccttttacttctttttgtgtcttcttcctcacctcatcagaatagatgaatttattagatctttctctctatgcttgataattcttcctcattatctccaccagaaaaaataaaaaatgtatttttaataaatattaatatttaataaaattaataaaatggaaaatggaaaagtgacaatacaaaatccgttccctcaattaaaaggtacttctctagcattttacctatttgagtggagcaatgaaatccacgctcccagttactttattctttgcatgtaatgctgtaggaaatctgttggttacagatttgtaagctctaggctcagtggccttaccacctggctttgacattattccctacaacaaagcatcgtaagacttgagggcaagatctctgctgattcattgctccatcccaaatagctcctggcagaatgtcttgtacaggaaagacacccattaatatttgtcaaataaatgaacagaggaaaagaaaaacccgggcttcctctaaacttgtcacactaagctcatgattgaatcaaacacataaagaaaccctttcatgatataaatgagaatactaacccctgctctgtgtggctttgtaacaatatttttaacaactaagttcaatcttttgtcagtgttatgactctgaaaattaaagaaaatgttttgtagaaacaaataattagaaatattgccaggaaacttctgtactggttgttgttacttttattcgctgggtctgtgagaaggttggtggtatagagagagttgtaagaggcatgattaacaagggcttattgagcccttactgtttgcataggcactattttcaaacggtgtagcaaatataaaagatacaaagtatatgacattttcttcctctgtagcatgcaagcttggtggaagacaagattcggagcacaattagagaacaatatgagactatgtacaatgaagtggtaaattgaatataattaagcacattttccataattccaaactgaaaaagtcagaggggaaaagaccgatgttggttgccagtataataaaatatgtcaaaattaacagaagatggaatacatagaatttcaaattctattgtgatgaatattatggggtatctccgcagtatatgtttacttcaagttttcctacataaaataatgagaaaatgtaattttatgtcagaatttcccatcgtagatgatcttgaagaactctcattttataaatttaggacaggctgccatggctacctaaaaggaggacaaaactttgtattatgcaaaataatttcctttaaagatatctgtgtttgctgacaatgtttgtactgtatctgtcccttcagtttacagatattagggagcagggggacagtctttttagtggaattactatagcagagagcgcaaggccacctgtgcctccaatggttttgtttctgtgcaatgttcttaaagttgacatattttcctcagtttaactcctttgggatataaaggcatttgaaagataagggtttggactttaggaaagactttaaaagtaaagatctgaagttgaggttggtgccattttttgtcacttacactttatatgaattttaaatttcaatttggcctcattttaaatcctctcaaagtgatagtacctctcctcacctctcacaattctgtattcataaatattctattatttcttggaaatatcttgatctcagagaaaaaaaaaatagcatcccagggctgacttttctcaggagacttctccttttttttgcttttttcaaatttcatgtcaaccacatttttttcccaaaggagaatgtctttttacagagagaaagagtagaagtgaatggttgaataagtttacaatcacacctctatctgctcattgcacttatttagtaatatctcagtgctatagtctttaatagtatatatatttttaaaatacaattggtaaaggagttttgctttgaagtattaaaaacatcacaacatttatctgcaacttcttttattgtacatccattagaaatatccaaatgaaagataatttttaattgaagaaaattacaatttcacaatttctagtatttaatgtaagtgataaatggagaataataataatagaaatgatatatgcattaaaaatactttattgatgaaatcactgcaattaggaaaagtaaaaggaaagagaacaggatgacagtctatcttcattaagtagcatctatactgatgcatcggtttagtaaatgagtgaacttgtcatctggatcactctgttcacatcatcagcccattcttgctccttccaaagaaggggttagaatccatgtttataattttgaattaaatttcaagaaaggaccacaattaaacagaacaacagttggttcacataaataggagattaataactttctaagcagatggctcagtaaggtcattcatcaatgtgagtaaagatgaactgtcagcaatgaagagaattgaaaatatggagtggatagtttagtttgttggacatggagttgttgctggaaaacaaattcaaggaaatctagaaggagaaataaacttggaatgctataaatacctattgtcaaacttagaatttatactggttttggaataatttaatcagtctctgtaaagacactagacttcaaagctcattttaaatactaataaagtgtgatttaactatatattatttaaagaaatattttagacaaattaaatttagtgagagtttatttgagcaataaactcttcatggattgggcagcatcagaaccagaagaggttcagagagctccacccagaagtgtgagcagtgagctttaacaggccaaacatagaagcaaagcaggaaagtaatctgattggctacagctaggtgtctgccttatttgggcatgatacaatgagttgtttgcctgctattggggctgttcactcctaaattagatttcaatttgtttacctactgttaggttgcagttcattgtgtcaaaactcaaaatatagagatagtctcaagctaatggcctattgcttatttaacaatatctatgatattcaccttatcattgcccctactgtattgcaaaacttatccatcttcgttatacacacacacaaacatatatatatgtgtgtgtttatatatgaatatatatgcatatatataaactgttcacaacttacaatggttcaacctatgattttttacctttacaatggtacaaaaatgatatgtattcagtagaaactgtactttgaatacccatacaaccattctatctttcactttcaatatagtattccgtaaattatataagacatttctttattacaatataggctttttgttagatgattttgcccaactgtaggtgaatgtaagtgttctgagcatgtttaaggtaggctacgctaagctatgatgttaggtatgttaggtatatcgaatgcattttcaacttaaatactttcaacttatgataggtttattgagctataaccccatcataagttgaaaagtgtctgtacaaagatagatttattgatagatacatatatcttgctcacaaaccgaagccaaaaagaactagcagtgatgacatccatgttttcataccaaatgaaccaaactttttggctttaccattgtctcttacccatgttgtttgtttttcttctaccattaatctgtatgctcttttagggtaaagaatactttttactcatggtgactccctctgcctccagcactttccatgttatcaatgcagaccgggcactccataagtgtttcataaattgaactgaattgtcttccttatcatccccttcaacaagatagaggtagtaaatggcaatatatttggagggagggaggtataactatctaaagcctcaaaagcaacaaaggacaataattcaaatatctgctagatcaggctacatggtcatgaggtgggacactggtgaagtgaagggagtgtgccctccctacagcagtgctgtggccactcaaatccaataatttcctgcagaacatgagccaaatctctatcttgtcaaatcttccaagttttaagaagctagaaactcaaatattgatgtggaaacttctgattttataatgctggcaaacgattggaagtatttttttaaacactgcacctgacaaataaaatatttctgtgggtcacatccctggagctcacaattttcgacctcactcggggcaacagaaaagctgaccaagaaggtcaagatgttaattaggcagctctgttgaccacaggcagatgcctgtggactataattctccacctcaatgtcacttggctacagggtggtagtgttaatgacattcgaggtaggcaatatatgtatccatgaaggtttgtcaatctgcggtgtatacacataatggctgaaaatcagctgtctcttatttgttgcggtttgtttggtgagactctgtgggagtatttgtggcttaagagcttggaaacctcagtgtccatgaacataggaattgttcagggaggagatgtaacaggtgaggcaagaaaccagaatgccacctttaatttcagttgttgtctggaatgcaaacaatgctcctagttacctgaccaatatttcccctcaatgtaaatgatttggtgaaaaatgatactctttctcacagccccaagaggaggttaaaatcctcttacagccttatttgaaaagtaaaatttcaaaagaaaaggaaagaaagacagccaaagcaatcattataaagcttgaggctaaagtcagttttactttattttttcatcactcaccctggaattgtttgataggatggtttgaaagaattcgggatgaagtgtagcatctccaaatgttagaaaatgtatactagaatatttataaatcttgttccattttacgcaccctagatgtcacgatatatgggaaatttaaaaaagtatcagaaaaactcggcatgggggatgagagtaacgagtgaagatgatgaacatgtgtctgatcgatgtgtctcccactctgtcctccacctgcctctcacctcctcccctgcctctcccactagcttgcccccctccggaagccccacacatttttttttcacttttacatgaacgcaacatgccacttttgaactcacagacttcacatctacctggaaattctgttctttttctttcaaaattcatctccaaaaggtaccgtaaatagacagagtggggtagtgatagagagctacgacgccggggccagactgcctgaatttgctctctattgtcatctcttttctagctgtgtaagcttgtgtctcctttcctttgtctttgcaatagagacaataatagtaatctaccttaaaaacgaggtttgatgtttaaatgaattagtaaatatacagttcattggagagttgtaactatatagtaaacacagtgtagtgttaattattttattatcactcacgacctcctcctctgtgaagtcatacctgagctggaggctaaagaagtgtcatggcaccttcaagcacctactctgtaaaacattctgctacatttgacttttattcacaaatgcttatgacaatgtattataattattgattgataggatatgtaatattgtatctacttacatatacatctaagctgtaggctactcaggggcacaaacaagatcacattattttgattatatggtattatctagaacttatcccagtacttaacacataaccgtcagtcaaaatatgtcaatttcctgaatgaataaggatgtgcatgggagtttatcctagtactatttcatgacttgtatctggattaaatatgcattggaaaaagtactgtatttttgtgcttttgacttaatatttgtcatagcaaagggagaactaatatctttttcagagtgatactgtctatgctggttaatatattaatttatgctaccacttctctctgcttacattagtaaagcctgactctctcaattttaaatacagaattatcatacactttgctagacacgcttcatatttctgggtttgacactagttttctggagtacaagagtgtcattatgtccttatgtctcaaatgcaatcttgccccatctggattcatgttagaagaggaagcagataacaacttttcctacttcacacctgtgagatcagtaaatttgaccacagattagaaattttaaaatgaataaaattttaagtggcacttctgatgcagtgtattttatgacttttttttaaagaaatgtacttgaccaccaatatattatttataattcaaaaaatctgactcagaacaagttctattgtaaccttatgcatcatcattatcctattctagtaagtataagggatagaatttccttaccgctactgaatgcttgacttcaatctaaaacactcttaatttgcattaaattaaaggccacttagaaaaatttagagaacacttttttgtgtgtgcagaaaacattaatcaagcagttttcctctgacttttttaactggaaatagctcatttaaatattatccaaactctacttcttttaaaataattttttcttagtattttattactggtattagtgtagtcatcttctttagtgatgttaaagcatcagggttaaagggctagaaatttagcttaagacataaattaaaggtgtgggaattatttactttggagaagaaagagattaagaaaataaatgttattaaaacaaaataaaaggtaaacgccattttattttgtttgtttgtttgtttgtttatattactttaagttctgggatacgtgtgtagaatgtgcaggtttgttacataggtatacatgtgccatggtggtttgctgtacctgtcaacccatcatctaagttttaagccctgcatgcattaagtatttgtcctaatgctctcccttcgcttgcccccacctcccgacaggccctggtgtgtaatgttcccctccctctgtccatgtgttctcgttgctcaactcccacttatgagtgaaaacatgcagtgtttggttttctgttcctgtggtaaacaccactttaaattatagacagatttggtggattagaataaaatagttgttactgtgtgtgtgtgtttgtgtaagaaaagaggtaagtgtttactagaagatattagatgatcccctagatgtttataatataaggagtctttgctaagatcgcttaagtgtgactccgccttgaggtatacatgtcggctagaccagacctgccactaggactcaagctggggagaattttgagcactttgttgtcagcaccatttagaagacaattttttttatcagctttatattctacaatatgtgtagacatcactgaatttcaatctcatttgcagctgaataaacaaacggtaggtatttccagttttttttaagccctcttacttagaattaccactcattctcatatactaagattatatcatttatgtttttaaataaatatccaacccctccccagactatataggtattttgggctgattatataatattatataatatatgctgagtttttatttgaatcactctatgtttttggaatagaaaaaaatcttaaatacaggaacagagtttttatgtgaaaactgctagggggaaaaaaaaataaaaactgctagggggaaaaaaagcaaaaacagttgctttgcattaataaaaacataaagcctccttttttattatttgtgatacagcaccaatttatcttacataaattaaactcatataactaatagtaatataggctagcttgcattaattttttatatgcattgcactatggtagaagtatttaaaaaagagaaatattcaaagatggagttactagcctgaagaatacaggggaactctatgtggagatctaattcttgaagtcttatacctgtaaggtggcagaaaataggggaggctgaaagtcagtgaaccccaacttcagtttccacaatgtacaacttacatattgtatggctcaaaaatctctggagcagcactttctttgcctataaaatgaaactattgaatcaaatgatccctaaggtcacttctaagctttatgaatatatagattaaaacttagaaataagaatcctaggaaagatataatcacaatacccaaaactaagtagaaatcttaaagagcaaatagtttcaaatcatttccaactatgtatccttatatgatatatgatgattactgatgtggttattatctattatttgcatgagagagtttggaggaacatctgacattggggaacaccaactctgaaaataagggaaataagatagtcttttgggaattacactgttaaactgacatgctcaagagccaagaaatacaaagtcaactaaaagagagcaagtgactctcatgccagcaggactagaatgtcactttttgaatgtttcaatatacccaaagcatgaacgtgttgaacagtagtggaattaatcagccttggaagaatagaaaaagaagagtttgtgcacaaatgatagcagagctcttgcaagcagagtccaatgggaagtgaggctgagtgatttaggtatttccatatcaatagcaagaccactgtgagctgaatacatcaggttatcttaccctgatgctattagacagtccattcattcaactccccttgttctgacttcctgctcaccaagctaccttccgaccataatctagcctttcatgcatgtcttcctactgagagaaagtacactgaggatatccactttgaataaatatctcctgttcctaaagcagtgattttttgtggagaatcaatatgggtttctgattatgatttggcttcccatgtgctggatcacagggaagagattgtgccagtgtgactattctaatctagatattgtttcttatggtaaattaataaatacatgccctagtctcatatgccatttagaacataaatcagcacttagggcaggaaaaagccatggatgccaagaaatgtctggtccttcaaagcagagggtcaaatttacagatggggcagttaataaaagcgctacctagtgagttcttaccttcatcaagctaacctttccttacatgacactctattcctcaacctataataaatattcaatttctttttttcattcccacatgaatgcaagattcagaaaggcaaaggcttggttgccttcatcactctttgtctagtgcttagtaccctgcctgaaacctagaagatgccattaaatatatgtggaataatgaagcttattcacactagctaccatttcagtctttcaacttcattgctatagtaattttaagcaagtaaccacaattcacattccagtaaaatgatcaggtcatttcagcctgagtaccttaattctcaaatcctacacctcaagaattcattgaattatgattttccctaccaaattttttctcctctcttatttttaaaaatgaatcatctgactgggcacggtggctcatgcctgtaatcccagcactttgggaggccaagaagggtggataacttgaggtcaggagttcgagaccagcctggccaacatggtgaagccccatctctactaaaaatacaaaaattagcctggcgtggtggcacgtgcctgtaatcctagctactggggtggctgaggcacgagaattgcttgaacctgggagatggaggttgcagtgaggcgagatggtgccactgcactccagcctgggcaacagagcgagactctgtctcgaaaaaaattaatcatccacccatatcctttgtcatatctctatttttccttagtcaaccatttttctttatatcttaaatctcttagtctctatagaactttctccttagtttacatgctcaagtatcttgtaaactcacaaaataattccctgcatgtgaatattattttaatcccttctctcttttccaaagccttcaatctctgaaacacagctcttccccaaggctggatggttgtctttattcactcctcactctactctttcctttaatgaagatgttggtcccaaagacccccccaatttcttctctggcccctccattcctcctgaagtcagatttgcatttctaacagcctcctgaaaatctgagagtatgtcacagagatatagctcagaacctcacatatagcgtgtccacagctgccttctttcaaaaactgctcttcgtttcattccctaatttggtaaagaataacatcattttatcatttgcttagtttagaaaatgtgaagattttccctttttacaaagcaccttgaagtcagggcctctatcacactcacagttgtttacggtgctgaacagtgtcttcggtccatcttcaattgattgaattgattaaaagaattgttttaaaattccatttcatttatctgttggatttctgccttctactccttcgcactaatttctatacttgtttctgcctatatatgtatttgttacttttcacagtctgtcatgtatcacgtcacataaaacgttatcttacatccataaagatccattgcccatatatccccctttataaaatagataccatgtgtattttagttacacatgttacaagcctcaaaacacaattttaaaatttgacttaaaaatcataaactatttagaaaaatttcagctactgagcaaagcgcaatatttgatttgtagtttgatgccaacaaagttaattgtgtactaaaactaacaagcaaatttaaaaaatactcttcagaatacgataacagaatcctgagtctctacaatataaaaatgacaatatcaaggtaaagtccttaataaatgcacatacaaagatttcggaaaatatgactcattcttaacagaaaaacaagcaaccaaaatcagtcctgtagtaactcacattttggaactagcatacaggattttaaagcagttcttataaacatgcttaatgatgggaatgaaaatatgctcagaataaaataaaagatataaaattttagccattatttcttcaaatattttttctgaccctttctgtctttcctcttcttttgggattgcaattacatagatattacaccttttgatattgtcctacagattcctgaaataatggtcatttttatattttaattatttctgttcagattgaatgctttgcattagtctcttttcatgttcaatgacttgtttctctgccatcttcaatctgctattgtgttcagtaattttttttggatattacggttgtagttccagaattttaatttctcttatagtttctactactctgctaaaattttctaaatatgccacatacacagtagctcaaatccccatttgtttttttaattcttaattctgctgcttagagttttttctgtgcatgtgggtataatttggggatatttctctatagctgtctcctttttcttttgtattcttcccttacttctcaacacctgtagtttccccaaactctatcctcttcttctggctggaaactctgcatgttttatacactacatgcagcattcccttcttgtaagtgtcatctcctccactttctgcctgtgtttgttccctgttcaatgccttcaggctttttgcatttcacctaaagtttatagttgttatttgcaggaagtgttggtctggcagtagctcacttggccatatgagaagctgaaatctattgataattttttaatttaaagtattttatactacttttgttttgttcttattatttttttcttttttctttttcttttctttcttttttttttttttttttttttttttttttttttttttttttttttttttttttgtgagctctgtcacccaccctggagtgcagtggtgcgatctcggctcactgaaagctccgcctcccaggttcacgccattctcctgcctcagcctcccgagtagctgggactacagccgcccgccaccacgcccggctaattttttgtatttttagtagagacggggtttcaccctgttagccaggatggtcttgatctcctgacctcgtgatctacccgcctcggcctcccaaatgttcttattatttctataatatattctctgctgccatctttctgggtaaaacttttcttactccatgttgaaatttattgaagccccttgcttgccatcccgcatagcactgatagtgctatgcatacatagctctgtatcttgacatatgcgtggttatcctatttcctaaagattgtataaaagaatgactccagtcatgatatgcccttcctcagaagtgttcaacagctctctgcttcctaaacaataaagtcccagaaatgtgttataatggaagaagacagcctttggagccaggttagtttgagttcaagatctgtcactgaccagctttataaacttaggcaagatgtttatctgaatattagttttattatttgttaaatagggagaataatatctgtctcaaagaatcattgtaagaattgatagataagttacaaatagttgctcttttagggcttagtacttagtgctcagcaactggtagctgttttaaaataagggacataaaaacaacagctctttctccgagattcaaagtcttccttcatctggttccaaatcagttttctatctattctcgcatttttcttattcatcaacaccattcaaatcacactgttctctaaaacccatgcatgtctcatgcttgcccatgacaatggccttgctcaaatcattctttctttttcttgtttctgcttgatgaatttctaaatattcctcaaggaccagcttaaatagcatatccacaaagaatccttctatgatcttccttccttgtaaaattctttagcaaagttttacctgtttatgcatctatcaggttccagctcatattatggtatttcctaggcatacattagctgccttatttgctgaattatcagctccttcagtgcaaggactcactcatatccaatatgcttgctgtatgaatggacaaatacactgcttataaaaatcgtgactgggattatgaattctaaaaccttactgtggtcagacaaatagttactaccatagctctctatgatttgagtattacgtattagaagcattgtatagaggtaacatattaattaaaattagtttgataaaatattatttttttcatttttataactaggaataattcaaataaccagttgaatctagaccgtcaaagatagaattctaagggatacctgggcttgcttaaggaacagtttaatttagacagctttggagtgagaaaggcaggtgaagcaattgttttttgcagttgcacaaatgaatacaaaagcgatattttattcaaaaataaacgctctgtttaatacaatgcaatttctgtgcaaatttataatagcaatagcaactgttctaaaatcactaattctataataatttttagttaaccactctggtagtaagcttatttataccttattttgaattacttgaataaagaacaaattctggctgggcgtggtggctcacacctgtaatcccagcactttgggaggctgagccgggtggatcacctgaggtcaggagttcaagaccagcctggccaaaagggtgaaaccccatctctactaaaaatacagaaattagctgggcatggtggtgggtgcctgtaatcccacttactcaggaggctgaggcaggagaatcgcttgaaccagggaggcggaggttgcagtgagccaagattgtgccattgtactgcaacctaggtgacaagagtgaaactctgtctcaaaaataaataaataaataaataaaaattctgttttgcatttttctacaaatgactttcttacattcatatttagatacctgaaagttcctgctagtatagtttgctttgtaaggttgttctccaaatgaaaagagccattacatctaaaatcctcttaatgatggacctaaattttgaatggaacaatatatgctacagttctaaaagacaaagatatttagcaggagaaacttaccggcaatgagaaccatattcatagattattttaatgcctttatgagtgagatgaaaaatagttaatggaaagatagttttgagattgtggcatgtcaagaaggtatctcattaaatatggaaggaggcagacataaaagaggttcatatgttatattcacaaaccatttcttctcaatagtttgttttggcattattaacatgataatcctcttctgggccaggtgtttctgtgtaaatgagttttttatataagacaccagtttcctttggatgaatttaaaataagacactaaatctaaggtttccacaaaattgaaaaaaaaaatcactctcctcccaaaagttcctggaaacatttccacattaatcatcatatttaaggaagagaattacattacataattagaacatgaagaccaaattattttcaatttgtttcattacctaagaatcaaagagacataataggtatgtgatttcagggggaaaaaatgcatttccttagctttgcaaagatgctcagcctatgtcatggaagcatgatagttaaaatggaaaaggaagttttctattaaatatttttctatgatccttggaggccaataggattacttggagccggtaggtaaaggaatggctttcactaattctgagagatatcacattcctaagtctcaaatatatttgttgaaaaactataaaataataaaatattttattttaacagatggcctctgaaacaaatttaatagatattaaagcattcagtcctttgacctggcaatttcatttcacttgaagaaaaaacaaaagttataaaacaagtatttgtgctcagaaactagaatacttacatgtttgtaaagtcctgcccttttacagagcccagttctctgaaaagccactactctggtgatgacagcatcatagagatgctaagatcatgacaaatgatttggctaggggaacaaggaatctttgaattataccttctacacttgccatataaaaataattagtaatgtaatcattacaaaaatatgtaatgattatcagtgtctcctatttccttttagatgaaaaactatctttctgttagaactagaaatcagtgtgacatcactgaagaacacatggctatggagttagacttgattttaaattttagctctgccgcttatttgcaatgtagccttacatttcttaatatctttgtgccatgggttcctcacctgcttgttgtgaggattaaataagacagtgcctggtacctatcaggtactcaaatacaacatgttaaattagtaaattatgttttaaagctacctggctcattatagatgcctgtaaatatcagagtcctttccctttgatgtaactgacatagaacagaaacagatgcacagttccatagacccagatgatttctgtagctttctgatttttctctggtccatgaggtgtgctttttagataagtattacttctttagtgtttattgcaccatctttactcttcaaatgatgcaggcaaaattcacatacagggtaatcttatttttccaaaaattctaacatacttgtatttttattttggtttacaaacctcatctatgcaagtaatcatagtttatgtattgtgtatgatttttagacaaaacatttgctccattttacaaatgagaaaaactgaagctcacacgatgaacacagctattcaatggcaaggacttcttttatgactctagatacaatgctaacttcaaccatatgctaacttcaaattcccactgttttaggaattaccagagattgtcagaagtggctttcattgttatatgattgtagagtatgagacccaataaatccattacacacaatttaacattggctattaatgtaacactagtacctttcataagctaaggttagggtttaaagattacactgtccgttggcctgtctcatatggaacactaagctttttaacagtgtgtatggtcaggataaatttattagttcctaataaaataacaagctcaaaagcttggaggggttttcacagagtaagaataaatgagcacagcctacccaagctaaaaagatattctcttaactcctgctaaagaaaacttgcaacaatttgccagagggaacaaaaacaagattagaaactgtctccacagaagtagtaaacttcaaaatcttgacacaataaataggcaatacttagggttgctatttaaagtaaaagttgcttttttctctctcactcactacaaatcctgtttgtgtgttagtcctaaacagtgattctcagctttggctgcacattggaatcacctggggacctttaagaacgtagcgaggcctgagtctcattcccagagattctgactcaattggtaaggaatactactgggcagcagcagtttaacaaagctgtttaggtaattctaacatgtatccaaggtagaaaaaccactactctaaggcaatttatttgggactacgctgatggaatttcagcttcataggatactaatatttataaagtatacactgcatttctggaattatactaagtgccttccgtagtgtatcaagacactttgggttaactgtcttggacaaaatgtaatttattgactcttgtaactaaaaagtctgggggatacagcacagctgaattcagtctttcttctctcctactcttggtttcaacattgcctccattctaagactaggtgtcttttcagagtcagaaaataagtcagcaactccagaccctacattctcctcacattcaaatccataaaaggagagctagggtttctttctcagactctggccaaaagtgtcatgtggctctgctcaggtcagagactgtctgtgatccctgagctgggctgaagctgtcatttgtccccaggcctgtccaattacagggtccatgcaccttttaacgcctccaaggaaagattaccagtttgattggaagaaaatgtttctctcccaatagagaatttgacaaatttaactatctctaaataagagttttcttacctttgaaaatctctcccaactctgcagctggaggcacttcctttcctcactgctttggatctagttgtccttccctccccttgcaatacaaccagttttctccaaggcaggccaggcctgtgtcccaggctgggaatctcagtgacaaaaatctatatattccttggttctgaatgtgaataattaatctcacatttaagttttataatgcctaattttctgtgcctgctataacaaattaccatgcactttgtggcttaaaaggacataaactttttctctcacaattctagaggtcagaagttcaaaccaaggtatgtgcagaggcatgatccctctaggactttagggaagaatccttccttgcttcttctagctttgatggctccaagaattcctttagtcttggcacagttccgatctctgcctccatctttgcatggctttctctttgtgtcttctcttcttccggtttttataagaatacttaccactggatgcagaccctatgtgaaaaattcagtgggagagttccctcacaggatatgcgacaggggtgtgactcacctattcatctgcttgcctcagctgctcaaactccttgtaggaggtgcagagaccaggtcaagtgctttggtctccatccccgtagtagtgtctaggggtggatgcctgcagccccagtgttacaatgctctcttagccttgctgtcagcagacagctttaagagttaactagctcagtgggcactctgcctttttgcaagggcagagggccagtgtgacagctttctgtatcccaagttactgcccagcgtctgggaagaattggatcacattcgggcttaaaggatgaatgcgagatattattgagtagtagaggtggctctcagcagggtggatggggagctggaaggggagatggagtgggaaggtggtcttcccccggagttgagccatccagcagccaaactcctctccgacaacccccagctgaaattctatcagcattcagatgtttctcctcttctctctttctctgccgcatcgctctgctgttcatctgcttatctcatctcctcatctgctggcctgctctggagcctggagttcagggtttatatgggtacaggatagggggtgtggtggaccaaaaggcaactttttggtgtgaaaacaggaatgcctgtactcattttgggccacaggtatccaggcttgaggatggggcttttgccgggtaactgccctcttctacccagcatttccctgcctcctgtctgtatcaatctcaccttgagatccttaacttaattacatatgcaaagacccttttttctaagtaaaatcacattcacgggttctgggattcaattatggagataattggggaggcatcattcaacccactgtaatactcattgccctttagtttctgaccattttatcttaaatatattttaagtgatatcattcacctcagaactattctttgactcatcacatgtatgatggggctgcaaaggaaagaccacagtggacatttcatttgtaaagaaaaggaatactaaattatgagagcaggaaactctctatgcatgtgtggcttatcagtagaaaactaaaattaatttcttagggcacaacacctagtattgaacttaaaaatgtaagtatgaaaataaacagaaaagaaaaggcatagttccacagatcttaaagttgtagggaaagatgaccatttgtaataacaagtacagttagttgtagaaaatttgaagatgcaagcatagtatgaaattgtattaaaactctaaattcaagtgacagaaacccaactcaagctttgttaagaacatagcttggttcatgctctggaaagtctaaggaggtgtgttaaattcaggatcagcagaattcaaggatataaacaatgtgcaaccatcaggaatttggtttttcttttcttccttgtcttcctggtttgttttccatgggtactgtttcacgcccagacatgcttcctgatgtagaaggagagatggcagtagatctttgcaggttttcctggcctttggtacattcagtctcaaaaacacagacactcttttctgagattcatttcagtccccagaaatggatcttgactggccctacttgaaatagatcttttcccttttacaaatctctgtgtctaggggaagaatgtactgtgattggttagcttgacatcatgtggaaagatagctcctaagacaaaagtagtattcctgttattagaagaaagaaatggagacaccagacaggtaacaactcatgcccacttacatgctcttaagaaggaagagcttcctgggacccttatgttaagtaaagacatcagtctaagggatcagaagtaatcagtcagcatgcttgcatatagcgaatcccagatgctgaagaaaggaagagaaatgggagggcattttgcttgaataatgatctctgtgaggccaataggatatgagtgcattatttgtccactctagaagaataagagcataaaaaggaacactggggtaagatctgggagattgggaacctccatcaggttctgctatttaccagccaatattacaacttctgagaccctttgtggctttaaggccctaaggattacaccaattaaagtgatggagcatgagttcagttgtaatgtttaaataccagttttcttatgctgtcatgaggtggtgggacagtttgaagtgaaagtatgtgaatttaacaaaagatatcatagataaacatttatttttcaaaatcctaaatgtaaggaagccttccaaattatgaccagaatatgatttattttctgcaccttccccaaaagcaggaaacagaattacactttttaggataagactcttaattctggcaacatgttgttctcaagaagtttaagaacaagattaaatactctaacacaagtctatttgtggtttgtgtttgtcttgaattagagtatgtacctgttaaaattattagaagtttgaatctgaaaaatatcgcttgagcaaatggttataagttatttaaataaaaaataaaatgcatcattgtgttttctcactggttcttttaaatagactaaagtgtctcattttttcttgctaaatttatccaactttctaatcttctagctttagcaaatctagctttcctgcatttatttagttctatactaagataattaaatatttaagctgcatcattcatatatctaaaatactaagtaggaagaacaagtcattttcttgaacatcctcctcaatattgatctgtgtttgccccctgtcttcctgacactagagttttcttcattccatttaagcacttaattacaataattatcaaagaaagaatatgaacataaattgtgaagtgatagttgagtataatttcctttttccctgggacatattttctctacaaaaaaaacaaaaatcttactttcaaacgacataggcagctgtggtatgggaggcttgattacatgtcagtttcttaaataaagtgtctctcactgccacagcaggggagccaggtacccagaggagatgccgctcttcacttatgctgtgactctactgaccagggcaggacaatgcgagagcttatgattcaaaggtgggaaatcatagtcctttgtttcatttttatctggggaaagtcagttgcttaaaatgagagcaggtgggatatagcaattagtatgataataataatagggttagataaaaaccagtggtgcagcaagagtatttttcaaactcttaaatagcttatcttacttcactttttacaatgtaaaaagttattatgaaaggaggagagaagttattttcatgagcacctactttgtgctgaagatgctttatttatttatttatttatttatttattttttggtcttttacagaaaatcttcaaagtgctatgtacattttaaagagaacagtatggttaaataactgggctaaggtcacaaagttagaagtcatcaaatgccagagtcaaacagtgtgtttcgttccaaagcttctactctttctcctctaacaaacaaacatattgtgttcctttaaaaaaattatgaccagtttttgtttttttaaaaattttattattattatactttaagttttagggtacatgtgcacaatatgcaggtttgttacatatgtatacatgtgccatgttggtgtgctgcacccattaactcgtcatttagcattaggtatatctcctaatgctatccctccccactccccacaccccacaacagtccccagggtgaccagttttaatgtatttgtatcaccactttaaaatagaaaactgaatctttctttgcttcttgtatcagtatctaaggaggaagtaattgccatggtctgaacttagtggaaatatagtaagtggggtaaatcaaaggtgaggggccagattcccaaagtcctattcaaacagctttttcctgcatttgtggagtgttgggatcagctttgagttgatgaaattctgaaacttctgacaaaatatgccatcaatgaatcacagagacatgatataatcgtaacaagaagcaggtcctgtgatacctaaactgttattatcagctttatacaatgcagattcatgggccaaaatgcagcattcacacagagaggtatgtaaatccatctatttagtacacatttaaggatgcattcaacatccaggaaatccattatgtgtaatgactcatgctttattaaatgcttcccacatgcaagtagtagtcaaaaagggaattactgatatcaagacaactgaaagccgccctctattattctgtgaaatgcagtattttaaaagtgtgctagatgacgttagtgttgggggtatattcagggccaccacatacacactttggtgcacaaaatgagttctgccccgaagcaccttcctgaaggggtaagtgggggcttaaaaacagacctagttttacttatcaagacctatgttcttattcaaagttgagtcaggccagagcccttccagaggagaatgaagccccttttttgccgtgttatgtgaagatttttaaatttgtattagaaaagtgtaaccactgcatcaactaatgattttattttcctttttaaaattattaaactagaccaggcatggtggctcacaccagtaatcctgacattttgggaggacaaggtgggtggataacttgagtccagatgttggagaccagcctggccatgatggcaaaattccgtctctactaaaaatacaaaaattaggtgggcatgatggtgcgcagctgtaatcccagctactcaggaagctgaggcacgagaatcacttgaacatgggaggcggaggttgcagtgaaccaagatcacatcactgcactccagcctgggtgacagagcaagacacggtctcaaaaaaaaaattaaactacagtgtgattaaatcataagtgtgtttaactatgagaaatgcatttttaaaactactacaagaggtgataaaacaaatcaaggaagaaagtatgcaaataattaaaatttggaaattactggtcctggggaaataccataagctttggagtaagacaaataataggatgttcaagcctgctcctgttgtgctttagcaagtcacttggttgttcagcttcagtgttctctcattctatgtaagaatgttctctccaaaggactgtagtgagaatgaaatgagatgtctatgaagttgtcaacagaccttacttttccatccttcatttttctttgtgcaagtctgaattcttagtcatcctagctggcttccttgacggtgttaactcaaaattctgagttcttgtgggtatcatactcagaaggataccatactggtcctaaggtactcagtcgtcttagttatttcagctttagtgccccatgattttcatctttcctattgcacatcccactcacctcaccacccccacggcgacattccagggagcaggtataaatacacacagtcagtcacactcacatgcattcacaggttcacacacattcacatactcacatacactctcatgtacactcatctgttcacacacattcacataaccactcacgcacaaactcacatgcatttttcacttacattcacatacatacacacgtgttcacacacacattcgcatattcatacattcacactttcacacacatacacatacatgagaaacactgcagccacacagagctactcaccatttcctgtttcccttctgtattcctttgttcattattgtacctttgtccacaattccctcttacatctccttctacttaaatctttccgttcctttaggtttagttaacaaatcaactcccctgttaagtcttacatgatcactcaaccagacatgaccttacctttaagtatttttttttaaatctttcctaaggttgtagatatattctaccctaagatgtaattacttatgttgtttgactaaatatcagactgtaaagtttttgaaggctatgatcatgtcttagttatttcatcccccacaatgattgtcttcattatgttgaagaaatataatcttagttaactttaatgaaatagactctttcaggttccaagcaatggagatgtatttaaaatagttaagtcacttggggatagatgttttagtgatatacaacttattttatctggatttactattgtcaatcaaggcaaaagagaaatctgactggttctgttgatccatctagtataaggtttacattcataatctaattagtaataaacagatatttcatgtcccaaattcagcattcctcaaaagtgggaaatagatatgctgggtccttgaaatattacagatttctctccagttccttccttgggccacttgtttccatacctcttcttcaggtcagtattatttagcttccaggcataaattctgttgagttgtatatctttttataaggaatagcaatataaaataataaacatatctttataaaatagctgtacaaatattactacaaaaaagatatagtatgtgtctatgtgtctgtttctaccccaaggagtgtgagcattctacagatcagctagctcaaaagtaagagggaaagtgtgaatgagctgagtgtgcccagtcgtttttgcacttatccatcaagtcagtcatgcattgtggagttggtggggctaagtgatgggaaagagaaaagcaggaggtatatttctcccatctttttccctgaggaggaatgaaatggaaattctttctcatctctgaaaaacctgaagagtgagaaataagtaccttttcatttcccctcatctattgagtctaagaattaaaccccaggggtataattatcctgcagaggtgaggggattagaagtgaaccaggacagtccttcttccactttcaggtacttctgcaccaaaaacttacttttgcaatgcagttttaggtactttcctagcccaatgattgacagacagtttagctgttgcctttagaaggctctgaaattatttctcttggaatccactagcccccagatttatactcaaaactatttcccatctaaaattaggcccccaaaaaactagtatatcaagattttggaaggaggcccctggggaggaataatttatcgatgcacacaggagaaatattgttgtctctttacgttgaggaagaaaataagtgcttttgagcttaagagaagtaaaactattttagaatacaagttttttattcaattcttttagccactctttgtttatagtttaaatctgatatccaccaaaacattttcccaatgtagagatactataaaaaataatttgctttccagaagcccattttagtcaaaaagaaacgttaaaccaatttaggaaggggcagagctcatatgaccacagtacttttattttaagtgtataaatcctattaacttgacaaatgtcaattgagaagctctactagatacttgtcatatccaagagatacttatgctagtaaacggttgttgaatatatttagactttaggttctatgctggtgtgcacttggccatggaaagtggttgggtagcgaaggactacaaggcccaggatctgaagccaaatcacaatggcactaagttacaggcaggaatacagttggcataggaagaggtattacataggtactgcaattgcatgggaagtgtctggggtgttgagtagagtggagagaagaaggtttaaagtaaagcaggtaagccagtattggtatttagaagtatatacgggcaaataaatccaggctccatacacttcaggattggggagtgaggggaatactgtgataaagttataaagcagagtggctaagaaacaagatctgggcaataatactaatgtcctcagtcaaaggaaggattattcagataaaaaatggctaatcattacacatggtcacaaatctcattaagattcttcagagctttggcactaagaccaaattcatcgtattaaaggtaaggatttcccttttacttctctggtactcaattacttggaaaaggatggtcattaacttctctgtaatacagaatgaaaaagcaatatagagaattatggccatggtaatgagcttaagtcttctcactcactcatagtcttttacttttcccaccagtcctactgtcttagtttgcactgtaaaatagagcagagaaattacataattacctgaattatttagactaaaaaaaagtgattgctatgaattacaggagctctttcaaaatttcctcaacatgaaatatttttactcttttttcttatttttagtgattttagacaggctcatacatctctctttatggaaaatgattaacatggactcaactggggagaaatcaaattatacagttaataaaaactaaaccttcagtccacgcgaagtaacaatgtagcaccagggaaaattaattactgcattttagagtgaaaggagtcagacatgtcaagtttgaatttagccttaggagctacaacaaattttagttcttttgtgactgaatttttatagtacaaaattactcaaaataatgtagccgtattctacaaatgtaactagctttttaaaattttctaatgattaatgcttaaattgcttgaattttttgtaggaatcttttcagattcattgtgtaaatttgagtcattcctttggttctagctgtgaacaatcactgatcggtgaaaaattattaaaattgctccatttcacgagagtgtttaagtgtttttgatacttctaaagagattctcaaagtgccttgatgctgagaatttatatgtaatcattctcaaatacagcatagtgcagtatttaagagctcaaatgagtagttgtcaatggaggcagattactaacaaacaattgggaataaaccagtaatttatagacttaaaattatagtgtatttttctgttattttgtgtgaactagatagactgatatcctgagaagtttacattttcctgtctatttaagtggtactgaataaacctaggcaacaaaaaaattatataatatgtgattgttagtctctgtcttataatcaccagatcattttgaaggaagaggttatacaggtctttgagtgcaggcttctctcttgtaggaccattcagcctttgcttgaacacaagctgaatgaattcactactcagcacaccgctttttctaccagggagcagctctaatgcttggtgactggtctgacttaccgtccagataaagtcctcagcttgactctttggcaaactcccaggagttaactataaaggagtctgatccctcagacttttgatgtctctttaattatgaggatcccacttatttctttcttcaccagacagtccaacataaatgctctcgaggttccccatttaacataatttttagatctcacaactaccccggacacagagtcaggatgtagtttaatcagtgtctgatttcaaataaaaactccgaaagagtctgatcagacaactgtaaaagatcccttaagtaagtgtatgagatttggtatcacacaattccttatgtccactgcaggaaaataggtggttactttattatttcttcattgaggtaggttaacaaaattgacatataaattaaaattatatcacaatatttttctccatgtgatttccaatttcatattggtgataatgacatacgtttaaatagtgtaaattcagatagctaatttgattacagctgtgaacacacatcttaattaaaattattaaggtaattcttttcacaagacttctcaaatcactttctatacgcttaaggcaaggatcatcaatacacaggaaaaacatattgatagataatgatcactttgtatagacaaaatgaaataaaaatgagtaggaaggaagtgtatattttaaataagaaggcataagttatggctaatgctgctgcagtatcagcaccattactgttagagaatgagctgctattttgcccagcacccccatccctaccctcatcttgctaccattgcaacgaaatgattgaattgtttgtttctttcccaatatttgtgccttaaacttctaattctatttttccttatacttcttgagtgaataccccctcctcttaaaagtgttccttaaaactgataatgagtacttttctttgtttcttaacattctttttgtacagtgacctttccaccagtagcctcttggctttgtatgttataaaagctgcaaagagctttcctttggaaacaatccaaatgaaatagatacatatacttaaaagtgttttatttagacttagaagtttatatttgtccccacaaattctaagcagtattgatctatgtccttgccaggctaaaaccagacaggagacaaatcttactttaaaaaattctcttgtaagaataaagtacaactaaaatatctttaaaagcttcttcatccaaatgcatgacaaatgtaactctattgtaaatgcaaggtacaattaattttggcttagaattggaaaactacctaagaggacacatcaaggtcttttatggtgctgggtaggtttctaaagagcattaaatttttttttgaagttaattatgtgaattatgtgcccaccattttctattctagtgcttcttcctaaaagaaattctgcaaaataccaaatatagtgatttggcaatgattgatagggtgacaaagggaatttccttgagaggcaagaaagtacagtgggaagtcagagaataatcgatttgaaatctagtcttatccttaataaaaataacttgatgcagttatatgtgcactctcatcttctgttaaataagaataataatctctacctcctaattttgttgtagcatacactaggtaatgaatacataaattttatttcttttgtagtacacattgcctcaaagttaacaataagttgcagacttataatgaagtaggagatacacttgtaatctttaaaatgaaaagatttatagagattttacaaatttattgctaattagtatttcatttcttctccaattatagccattcttaataactaaaaagtgaccatgaaattcatcatcaataacatcaacacttggttcatctctatcttgttattaccatcttgtggtcatgtttccataaattattctcttccagagaatataataaacatggaaaaggtcataaaactttattagcatctctggaaacaaactgaaccaagagacattttaaactgtgtatcaaaatgagatcaggtttcaattcaattttattgacaagttaaaatctttggagcccagtacccgtgcacaccacattacaactgatggcacctagagcccgaggaccagtcctctgagggcctacctctactaccaccagcaaccttgcttcctccactggtagagtcactgcacaaccatgcatgtgcctcaggctcttgagagccagctttttcagcaacgcttccccagcaaagatatgccacagcctccacaaacagccacagcttaggccacagaagcactttcaaacaccactaacattgattacagccaaagaaatcataaggagattatactactgtgcccacacagaacaaaagccaaagcactctacccaatgaacaccatagatacatctacaggggaaaaaaaaaaaatttcctagaaaaggttctccatacaactggaaaaaataacggtttcaccagatgtgcagatatcaatgtatagacacaagaaacataaacaagcaagtaaacatgatacctccaaagaaacacagccactaacagacctcaagtaaaagaaaatatattgaaatgcctaaaatgtaattcaaaataattatcttaagggaactcagtgagatacatgagaacactgatagacaattaaacaaaattaggcaagcaattcatgatctgactgagaaattcaacagaaatagatctaataataaaaaaccaaacagaaatcatatttgaagatttttgtgaataaaattaaaagtacaattgagcacttcaataatagactagatcaagcaatgaaggaatttttgaacttgaaaaggagtcttttgaaataagccagtcacacacacaaaaaaagaataataaaagcctatgttacatgtgggatacaattaagtaaacaaatatttgcattttgggaattctagaaaaataaaagattggaaaagccatagaaaacctatttaatgaaataataactaaaaattttccaagttttagaagagatatagacatccagatccaagaagctgaatgattcccaaatataatcaacccaaaagtgttctctatgaggtatattataatcaaattctcaaaagccaaagagagaattctaaaaacagcaaaaacaaacaaacaaacaaacaaaattcaagtcacatataagggaatccccttcagactaacaggagatcttttagcagaaattttacaggtcagaagaatagtatgaggtaatatattcaaagtgctgaaagagaaagaaagaaagagaaagaagagagaaagaaaaaagaaaagaaaaagacaaggtaaggaaaggaagaagaggaaggaaggaaggaaagagagaaagaaagagaaaaaagacaaagaaagaaagagaaagaaagagaaagaaagagctagccaagaatactatgcacagcatggctattcttcagaattgaaggttaaagttttactcagagaagcaaaaactgaataattcattaccatcagaccagccatacaaaaaaatgcttaagggagttctttatcttaaagttaaaggataatatctatcattatgaaaacatacaaaagtatataaaactcactggtagaacagatatacaaataagacagagaaaagaatcaaatgatatcactacagaaaaccagcaaatggcaaagataaagaataagagaggaagaaagagtaaagaatatacaaaactaccagaaaacaattaataaatgatgggagtaactcctcacctattaataacaaccttgactgtaaacagtttaggtttcccaattaagagacatagacaagattcaactatctgctgcctacaagaaactaacttcaactgtaaagacacacatagattctaagtgaataaatggaaaaaatacattctatggaaaccaaaagcatgcaggagttgctatatttggacaaaatagacagtaagtaaaaatcataaaatattataaagaaggtcattgtatcataataaaggggtcaattcagcaaaaggacatatcaattataaatagacatgcacccaacaatggagcacccagatacataaagcaaatattattagtgccaaagagagaagtagactccaataaaataatagttggagacttcaaaataccacatttggccttggacagattatcccgatagaaaatcaacaaagaaacattggacttgaactgcactatacagcaaataggcataatagacatttgcaggacatttcatgtaataactacagaatacatattcttctcatcaggacatgaaacattctccaggatagagcatatgttgggccacgaaacaagtctcagcaaatttttaaaaatttaaatcatgtcaagtatcttctcagaccacaatagaataaaactagaaataaataacaaaaaaaaggaactttggaaaccacacatgtccatgaaaactgaacaacattttgctgaatgaccaatgagtcaatgaagaaaaaaaaaatcttgaaacaaatgaaaatggaaacacaacatacaaaaacctatgggttacagaaaacgcaatactaagtagaaagtttatagcaataaatggctatctcaaaagaagagaaagttttcaaataacccatgtacctcgagcatccagggaagcaaggaaaactaaacccaaggttagtaggagaaaagaaatgaagatcagaacagaactaaatgaaataaatacaaaatacaaaagatcaacaaaatgaaaagttgctctcttgagaagaaaaacaaaatcaataatccatgatgcagactaagagaaaaggggagaagacccaaataaataaaattagaaatgaaaaagaagacattacaactgataccacaaaaatacaaaggagacagactattatgaaaaactctatgccaacaaattgaaaaacctagaggaaacagatacagttctagacatatataacctaccaaaattgaacaagaaagaaatagaaaacctaaacagacccataaaaagtaatacgattgatcaataataaagtcacccaacaaagtaaagccaggcttcactgctgaattctaccaaacttttaaagaactaaaaccaattatcaaactatttcacaaaaactgaaaaggaaggaattctttctagctaattatacaaggccagcattaccctggtaccaaaactagaaaatgacacaaaaatatgttcatctatgcatttatgtgcatctggtgaacatggatgcaaacgtcctcaacaaaatactaggaaactgaatataacattacattaaaagataatagatgataatcaagtaagatttatctcagggatgctaggaaatttcaacatatgtagattaataaatgtgatgcattatatcaacagaagtaaggacaagaaccacgcgattctctcagtaggtgcagaaaaagtatctgatcatattcagcatagcttaatgataaaacaactttcaacaaattaggtataaaagaaacataccttgacagaatgaaggcaatataagacaaaactacaaataacatcacacctaattgggaaaagctaaaagcctttcctctaaaaaactgaaacaagatatgaatgcccatttttacctctcttattcaatatagtactaaaatgtctagcaattagataagagaaagaaaaagagggcatccaaattggaaaaaaaggaagtcaaattgtccctctttgcaaataacatttttgtgttattttttatttagaaaataaatttttgcattattttttctttagaaaaacctaaagattccaccacatgtctcttagaataaatttactaaagttacaagatataaaatcaacatacaaaaattagtagtgtttctaaacaacaagaacaaagtaggtaagaaagaaattatgaacacaatccatttaaaatagctacaaaaataaatacctagaaataaattcagccaaaagatgaaagatctctacaatgaaacagtaaaacaccgatttaaaaaattaaagaggacccccaaaaataaaaagacattccatactcatggattggaagaattaatatggctaaaatgaccatcatatccaaagcaatctataaattcaatccaattcctatcaaaatatcaatgacattcttcaaacagcaaaaacaattctaatacttgtatggaaccacaaaagacctcaagtattcaaagcaattctggggaaaacaaacaaactgaaggcatcatactatctaacttaaaaaatatatatgctacagtatagtaaccaaaaccaaaacatagtattggttcaagaactggcacatagaccagtggaacagaatagagaacccagaaaaaaaatccatgtattcacagctgacagatttttgccaaaggttccaagaacatacattggagaaagaatcggctcttcaatacatagtgctgggaaaactggataactgtatgcagaagaatgaaactagacccctctctctcaccatatccaaaaatcaactcaaaatgggtgaaagacttaaatgtaacacctgaaactataaaactattagaaaaacatagggaaaatgtttcatgacataggtcaaggcaaatattttatgggtaagacttcaaatgcacagtcaatgatatcaaaagtagacaaatgggagtatgtcagactaaaagccttctgaacagcaaaggaaacaaccaaaagagtgaagagataaccagtagatgggagaaaatatttgtaaactattcgtacaagagattaataaccaaaatgtacaaagaactcaaatgactcagcaacaacaacaacaacagcaaaaaacatataattcaattaaaagataagcaaagagggccgggcgcggtggctcacgcctgtaatctcagcactttgagagcccaaggtgggtggatcacaaggtcaggagatcgagaccatcctggctaacgtggtgaaaccccatctctaataaaaatacaaaaagccagacgtggtagtggacgcctgtagtcccagctactcgggaggctggggcaggagaatcacttgaacctgggaggtggatgttgcagtgagctgagattgcaccactgcactccagcctgggggcagagtgagactctgtcaaaaaaaaaaaaaaaaaaaaaagataagcaaagaatctgaatagaaactttttaaaagaagatatacaattggcccataagcatatgaaaaaataatcagcaccactaataatcagggaaaagtgaatcaaaaccacaatgaaatatcaccacacccctagttagaatgactattatcaaaaaggtaaaaagtaaatgctggtgaggattcaaagaaaaaggaactcttatacaccattggtgggaagtaaattagtacagccattgtggaaaaaccatgtagtttcctcaaaaaactaaccatagaactaccaacaattcttctactgggtattaccaaaaggaaaggaaattagtatatcaaagagatatctgcacccccatgtttatttcagtactatccacaatagtggagatacagaatcaacctaaatgcctattaaaagattaatagataagaaaatacggtgtatataggctgggagtgcgatggctcatgcctgtaaatcccagcactttgggaggccaacgtgtgtgggagttccagaccagtctgaccaatatggtgaaaccccatctctgctaaacatacaaaaattagccaggcatggtggcgtgtgcctgtagtcccagctactcaggaggctgagacaggagaattgcttgaacccaggaggcagaggttgcagtaagccgagatcacggcactgcattccagcctgggcaacagagtgagactccgtaaagaaaaaaaaaagtatatataatatataccacgaaatactattcagtacaaaaagaatgaaaccttgtcattcatgaaaacatggatgagtttgcagtgaaagttaaatgctacttgttctcactcgtatgtgcgagctgaacaagttgatctcatagaagtggagagtagagttgcaattattagacactgagaagagtcgggagagaaggatagggagaggttggttaatgaattaaaatttacagctagttgggaggaataaattttagtgttctatagcattgcagggtgactttagttaacaatcatttattgtatattttcaaatagctagaagagaggattttgaatgtctccaacacaaaggataaatattgaggtgatggatatgctaatgattctgatttgatacatgaatcaaaatatcactctgtatcctataaacacatacaattactacgtgtcaaccgaaaatagaagcaaaactaatttctggagccaagcacagacactatacgagtcataatttctgactatcgaaaaatgataatgacagtaccaggggtgggtttcctattcagggacaatagtgactggcagtaatggtggggaactattgaggaggacattgccttgtttcttaaatgtctctaagccttcaatatcttcagcatgtctgtgccttcatgctaattaaaaattcacataaatatgcttttaaaattagtaaaattgtggcctcaggtgagttcttaaatggcagtaatatctctggaaatacttaacctgttcattgaaaactgagcctctagagtgaatgcagctaacttttcaaagctcttagggaaaggaacactcacaatatgggaaaagatacctgtggggagggaacaaacaggaaagtgagaaaacagcaggaaaagctctgccaaaaaaggattcagtacattggaaactataaagtcagtgagaagttgatctttcattatcgtaaccagctgagaaaattctgcctctagcatctgctagtaaaggcgtgaaagagagaagactcattttgccaaacttagatcccactcatagctgatgagttctaactttagaggtggaaaataaaattgagattttgagcctggaagttcgatgaactttaacatagcatggagatttgcttattgaattttttcccgtttcctattttttcttttcatttccatccttccctccttccctctcatccttcctttcttctttccttccatctttcttccttgttttccttttttacctttcagtgaattacaaggatcaccttaaaacaaaattctttgtattctagcagcaaactttcttctgcagttgagagttgatatgcacttcttgagaaggaactgtgaacatatcgggtttaacatgttcctgtacccttaagaaaaaagcaactgactaagacaatgttgctattcgtacatataaagaggtaccaggtctaacactgtgaggtttgaaaaggaatggaattaatcaggaaaagctgttgagaaggggtaactcaaagtattaattcaaacgaagagagatacgcagaatgttaataggaagttataaggaggctttcataaaaatgcaatatttgtagcaatactcagaatgcaaaaagaatagaccaatgacagacaacataaaacatttatctggaccaagaaggcagtcgcgataagacttggaaaaaagaaataatggcctttgttggtacatggacatgagaaacctgttttcaggcaagaaataattaaaacatataatagcaatgaactttaaatattttacattatatctttagtgaatctttccacataatcagaagaaatacattttgttgttaaaacactagctttttttttttttttttttttttttttttttttttttttgagacagtgtcttgctctgttgcccaggctggagtgcagtggcaagatctcagctccctgcaacctccgcctcctgggctaaagcgattctcctgcttcagcctcatgagtagctgggactacaggtgtgcaccaccatgccagccttatttattttattttgtatttttagtagagatgggatttcaccactgtggccaggctggtctcaaactcccaaggtgatccacctgccttagcctcccaaagtgctggatttacaggtgtgagccactgcacccagccaaaagattagcttttagaaagacaaataccactggcctttacttatatgtttttagagcaatggttgtaatgttttccatgctcacagaaatattttataaactctttcctgaataactaatgtcaggaaccaagagctggagttaaccctagctatggtgtcatattgaattatgatatataatcaaccagatcccaaagttacccatagttgaagactctaacaaagtaggaacaggagtatatatctgatcgcccttcataatatagtggaatgaatcacacctttgaattttttagtgggtagatataaattttttgtgttctgggctgcatttctataaaggcagctttcattcaacctgttaaataaacatatttgtaattttggttatcttctcaaaaccatactttctcagctgttcttcctcgcatcttgaacaatataatttgctttcactgcttttcatatgctaccaggataactttagcattgggggttttatatgtagaagtggatttgcatagatctatacaagtattaccagaaaaatgctatacttagaatgataaattcaccagcagaaaacaagccatgactaataacaattttaaagaatttttcagggttttctatgagtgagtgtccacatgtagatattggcagtgcaatacagaacagtgctttctgatgataacttaaaatttaatccagtatatgttgattgtaaataaataagagttcatgaaaatacgtgattcttcatgtcaaatacagcctcccccactattccatctcctgcatcctttgctaattacaggatgttattcatcatggattttcctatttctctcagttgtaaagatgaaatgcatatagttttgttaatgtaaatattgatacttcccagggtatgttttgtttgttaaaatttgcttttttcccttaaatgtacttgcttggcattcctctaatgtcatcaacataaatatgttttaaggtaaggagaatgctgacttggtcccattcttaactctgaaaatattaaaagcactgctcctggtcatagtttctgcttctctgtatccttgtagaactcaggagagtagtctgggtataattaaggtcaagcactcagaatttataataatggcatctgtgttaccaacttcctcatgactactattaaatacagcacctgtactggttgcaccacatatctcctgcacagcccacccaatcctacaagagaaggattagttttattgtaataactcttggcttatatttaatggtgcttgtggtctcttactgatcaaaaacctttcaataagcaggatttattgatctggcacttaggtccctcttcaatctagccgcagtttatctttccaatgctattctatactactactaacaaaatcccatctcataagtataaggctacatattgctacttagaaatacaagttgtatatctatagttttgattattgtttcactttacttaaaattgtcttttttcccctggctgtgggtctatctaagcctggctctttcaggttccagctagagttcccaggcaccataccatttgaattcttggacatagattgtccacatcacttattaagtacttatcaaatactttcttatatcggtatattttatttttatacctagtttcccaaaagagacaatagccccatgatgtcatatatgctatcttactatcttatatagattcacatcacatcattatggcctggtaaggtgatttacatatggtataggaattattaatatttgtgtaactaacttgataactctaggcttattgccatttcataaggagtgcatttctagccttttagtaaccacactgcctagaaatgagaagttatccatttttaatattattctaaaagaagaaggtaatagaaaactccagaaatctaagaaaatatttcatatttttaaattgcaactctcacactccatcttcaaatctctgtaatctagcccccattacttactatcataacagttatatgcatgtgtgctttgctcttcaaataccataagctggaaaagtaaattttagctctttattgaaattctgaaatgtcattagtatcattttctcatttacttatcaattctttttttaatcaaatgcttattatttgttgagcaattaggcttcttacattgacctgaatacatacaggccctgtcagaaacaaattttagtgctaataacagctttcatgtaacacatcatcagaccttgttattttgaagaaatgacatgactaaaaatggggtcctttaatctgaactttctgaagatttactaggagagatgaataaataaattaacaccaagattttttatcactatgctgatgagaacatataattatgaaagttttctttagatttaaaagttttatcatgttaacaattctgagtccctttttcatgtttttcctatgaatacatcccgaatgcatccagagtgtaaaagattttgtttgtgcttttcttttcttttttttttttttgagacatagtctcgctcttttgcccaggctggagggtagtggcacgatttcggcttactgaaacctccgcctcccgggttcaagcgattctcctgcctcagccttcggagtagctgggactacaggcatgtggcaccacgcccagctaactttttgtatatttagtagagacggggtttcaccatgttagccaggatggtcttgatctcctgaccttgtgatccgcctgcctcggcccccccaaagtgctgggattatatggcatgagccaccatgcccagcttgtttgtggttttctaccttattttgtgacattgagacttgtggtttgtgtcaaaagtcataattttgagctgaaaattacaaagcatacaggaattaaataacctgctgatatacatggcacagatcacactgaggaattcctgttatatttaaaaggggacttcaagaaaacccttatgttgtctgttttacaagaagaaatttatattttgtagttaaaacattgaatatgtgcacatacacacagagacttcttgtttaaatgtctacaggaaaatagatgaaagtataaaataataccagaaattttccatttaatgatagctggttgaagatatacacttacttatattttatcctaaaataccaacaaattgatgttaaagaattaacagtgagacaagaagtttcagcaatttttagaagattgaaagtagatagaggattggcaagtgagcagaaaggaaaacccaaaaacttatgaacatgcagaggaggattccaaagtacaaatttggcaggtaacatcctctaacaacaggatttggaagtggaaggaatgtgtgaggtagaggaccaaaaactggaataggttgaacaatctgtttaaggaacaggtagcttgccttagcctcttccaatggtctccacatcaggcttctcccccaaacaggcaagcctcttgaggcacaggtcagcatcagcagtttctaaacagaagattaaattaaaatttgcatactgaaaaattaaaaactgcatactatgcagcaagaccaccagctccttcccagttcagccccaaaatgctgtggtttggtgcctaataataagaagacttgcagacccaaagcaaaatcctacagactcctatacatagagcatttggaaggcactgccccatcatcttatgtgagagacaacaaatgaccagcacactaatgtataacaaagcaccaatcaagttttagctcctcctatttaatatgaaaagacaaccagggatcaccagacttttaaggaaggctccaacatgaaagttaaagataagaataaacataatagaaaatctttaagtcatcctcactggctgttcccagtgttgggaattctctttctcatctttgctctgttcactccttcacttcattcactggctgctgttcaaatgtaagatactgagatatcttttcttaccattacatctagaatagtgttacccactgcctcaccctcacccagttcttggtcattctatttatttacttgaatttattttccttattatattaatcactgcacagatattttggtatatttatatatttgttgtccatctcctccattacaaaataaacattcataaggggaaggaatattgtttatagacaataattgtttttaatatttacttatttatttagtgaagatgagtaacttgaataaagcaaaagcaatgtagaaaatataattttaaaactctgataattcagagaactaagaaaacttatagccaagacacaattaaaataagagctatataaaaagaacaattagagaataattagctcttggaagttcaaaacgttaaaaattttaaaatagttcactattagactcgcaagacttggtaaagaaaatctcagagagtaaagagaaatgagaaatatgaacagtgggaaagaaaagataagaaggtgagagatcagtcctggaagtcaactgtctgactaacagaatttcctgtagtaatagaaagagtggaagggaggaaaaaattaaggatataatgcaataatattgtctagactataattaaagggcccatatattgaaaggcccaaagatgctctacaagctaaatgaaaaacagcaacaacaacaacaaaaacacccagttacttcctttagagaatttcagaactgggagctgaatgtatttcctacataaaggaacctcaggctaggtgcagtggctcacacctgtaatcccagcagtttgggaagccgaggcgagtagatcacttgaggccaggagtttgagaccagcctggctaacatggtgaaacctcatctctactaaaaatacaaaaattagccaggtgtggtggtgcatgcctgtaaaccatgatactcaggaggctgaggcagaagaattgcttgaagttgggaggcggaggttgtagtgagctgagatcatgccactgcactccagtctgggtgacagaggaagactccgtctcaaaaaacaaaaacaaaaacaaaaacaaaacaaaaaaagcaagaaacctcaaatatattaaaggaaaccaaaataaggtgtagagtatatatatatgtcttaaaacctaaaaaatacccctagtattttatattattaatgggtatggatatgtaaatatttaggaaaactgtaaaaaaaaagtcacgtgaacactaattctaaaatcatgatagtaattatccctgaagaagaagtgaagaaagtaatatttaggagaagtacagagaaggcatcatttatattgtataaaatattctattaaaaatgacttcagtctgggtgtggtggcttacacctgtaatcctagcactttggaaggctgaggcaggcagaccacttgaggtcaggagttcaagaccagactggccaacataatgaaaccctgtctctactaaaaatagaaaaattagccagacgtgctcacttgaacccaggaggtggagggtctagtaagccaagattgtgccactgcactccagcctgggcgacagagcgagactctgtcaaaaaaaaaaaaaaaaaaaaaaaagacttcaagcaaatatagcctaaggattaatgaaactgggtggtgggtataatgacgttattataatatcctttatactcttcaatggttttggaactatatcattgcttttttaaaaacagatgcaaaataccaaaagaaagaaagaatggaaacaggttacattttttaaaaatgtagggaagcaaaatgatattggacttctcaactgcaaaaacagaaactagaaaataacggagaaatttccacatgattctgagagaaaatcgtatttaaccaagcagtataaatgtgtccatccaaaatatcagtcaattaatataaaaatgtaatgaaagcacattcatcagacttaagaaactagtgactaacatgctctgtaaaacaagagaagaaaccaattaagagaaagacacgagaaatgttaaagagaaattataccaatacttgttaagaatggcaagatggattttatttgaactactgtagtagggaagagagacttcaatattgaactgacatcatctccaagtaaaacaaacaaagaacactttactcaagaccattgcaatgggagagaagaccactgcagaagagagacagactgaactcagctccactgaaaagaaagcagaaggattattaaatgctgacatgaaccagtagggagtacattagtggggaagttggtgaatgtgtttaggccatctgagtttgctaaatgtcacttacctgagttaggctcctactctcctacacagattgaaatagaggtgctatcatttttcacaattacatttcaaagggatatctctcatgtccttgagaaagacattcctgagttgtagaaaatttacatctcaaaaatagggagaaaaaattgataattgcaaaatttctaaagtaaatgctctaagaaaagggaagttagaggcccatattgaggaagaaatctctttaaagtttagtcgagctgataggaacattaaggtcatgttggtcagatccaggaaactgggggttcaacatgcaagagaactgatgatattgggtggaggcctacattaaattatgtgcatcaagttcatggagtgtgatggaagccaaagcctggaggattccaagtcatagttcacctgaaaaagaacaaacaaaaaaggcattaaatgatcctgaagtattggaccatgtagaaatgaatattgaatgagtccttacagttctattggtcaatttgaaaataattagtggtagatatgccacaaagagatgatgaaaatctacccaaaaaatgtgaagaaatcaaaaaaacaaagatagctggaaaatcccaaaatacatggagattaaacaacacattctaaatagcacatgggtcaagaataaatctcaagacaaattgtaaaatattttgaactaaatggaaattaaaatatcactttttaaattttgtagaatgtagtgaaagcactgctttgagggaaatttatagcattgaatgcatattaaaacaatctaaaatcaataagctaaccttccaatttatcactctaggaaaaaaaagagcaaaggaaatccaaactaagcagaaggaaagacctactacaaattagaaaataaatcaataaaattaaaaataagaaatcagtagtgaaaaccaacaaaactataaactgcttatttgaaatgattaataaatcattaggcctttaggctaagaacaaaagagggaagttaagaattactaatattatcaatgaaagcaggaatataactacagatatctggacaagaaaggataataatggtatattgttaacaattctatatctacaaatttaacaacaaagataaaatggaacaatttttgaaagatgcagtctaaaaaaacttgtagaaatagacaaattgaataggcttttatctattaaaaaattgaatcagcaattattaactttttaaagcagaaagcaccagacctagataggttcactggtggattctaccaaacacgtaaagaagacattataccaattctctaccatctttttcagaagatagaagcagagacactaacttcgtaacacagtctatgatgctagcatcaccgtaataccaaaaccagacaaaggcagcacaaaaaaagaaaactgtagtccaatatccctcatgaacacagatgcaaagactttcaacatataacagtcagtatagcaaattgaatcagagaatgtataaaaaaaattatacaccacaacaaactgtgatttgtcccaggtatgcaaagctggttcaaaattcatgtaatacatcacatccacaaactaaagaagaaaaattacaatatctatagatgtacatcgtatcaatagatgtacctcacatcagtagatgtataaaaagcatttggcaaaatccagcatccattcatgataaaaacaaacaaaaaaactctcagtaaactaagacagagaaacttcctccactggataaagagtacctataaaaaaatctatagctaacatcctaacagtgagaactagaagcttttctactaagatcaggaacaaagcagggttattccctctcactacacctcttaatattttactggaagttgtagctaacacaagacaagagaaggaaataaagttacacagattaggaaggaagagataaaactatttttgctcacagataaaatgattgtctgtgtagaaaatctgcaggtattggcccccaaaatactcctgtagctagtaagcagttacagcaaagtttcagggtacaaggttaatatgcaaaagccaattggtttcctttgtactaccagtaaacagaatttgaaatttaaaatacaataccatttatattaccacacacacacaaaaggaaatatataggtatcaatttgtcttcaactattttgtgctgctgtaacaaaatactacagactaagtaatatataattttataatttataattgtgcatttaggctgcatcataatatggcaaaaggtatcatatggcagaaaggcaaaaagacagggagatatatgaggggaaagagaacaaaaagaaggccaaactcacccttctgtagcaaacccactcccatggtggcaacattagctcattcatgacagtggagcaacgcatggcctaatcacctcttgttatgccccacctcccaacactgttgcactgggtattaaattcacatgcttttggggtgacatactcaaaccatagcacttctggtccgccagaatctatgttcacctcacatgcaaaatatattcatttgatttcaataacaccaatgtcttaacttgttctagcaccaactcaaaagtccaaagtcaagagattcatctaaatcagatatggatgagactcaaagcacaattcttcctgaggcaaattccctctagcttgagcctatgaaatcaaaacaagttatctatttccaaaatacaatggtgggacagacataaggtagacattcccattccaaaagggcgaaataggtaagaaaagaggggtgacttgtctcaataaagtccaaaacccaatagggcaaacaacattaaatcttaaagctggagaataatctctgttttgaccctatgtcccatctttttagtacactgaggtaggagttaagccgccaaggctttaggcagccccacctctattgctttgctgggctcagcctgtatagcagctctcacaggatagggtgtcatgactacagctctccgggtggttgttgcagactggtagctctgcagttctgaggtcttggggatggccccactactgtggctccatcagaccttgccctagggaggactctctgcagtagcctcactacctgtattccactaatcattgcttagtgactctgccccgaagcaggtttctgcctgggccccaggctgcctaatgtattctttgattagtggatgctgccataactccatagctcatgaacttggcacgtctgcagagtcagcaccacataaatgcctcaaggcttactgcttgagccctcaggaacagtggcccgagctgtacttgaggctgcttaagccacagctgtgggagacaaggagacaagcttcttgaatgtggggaacagagttataaacacagggaacagaggcccaaagtggccctagtcaaggagcttgtggagggcatcctagacctgtctcccaaaatcattctgccctcctacagctctgggtctatgataagagggaaagtctcaaagatcacagaaatgccttcagaatcattttccattatcttgatgaataacacctgtctttcttctagccatactgatctccttatcaaatgtgtacttggccatacccttggatttctttcctaaaaaaggtcttttattctgtaccatatggtcaaggctgaaactcctttaaatccctaagtgtgtttccctttaaatcattttatttaaatctagttttgtctttaaataatttatttcttcttggattttactgtatgaagttaaaagaagccacacaactcctgtaatattttgcttagaaatttcttctgccagatatcctggatcatcactcttaaattccatcttccataaagccctggggcatggatacaattcagcaaagttctctgccactttatatcaaggatggcctttactccagtttccaaaaagatgtttcccatctccatctgagacctcatcagaatggcctctactgcccatatttctaccagcattcctatcataaccacttaagtaatctatatgaagtttcagactttccctgtagctctccttcttctgagttttcaccagaatcgtctgtaatcctccatttatagcaatacaagctttttctagcattcatttcaaaactgtttcagcctctactcattacctagctctcaatcgtttccacattttcgggtattcgttatagtaccactcaattcctctggtaccagttttctatcttagtttgttttgggctactatgacaaaacaccccagactgggtaatttacaataaacaagaatttattttctcacaattctggaggctgggcactctaaaatcaaggggccggcatccatcaaagtccttcttgttgtgttataatatggcagaaggcatcaccaggtagaagggcacagagagtgcaagagaggaagtgaaaaaaaggccagtctcacccttttataacaaacccacttgcatgataatgaagccccacacactccagtcatagcagcattagtccattggtgagcctggagtcctcatgacctaatcatgtctcattaggcttcacttcccaacactattgctttgggggatgtttcctacacacaattttgggggatacattcaaactacagcaaaatctagcaaaatatgtacaagatctatatgaggaaaattgcaaacttcttttaaaaggaatcaaataaataatcgtgtgaaattcaatgtttatggatagaaagactcaagattttcaagatttcagttaatcccagcttgatcgatagattcatcacaatccagcaagtaattttatggatgttggcaaactgattctaaagtatatagagagaggtgaaagatccagaatagacgaaactatattgaaggaaaacgataaaatttgaggaccaataacacctaacctcaagagttaatataaagttacagtaattaaaacagtgtggtattggcaaaagaagagacaaatagatcaatggaacagaatagagaacctagaagtccacccacacaaatatagtcaactgttttttgcaagagaggaaaggcaatgcaaaggggaagacagtcctttcaataaatggtgctggaataattgcacatccacatgcaaaaaaaaaaaaaaaaaaaaaaaatctagacacaaaccttgtgtccttgacaaaaattaactcaaaatgggtcaaagacctaaatgtaaaatgcaaaactgtaaaactcctagaaaatgacacaggagaaaatctagatgaacttggatttggcaatgacttttaaaatatgacaccaaaggcatgatccatgaaaaaaagcattaacaagctgtccttagttaaaatttaaaaacttctttctgaaagtattatcaaaagaatgaaaagacaagccatagactggtagaaaatattgcaaaagacatatatgataaaagactaccaggtatggtattttaatctatattttaacaatataatttttatctttttgagtctgaaataggcaaagaactcttaaaactcaatgatgaaaagcaaacaacccaatttaaaaatgagccaaagatcttagcagacatctcactgtagaagataaacagatggcaaataagtatatgaaaatagtctcaacatcgtatgtcatcagggaaatgcaaattttgtaatattcatacaaccaaattttagagaaaattatacagaatggtgaggaatagaaagggaatatttctaaaaatgttacttcacacatttcatactagaaataggagataatacttaaatgataaatgaataatgtcaacatgagcatgatatttacaaaacaaaagtaaatacttaaagaaacagttataaaaaatgaaagtggttgcctttcaatagggtactatgaaatggaaagaaccgtggacaagaaatgctatttttggctacagctttatggtaaatgtaattatttaaaatatatgtagttaattgattttctaagtaataaataatatagaaagcatataaataaatgtatgaagtaataaaatattttacttgtcatccagacaataggttcaaatgacctttagaaatctcaaacgtaagttaaaagagaaaataccaaaaaagtaaataaatttaacaaaagagaaaacttagaactgaccctctggagaaatgaaaaataaaataaaaaagagagagagaaattagagtttggtgttaccatttggattatgcctgctcccctaaacttatgtttatggcctaacccccagtacctcagaatgtgacttcatgtggaaaaaggatcatttcagatgtgactacttaatgaggtcattagagtgggctctaggccaatacaactggaggccttatattttaaaaacagaaatttggatacagcttggcacccggggaagttgctatgtggaatgaaggcagagattagggtgatggttctacaagccacagaatgccaaatattaccagcacaccatcagaggcatgcaatggatccttcttcacagaaagccccttgaaagaaccttacttacaccaggatcttagaattttggcctctagaactgtgagaaaataagtttcttcttaagccaccctatttgtggtactttgttatggcagccctagcaaactaatatagttactgtattagaaagaggagctaaagatggctcagatgtctgttaaatccagcataattcgctgccagtattcttgaaattatggaagaaaaatcaattaacgataccatccaatatattataaatattttatatgaaatatttatataattgttaattcctcttaagaaattagtattaggaaagaagagattgtctttcttggggccatggtattcttcattcttttagatgatgatagctgtgttcccattgtgtctccattattaccaacaagtcagttctgaattgagtatccaagtgaggcacttactcatgtcttggtttcctggctcactagctatcatctccatttttttggttcttattttttacccttgttttaatggtatatgtttgctttattatgacaagactcttttttttggcagtagttaggatataaataattagtaaataaatgatcacttctgattaccatagctctagtggccaacaaactcaactaacatcaatgctttttaaaaacttgtctctgcagctatggtgactaactgtcctggtgtgcttgggactaaggggcttccaaggacaagggactttcattgcaaaattcatgacagtcccgggcataatgggatagttacctatctgaaccacttctgtgtctaacagctcacaagcatgttttcactgtcactgctttgggctctggtccctgtttgcaattatgattacccctaataaactcatacatagttgagttgattattgaatcatcttgctttgtatgataaattttgcttcaaccaatgagaagcaataatgcaaataaccaagttctaagtctcagaaaatcctccttaccattgtttcaaatggaaacttgtggttggtcttgacttcctgtgagagagggaggtttaccgagaccttgagctatggatattagatatcaccagggattagggaactggattgtgttcttgctgggctgtccaagcctggctgccctcatggcttagtctcttgttggttgcccttttgaatggttttctcttttctcttaggccctggggatttatccagtttgctttggtaaccaaacattaaatgatcatgattttgagaaaaataacataaaaaacattcctttctcatgatttcccccacagggctccccatggacctgattcttctgctaccattggataaaataaatagcagatctcctacttttgtggttacttccagataataacaagttatccaaagtcactatagtttccaaagaagtctgtgttcagaaattaatgtctgacattataataaaaaatccaaattgtattcaaaattaaacttcttccttcctgtagggaaagttgtatgctttgtgtttcacttcgatctttactaactaaccccatccctatctcacaactattatctgagatctcagaccccaccatgcttggagtatagcaatggagaggagataagggagcaggagagatatctaggctaacagaatttggtggctaatgagattgaaaagtgtctcgagacacttttctggggttttcagagaccctgcattgcattaaatatctcatctgtaggtacatgatttagttggtgtctcttccatacttactatattttaacactccctccctcatgccctaagaataggtgatggtaaagattcagccatcacccccctacccaccagtcttcttagaaatccttggaagaaaacccacgttagctctctctcatgacagcccacatctgctaccaaggatcattactttagatccatgatatgtagcagtgcactttcctttctcatactgcctaatttttgtttgaccacttctcaggtagctctagccacagactctattttgagatttatcaggcctgagtcagacactagctgctgtgtttcctaggttccaaagatactttgaagcttttctcaacaggcttgcaaaaaaaagagatcacccctaccccacccaaccaccaccatggagatgatgacattcatagcacacctttttccaaagaagttctacttgcaatctccaaattccctggccatttcaactcaacctttccatatgttcaatgtgagtgtgtggctccacgtcacaaacgatgacttaagacgttatctgtacagggtctgcctagtccatcagaacctcactttggagtgagtagttggcacctattatcttgtggccataactatcactgaaactgatagagtgcaatttcccataactgacctttttttcttagaacttatcttccttcatgacttgctgaataataaaatgcttttgatgcatttcctttagccgttctttccctggaagacaacatttgcccatgtgccattgatagctccaagttggcataggtgattgcaagctctctgagtgcaaaattctacttttattccatttacagctgggtatcacctaacatggtgaacttcatctaaatagttgatttattatctccaccctacaagaatttgataataatatttcctaaaaaatatttacttcttaattcttaagaaacattatgaccaatttcacaaaaagtgataagattgaagagacactgatttgcccaaataacaggaagagggggaagcaagtaatattatgttttcttaagtaagggtcttacaaattcaagcattagccacaatattatgttaaatgttgcagaattgaagtatagctttaagatttaaaatgtgtgaaaagtaaacattttgagagaaaaaaataaagcagatttagaatagcatgaacttcacttgataaaagtttaaatccttccctttgtaatgggaaagacccttgaaaggtaaagactcttcagtgttacaatgaatataaatcattagtaatataaatcactaggaatttctccaataaaataatttgatctatattattatagtcaggaaaaaccttcataagtaggatgaatccatagatgcataattaatttagctgtgtcctcgcttcctgtaaaatacagcatggggtaggaaaaaaaaaacaaacaaacccacatttccaaatgggaaagtcaaagcaagtcagtcccaagtaagctgactaacatttataaagtaattctcatccttgtaaattgccttcttgcaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaataaaaaaaaaaaaaaacctccttctaccaggaggcagtagcacttacaaataacatatgtgtacaacatatgcctattttatataaaatacatgatttaacattgtattactatgacaaagagataaattaaaacacctctttctcaagaaggccaactgcataatatcatgagatgtataaagttaaggcaactttatgacacatgaatccatttattcattacagatcttaaatgcagaactgcatagatttttcttagattctatgtggatgtgcaattgatgtgcatagtattaaaattgttagcaacaaatgatgcaagcagaatctgctttttacctctttagttaattattttggaaatgatattgactcacagttcttggataacaataaataatagtttctgggtagagtggcatacaattcagagaaacataaaattcttctggaattaaaaaaaaaaactatgtgagtgtgtcagtgttagatgatataactaatatatccttgttatatttttaatggaatgtgtgtgcttatgtgtgtgtgtgtgtgttgtgatagactaaggaagctaagtatgctatgttagtaaacacttccaaattctctgtaaataaaagtcatgaaggtttcttcttgtgtgtcagcaggaggctccactgatcactgtcagtaaggaaacaaggctagttgagtagccagtatctccatcatcatgggttactgtgccagaaagtaataatagctgtggagggtctacatgggcacacacatgcttctgcttgggaggaaggctcattgttcacagttcattgtgcggaattggtcacacagtcccacccaatcacagaatggacagtaaagaggaagggctgtttatttggaaatcagcataaatgatgtccagaacatttgaattatgttctttgctaaaacactaagtaatatcccttgaatatgttcaaccatagacactccttccaattaacaaactcttctgtaatagttttaaatctaaaagtgcttactttgcttatcctgaagtaaaaataagttagacttgacaggatggaagtagccatttcattctttaaaatccatttaaatcaagtaatcattatcacatgagaaaagtgaaatatttctgtgatttggggtcagataaaatatctttatatatgtattaaaaggaggttttaaacaaaatattccttctgtagaactgcctatctttactgtacccacaaaattttggaaaatttccacctatgttttaaggatgaagtgaagatacagtttatgtgcatggatatttatatatgactatttatagagttttttgaattagtttatgtgtgtatgtgtgcgtaaaatagattcacagatttattaaatgccacataaaatgctgacacatagggaatgtgctaaaaaaatacatttggacgtgggggcatatgttgaagttgacatacatacccaaagaaaagataattttccttaagtagaaaccatctgtaacagcaaggtggctagagtgcaaagaagatggatgggttattgctaagaacagatgtgaccaatatttcatgctactggctcttgtttctcctgtctgcattccccccagtggagtgaaggaatagtttgagtaaaccatcctaggatgtgacatcttcacctctaccttttccacctgttctttccaggggtgtactacttttgcaatgttgactgtggaacaccagagttagcaatggcacagccacggcattacttggagaaatttcaacacattttctacttttgagcttgctcttatctagccagctttgggttgaatgtgtctgctatacagaaaacttagcaaatttgaactcgagttttataatgcaaatcaaaaaggcttatctttaacaacttgctctgcaaacaaaatttcctatcttcattctgatcactgatgtaatgattaattgatgaaatagtgtcttaaatctctgtccctccccttttgtgttacccagatcatctccttgacaatcaaatgttccattaaatcagtctagtggaaaattcctcagtgcttgtctccttctggcatctagagaagcaaaggtgtcaggacctctgaccttgaggctgtcacagtcaaatatacagcaacgttccccaaagcacaaacgaggtgcaaacaggcacatttgggggatgtggtagacaaagaatatggcttatgcagtttaaggcataatcttggcttcttagctccatgcagttttgtaaagtcagctgaactctcactcttctcactgttttcatccaagtctttgaaactgccctctcttccagcatatctggcttagatctgctttcataaactgctgctttctcagccactgctcttgattaactccaaatctctccagctctttgtctccaccctcattcagcctttctttcacagattcctgaaccctggcaagcctgtcaccctgttgttcggttttctgccaatcaactcctggctgattctgaaattagcattcacaaagcccacatttgcatcacacatacataagatatctccaatctacagccaaaggaagacaagtataatatccatataattgggacgaggggctattaatcacacagcttccagccgtgcagaaaagactgccagaacaccataatgatgagccaggtgtgatatttcgagctttctccttctccagccatattttcttctggttagcatcagatagcacattcaaaaagaatacagatgtgcacagatttaataaaaccaaaaattaaaaaaatccacattttcaaaatagataaaataaatgtatgtggggagagccaaggaggagatcaattggggagatattattgttcacgttacagaaaaattaatcggatcctttcaatgtgtgattggaacagcatggattataaaatatgttcacatgaattaaatcttttgattgtgtaacagtcctctgagggcagcagaataggttaaaagctcttcctaagatattttagctaataaatagggacaatgaacatgctgtcatagcaaggttgggaaatagtcttcaatctgaatgccagcagcagctgatggataatggattcccggagtgtaaaaattcagggttcttgagcagcaaaggatgccatgattgattagctatgtctgccacaggtgaggggaatgaagagggatgtgcctcacatttattatgcacatattatactttacttcctgtgataaaaacaatgaacagggagtgtgttttacaaacaaatgtgcagaaagaataatttatatatatatatatatgtaagctttctgttttcccacagccattagtgttgacttagaaacagtgtacaaatgagcagggaagccatggatgacattagaaaaggttctaatatctggtacctggttcatagctaaaaatagtttaaagtcaagttctccttcggttatatctattccctattcagaaaactctctactttgtagagtgcatgaaatggtaaaaattatttttcaacagattgaggaaaaaaatgtagataaaatgcatacattggggtcagtaaagtcacagatgtgtttagttatgttgttaataatttatgtttgccatttgtctggctaagacttactgaggataccgttagtgaagaagttttccaaactttgaaactctttatccaagtggacttgaggttgtgttgggaatggcacatgggtgtttctttggatgtagctgatatgtatgttgtatgcatgggagtggccttattgtgcatgttgctgtttgatgcctcttttaatctggaaacattcacaaagattttatttttaagatttgaattctgacttccacgtcacctagaatattgccattcacgttttacatgttaaatctaagttgtgaacttgtgtagtttgaaagggatgagtgggaagtgatatgagctgatactagctactcagcagtcagaagtggtgtggttgccatggccatgggactatcctttgttacatttatttgaattaaaaaataaaacagtattttaaaggaaaaattagtttgatttgaattgattcacagtagataatgatttcatcatttaaaagttatagattttggccaggtgtggtggctcacgcctgtaatcccagcagtttgggaggccgaggccactggatcacgaggtcaggagttcgagaccagcctgatcaacatggtgaaacccatctctactaaaaatacacacacaaaaaaatagccaggtgtggtggtgcacacctgtaatccccgctactcaggaggctaaggcaggagaatcgcttgaaactgggaggtggaggttgcagtgagccgagatcatgctactgcactccaacctgggctacagagcaagactccatctcaaaaaaaaaaaagttacatattatgccatttttcaaaaactaaattagccagatctgcagcttcacagtttgacaaaaaatatacccaaaacgcatgacttcttaaacagatagaaaatattatttcaaaaaacatatattgaaattaaataacatttcagtatttcccaaactgttattatatacatcagtttgaactaggtgactataggagaaagaagtaggaatataattaataattgtttgttatgtcttggtagtatttttggtgtacttcccagaaattactgttgcaaattgggcaattttcaattctttgctttcattaaaattgaaggaagacctaatagatttgtcagttggtagactatctgaaataaattttgttataaataattatgtaaactgtggcatgcaaaaagttgctgccgttgagtgtcatcattataatgaaaagccttcaatgcttctctatttagagaacaagatttttcaatgcttaaaccttaaggagaaaaaaaacctagaaattgaatcgtccttaattctgtctcattctagtgctaatgcttggtggctcatgcctataatgccagcacattgggaggctgaggagggtggatcacttgaggtcaggagtttgaaagcagcctggccaacatgctgaaaccccgtctctactaaaaatacaaaaatttgctggacatggtggcggatgcatgtcatcccagctactcgggaggctgaggcaggagaattgcctggacccgggaggcggaggttgcagtgatctgagatcataccatttcactccagcctgggcgagacagcaagactctgtctcaaaaaaaagaaagaaaaaaaaaagaaattcatatcaaataaaattttattttatacctagtagttttaatcaatatttataataatgttgttttgatcaattttatataacaataattgtgttgataaacaagaatacattttcaacacaatgccttatggacatgggaaaaaatcaaatttaagcttatacatatttaacatatatacaaatttatacctatacatagatattttctgcaaagaagtgtgatagaattatcaatataaaaatttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaatttcaagttaaaaaacattagcacaagcagtggagttcacaaagagaagaaattacataaaatgtttgatctttaaacaagaatgtatacgtgtatctttaaataaaagaaggtgaatttcaaatcacagtggtattcaaatttcattggatttatttaaaagaaaaatgtagtaggtccctttaacatctattagtattgataatgtgccaaaataaacagaccttttgcagccaattattctagtccatactacccaaagaaatctacagattcaatgcaatgtttattaaaaatctgaatagcatttctacagaaatagaaaaaaaaatcctacaattcatatggaaccacaaaacaccagaataatcaaaacaatcttgtgaaagaacaaagctagaagtatcacacttcctgatttcaaaatattaaaaaagctgcagtaattgaaacagtatggtattggcataaagacaaacatatagaccaaaggaacagaatagagtccagaaataaatccacatgtaatggtcagctgatcttcaacaaggtaggcatttaaataatgtttaaaaatatcaagcatcaattccaaatgtacatagttttcaagtgtttaattctttccaaatatatgggagcagaagggggcagtactctaagtcagtagttctctatactggctgagaataggaatttcctattcagttgtttaaaggattaccatgatatgacctactcatggaagtttgttttccttaggcttgatgtagggactacatggtacacttttcaaatttttcatcagaaatattagtgccttccctttctcttcactactgattcttctatgtcctaaattgctcagaaacacctggtgtctactcaggaaagatgattctctaataccagaatggcatcacagctctgattgctccattgactcctttttaggccctgagagtcatttcctttctgagactgcaggatcaagcctttcacacaactagccttttatcagataatgagtctgtgtatctatactgtgcgtaccgtacttctcagtaaatcgtgagttggtgtagatctggaattgaaaactaagtcttccagattcttcctagtccagtatcaaagactctacaactgttttcttaggacaaactgtcttgtgcctgcaatagaaaatagacagaatgactagccctgggcttctttccctgttcccatggtggttcaatagctttgttacatggcttcagttatgcctactactccaactctagttctcctgtgtaccagaaacacaaacctgcttgtcaaaagatagtaatccagtaaacaaaataaatgtgtttgtttttctgtaacatcagaatagtttataaaaatagtcacaaaaatatgggaagaagaagcaaataccaatgtaaatagagagttttccctatggcaatgttactgaaataggagaatgaaggtggtaagtagaacagggaaaggacatttctgggcacagctcagagttgcaaagcatggataaataagcgaagtcccacagactaatttcagaaccttgactggatccatccctgaatagtaaaaaatattattattactgaatagtaagaagtaagttgttgttacttctgaaatgggcacaaatttaactttccaatctattctctattcctctaaataataataaattcatgtgaatatcatcccctttggagtgtaacaccttgattgtaatgtcaatcaagttttggttaaagtcaacagtatacaattatcatgttctaaattttatttcactttactactgaaaagtgcagttgtaaattggtgagtggttctgtgagcaaagtgcaagaacttaaacagcctctaaagtcagattacgtttaagatttttttttgcttttaatattctcaggtattccctatatgcaaatttagtaatataaggtaaaatattcacagtctgggagcaagaatccttaaatcttatacccagttgtataacaagctgttttgtaattatgaactaaatgagataatgtttaagaaattgccttgaaaacaataaaggtaatgttatttattttctctttagctcagtttcttccactgctcattgagaatactattagcttttcaggccaactcacagtgacatacaaaaattaactaaatcctactaaatttacttactccccagatagaactgtgattcttaaagctagtgtaataatatttagtgtagttcaccactatcctacacagcagcaaattttatcccatatcaaccattattatcaggatgcaatatatttttctatgtgtactgtttgaagcatatcacattctaaggaaatgtttggaaacatcagggaataaaaatgccaacacatttaagatagtagtaaggattatatgttgcaaaaaaaatcaccaataattgtgttttcttagtaatgtgagatttaaaagttgaaattgtttgcatacaatgttgtgcaataaacaatgtatgatcccatttttatatttgattttataatcataaaattatttcaggaagaagtgaagtacattaaattataagttatttcagaaataagtaaagtatatgaagatatattaaaatacagtattttttgaaagacattacaagtttttggccttgaataaaaggtcagcatccttcttcataatactgtatataatattattgccttttaggatgattttccagtcatgatcagttattatgatacaaatttcttaaaaatatatctttgatggcaattttctcttcatgagaacttctaaacatggtgataggacaataatagtaggatatgttagtgttttcaaataagagcaaggaattctcaaaggaagggtataaagatgacagctataagatgagggataatttattgttcagtatgttatacttgagggaaaaagaatttaaaatatgggcagacacacttaagctaaataatttttacacagtaaaaaaagagccattggtgacattccttctgtaccttttgcttttaccaatcttataaataggatcgaaaactctactgttcccaacccacacattcttctatataacaagatatctgattcctagttcttattattctcttgccttttcctctcctcatggcactgtggctgcttctgtcctgactgccatttgtttctctctgacacttgtcccgactgccgttcattttgttagactcctatcaagcagtggccctgagagtcaaggccataactttttatatacatatgtttactacgtgtaatcttctaacttagttcatactattacactttattatactcaaggaagcagttatttgtcacgtgattattttggttagtgctaattgcaaatatggctctagagtcatggactgaagtagagtgtcctgtcttcaaggatattttgagtttctttatctcctcttatatcctgaaatttatgagttattccattctcctttattgatttccaatagctctacctcttaagtttgattagcttatcatcaacaacgttataaatagagactattcctttttcctctcacgacctagtgtcttctagcaattcgtctttactttccctaccccctgttccataacctaattgatttcttcatcagagaataatagcaggttctattttattttttaatgtcttagtttttcaactcatacgcattctaatttcatgccatcttcttagtttaatgccatgtttaggttgattcagtcctaccatacgatatgttagcataaaaacaatttttcctgaaattatactgtgaggtacggaaaacttccatgtcagtgattcaataattgttcacgtatttctcttcagcaatgtcttttttcgcaaacagaaatgtctgtgttgcttacaatttaaaaattagaggcaggttgtcaaaggaagcttgataataaaaatatagtaaagaagtcaccaaaatagatgacaaaatgtgtttggccacatctttattgtcctttaattgtgactctgggatctgaattgatatgacatagccatgtggtactcacatgttctttggttcaaacttgtggccttaaaagcttcaaagttgctgtgatcatttatctgggctgatttggaagacccacatcccggcagtagtatggatttttcttctgggcaatatattgtggcaatataatagggtgcacatgacaacttatcaccaggatagtatatggagtaatggatcatagttgctgtcttggaatacaggcagaaacttcattagagtctggatttaggataaccaatggcattgtattcttccatactgttcaactgcttagagttagaaacaggtttacattcattcagtcactcaacagatattcactgagtgcctctgccctgcattggtatgaagcactgtacatacaggggtgagtcaaagtctttgctgtcaggtaaattaaattcttgtaaggagacgcaaatgaatatctatagtatgttcagtagggtagctgctctgctgatgaataaaataggataaggtaaaaaagagccaaaagagaatggccagggaaggccattctgtgataggtgactttagagctaaaatctgactgcagtgaggactggcccatgtggatatttgcggaaggagtattataggtaggagaacattcagggtagggaactctactcaggccagcattatctggagctctgaccaggtatagcctagtctgcagtcagtaaatacatattactattcttaaaaggaagctagcttacatatatttttcttcttccctctttctgacttcttaaattctcctctttcattaaaagattccccacattctttcagaatctaatcattctctccacctccgtttctcacattttttggcattacatttatttttcaactttttctatccacctcaccatattccatttatctgtttccttctgcctgacaagcctgacattgagcgtactgctccccctctcaagtcttcccctttctgtcctcctctccatcactgtcaggataaatatcatcatccccatttctgaagactggaatcatgctgtcatcttcactctgttttctatctcctcccatgtaggttggtgcaaaagtaatcgcagttttgccatttgaaagtaatggcaaaaaccacaattatttttgtaccaactccaaaataatccaaatgcattactatgtaactaaattttagagaaatgttagttacttgattgctagaagccaatatttttccaagtgtttctagaaaatcactgttgttactcatccattcgattataaaacctattctccagaatcttgttgatgttaagtaacatttttatggtagacaatgccttgccaaaggttgattggcatgactcattatcatcactcttccctctgtacagatgagttcatataaacattggaattttcaagagtgtttttaaaagattcattcagtgagaaaagtatagaataatattaataaaatttgattttgtatagcattattttaaacatagtttatagaaatcttcacatacaaattattgtgatgtgttcaacaactccataagtgagattaaatctgagtgccatgagcatgtgtctggaaaaattatttgatcatttaagttataaattaagaatcactgaaagcacaattaaatatatctgcaagaacatttacctgagattaatctttgctttctgtgtgtgtgtgtgtgtgtgtgtgtgtgtgtgtgttgcataatagattttttcttttatatcccatatgcttacagatgttaatctccagagaagaacaataattctctcaagaaaggtggtttgttgcctggctttgtttcactgacacccagttggaagctctgatgacaaatagtctgcccatcagctttgcttcatgaatccaaagaaaatggaacttatcagaagctgagcctcaagctttacctgtgcctgttatttgggccttttcacgctaggtttggcaggggtcttagtctttcatcatttggttcaccaatagaaagagaagggagcagttgcacttttaggtaccactctgcagactgctatattgcaaaataaacaaacaatatatttttagggcaccacctgcagcaagcagctgtaccaaacagagcagaaccacgaaggatgtgatttgttccatttaacacgaagccttaaggtttgagaagagagggaggagaaggttctatgtatacaacccacacatcacaatttaaactgaagctgattttctctcttttttagattggaattgaggtatcattatatctctcctcctttcccaccccacaacctctggttgaaaacaattctattattgaggttataacgttaactgagaaaattatttttctctgccagcaaactttcttttccattcaagggcaattttctctcatagcaaactatacttaaatgccaacatctgctacatctaagctgtatataaaatgatgtctggcatttacatgatgccaatgacatggttagagaaactcatacacttggcttacacaggattttcttctcatctatagctttcctctatttctgtccttccttaggatctgtctgcctctctaaatgtgccacacaagttcaaaatactctgaaagctgaaccttcagctcttattctgatcaacaatctgtttttgccttaatccatttctttccaggcataaaaactatatagagcctcatgataaaaatttcaccatccctgcactctctgagtatatagcagctgatgcaagacatattttaggtacttggttttttcttggatttaaaaatctcttcgttctcttaatggctattgattctggcctcacaaaccaaaatcaccatttcattttcagttctaggtgagctgggataaatataattaaattatagatgactctggaggcaatccagttagttacaaattgaggtcattctaagtacagaatggggcagttagctttaatattagattggccaccaagaaccatacaatattttaatgtttttcctgtcaatgagcccattttaaaaaacaaaaaagagagaagaaactgttctaaatatttatgaagtgaactagaatgccattcttaagtcttctaccacttactagattgttagtctggggagaaaattacatttcatagtactttcagatattgctctaggactcagagaagtgagatgaaagaattataagtctgcaatgatgcctccagataacagaggaaatcaaatcttgtgagccgggaagcaaagttgccttcactgtcatcatcaaggggatgatttgtaagaatattgggcatgaaataaattcttgccaaagttgtctacaggagtgtccaatgtgggaattgttgtcatctctttcacccttctaacattaaaaggaacttactgaaaaagttctcagactggattttgctaaattgtgtctgctttggaatctttgtccatcagtcaagtctctatgactattggatagtgcttttaactctgtgtggtcaaaactttggaagaagtaagagaaatatctttcattccaaagaacaaaagaggaccattagtcagagcatctttatttttcataaaaagaaaagtcagttagattgatcattcatgaatatttataatatatcagatattctttggggctctctggaaaaaagtagtaagcctttgacaatgaggctgtgtggaataagggaaaggaatagatataactgatattaaataaagttaaaaaatggcttgacaaagaagaggattcaacatctcagattattgaaaccctatgtaaaagatacagagacaaaggttaggcatcttctctaagcctcagtttcctcatctgtaataggcataactactctctaactcatttggtatttttaattgttgtaaaaaacacatgacctgaaatccaccttctcaacaaatttttaagtgtccaagacactgctgctgactgtatgcacattgttgtaaagcagatctccagaactttacatcttgcatggctgaaaatatacactcattgaacagcaactcctcattttctcccttccccaagcttctggcacccaccatcatactctctgcttctgtgagtctcactactttagataactcttgttaagtggaatcatgtagtatctgtccttctgtgatgtgcttgtctcattaagcatgatatcctctaagttcatctatattgttgcctataataggatgttcttctttttaatgctgaataacattccatgatatgtatataccacattttctctatccattcacctgtcagcagatatttaggttgatttcatatcttgcctactgtgaatagtgctgcagtgaacatgggaatgcagatgttcgttcaagattcaattttcagtcctttggctaaatatccaaaagtgaaattgttgaatgatatgatcattttacttttaattttttgagaactgtatactgttacaccattttacatttcaagcatcagtacactagggttccagtttctccacatcgttgtcaacacttgttattttctgtttggttgttgttgttgtttaataatggccatcctaacaagtatgaggtgatatctcactgtggttttgatttgtatttcccggatgattagtgatgttgaacttttttcatatacctgttggccatttgaatgtcttttttgaagaaatatttacttaagttctttgcccattttttaattgggtttttttttcactattaaattttagaggtttatcatatattttagatattaacctattatcagatatatggtttaccaatattttccactattccctaggttgccttttcagtctgtttattatttcctttgctgtgcagaaacttttattttaaagtctaacttgtctattttttgtggttgcttgtgctttttatttcatatcaaagaaatcattaccaaaaccaatgctatgaagttttccacctatatatcttctaggagttttacagcttcttaagcctttcttccattttgatttggtttttgtatatattagttcagtttctttcttttgcatgtggatatttacttaacatcatttgttgtgaagactatcatctcaccattgtgtagtcttgacaaccttgtcaaaaatcatttgactgtatatgcataggcttctttggcttattttggggctctctactctgtttcattagtctatatgtatctgttgttatgccagtaccatactgttttgattattgtagctttgtaatatgttttgaagtcaggacgtgtgaggcttctgctttgtttttctttctcaagattgtttgggctgttggggtctttttggttccatatgactattagaatattttttctatttctgcaaaaaagagccattgtgcttttgatagagatttcattgaatctgtagattgtttccggtactattaacatttttaagaatagtaagttctttcaatccatgaacatgaatgtctttccatttatttatatcttctttaattacttagcaatgttttatagttttcagggtacaagcctttcatatcatttgttaagtttattcttaagtattttattcctttagatgtgattataagtgagattttcttaatttctttttcagattatttgctgttaatgtatagaaatacaactgatttttttgtgttgctttaatatcctgcaatgtttgtgaatttgtttctaacaggtttttttgtgagacctttagtgtttgatatgggttttacagattatgtcatctgagaacagaaatattattctttcttcttttctgatttggataccttttatttctttctcttgcctaatttatcttggtgaggacttccaatacaatgttgaataaaagtggcaagagtgggcatccttgccttgttcctgatcttcaagaaaaaactctccatttttcaccattaagcatgaggttagctgtgagtgagcttttcatatatggttcttgttttactggcataatttccttctattcatagtttgttgagtgtttttatcatgaaaaagaggtgaattttgtcaaatgcttttttctgcatccattgatctgatcttgagatttttaaattccttcattctgttaatgtggtatgttacattaattgatttttgtatgttgaaccatctttacatcccagggataaattctacttgattatagcctatggtcctgttaaggtgttgttaagtttagtttgctagtatttgttgaagatgtttttgttttgctagtatttgttgaagatgtaaacatcgatgttcatcaggtatattgacctatagttttctttcttgtagtgtctttttgtggttctgatatcaggacaatgttggccatataaaatgagcttgtaagtgttctctcttctttaatttttttgaaaaagtttgagaggcattggcatgaatagttccttaaatgtttggtagagttaatcagtgaaactgcttgttcttggacttatgagttattgctcagttcagattttctatttcttgataattaagtcttgatagattatatacttttaggaatttattcatgtcttccaagttatctaatttgttgctgtataattattcatggtagtctcttataatcctttgtatttctatcacattcataatgtctccattttcgtttctgattttgagtcttcttttttcttttttatcctaagtgaatgtttgttaatattgttgatcttttcaaaaaacagttgttagtttttttgtttttttaatatttttttccattctctatctcatttaatgtttactacttccttccttctgttcaaaattgggcttattttttccttctttttctggttctttgagttgtaaagttacattgtttgtttaatatctttcttcttttttaatgtatgcatttaccactgtaaactgctttcttcatactgcttagctgcatctcataagtgttgatacgttttgtttttatttttgtttctcaaaacattttataatttcccttttgatttttcctttgtcccgttggttgttcgagaatgtattgcttaattctcacttattcatgaattctcctatgtttcttttgctgttgatttctagcttcattccattgtggtcagaaaatatttttggtatgatttcaatcttcttaaatctgtcatgacttattttgtgacctaacatgtgattcatttggagaatgttgtgtgtgtgcttgagaagaatgtatattctgctgctgttggacagaatgttctgtatatgtcttttagctccattttgtctatattgttgttctagtcctctttttcttatcgactttctatctgggtgttctatccattattgaatgtggggtattgaaatctcctactatcatttaattgctgtttatttctcccttcagttcgtcagtaactgcttcatatatttgagtgctctgatgttggatgcataaatatctataattgttatatcttcctcatgagttcaccctattatccctatatagtccttctttgtctcttgtgactatttattatttatttatttttagagacagagtctcactctgttgcccagcctagaatgcagtggcacaatcatagcttactgcagcctcaaaatcgtgagctgaaatgatctcccaccttagtctcccaaagtactgggattataggcatgagccaccacaactagccttcttgtgacaatttatttaaagtctattttgtattctataagtatggcccacccctacacttttttggttaatatttgcatggagtatctttttccatcctttcacatttagcccatgtgaatacttaaacctaaaataagtctcttgttatctcaagatccagcattaaattggatcttgtggggtttgttgttgttgtcgttgttgttgttttggggtggaggacagtgtctcgctctgtcgcccagactggagtccagtggcgtgatctcggctcactgcaacctctgcctcctgggttcaagcaattctcctgcctcagcctcccaagtagctgggattgcaggtccacgccaccacacccagctaatttttgtatttttagtagtgacaaggtttcaccatgttggccaggctggtctcgaactcctgacctgaagtgatccacctgccttggccctccaaagtgctgggattacaggcgtgagccaccgggtctggccagatcttgtgtttttattcattcagtcatttcccatattttcaaaaaggagtttaatctgtttatatttaaagtaatttctgaaaaggaagggcttactattgccattttgttaattgttttctcttggtcttgtaggtttttttcatcttctttcactcttacagtctatctttatgtttcattgactttttttagtggcatactttgacttatttctcctttgtgtgccttcaatattttctttatggttactatgagatttatttaaaacatcatataggtaaaacaatctattataaactaatcacaacttcaatcaaatacaaaaactactttttcatcacatacacattatgttactgatgtcataaattacatctttttatactgtgtatctattaacatatttttatagtaatagttatttttgtaattttgtattttacttctatgtcagaattaaaattgatttatgtaccattacagttttacagtattctgtatttatcccttatgtatttacatttacccatgatctttctattttcatatgcttttgtgttgttatctagcatcctttcatttccacttaaaggacttcctttaacctttctttttaaggcaggtctagtggccataaactccttcagtttttctttatccaggaatgtcttctttttccttcatttttgaatgacagttttgtcagatttagcattttttgctggtagtgttttttttctttcagcactttgaatatattatcccactcccttctgagttgcaagatattttttagaaatccacttacagtcttatagaaactaccttgtatgtgatgtctcttttttcgtgctactttcaaaattctgtcttcatttgacttttaacaatttaattatcatgtgtctcaatgtggatttatttacattaattgtagttggaactacagctttttgaatctgggtgtccatttccttacctagatttagggagtttgggggcactattttttcaaataagcttacttttcctttctctctctagtctcctcctgaaactctcataatatatacattggttcacttaatgatgtaccataagttccttaagctttcttcaactttcttcattctttttttattttctcctctttctggataatttcaaataaccactctttgagtttgctgattgattttttttctcatacctgatcaagtctgctgttgtagctttctagtgaatttttcaattcagttattatatgcttcaggtctaaaattcatttggttcgttttaatatttttcatctctttgttaataatctcattttgttcacccattgttttcctgaaatactgagcatctttatgacagttattttgaattctttgtcagaaattttatataccaccatagtttggagttcatttgtggaaattttcttttgctcttttgattgtgccatgtttccctgtttcttcatgtgccttgtaacttttgttcggattcacacatttgtcaaagtagccacttctcccaaactttaaaaactggctttgtacagggaaagatctttgttaatcaacccacctacagactctgacaacttctcaaaccttttctatggatgaatcttctctggactagtgtgtgtaaatttcaaatcagagcgatttactagtttcattttttccagcagtttgtgttctttcactcccttggtgcatgtcagaagtaccaaaggttctccggagtgatcatcagatgcctagctgttttattctctgtggtccacaggcttctcgagtatactaggtctcattaggactccaagacagtcaagagagaagccagtccctggacagcccacccccaaaaaataatcctgaatattgcaaacacatttcaactctttccctcccctggaagaagccatgtcttggggttttctcttgcccattctaccctgaacccgggacaagggtgggactatgatgcataagggtgtgctagtcctaagcatcacttttttttcagtgacgctcaaattggtgcccttttctgtcagtacttacatttagacaagacagaaaccagtgccttgggcagccctccaaaaagtatgaatgtcggacatatttcagctttctccttccctacctaggaagaagccaggagctggaggtattttcccaatcatactatactgagccaagtggaaggactgtgatgaatgagtgccatcgatttttctggctttgatgcagctagttttgcaatcacctggggtttagcagtctcttaactggtttgttgattactcacagaaagaatggatccatgtgttagtcattttctccacagaggaaagagagcctgagaatttttattctaccatctgatgatgtcactatccctaattcattgtattttgtgggtgagaataaaataaataatggtttttaaaagtctctatttttttcacagaataggtcttcagtaaatattagttgttttgttgtaattattgttaataatgtgtgacaggaactaggcaggtttatatggaaaaagtagaagtagtgaccattcaggatttttacatgagagctgggctattcaaagttgtcagttgataaatgagtctgaaatttaggcaaaatttttaaatgtgatgtgaaagataacagaaaccactgtaagtgtctaaatagataagaaagcaagagatatcattatttattacgatgagccaccaaaattttcttataattctcttatgtgctatattttctattaggcaataataacaaattgttgtttctactatactgaaaattcctccataataatctggttgtaaagtaacctaaggaagaaccaaaacttgacggctatttgaatatgggaccttaagaaagaataaatcaatcaataataatgtttaaaatttaaggaatgtgtttcccttaaagatttactgcagacctccttataaaggagaagccaagagatgctgtggcagttgatgatttgatgagtcaaagacagaatcagtatatatctatgagtggaattgacatctagttttagtgtcaaataattagatagcttctcatgaactcattcaaagctggttgagagccttttaacatagaacactccgttttaaaaatgtttacctgagaataaatgttttgcatccgtctttacagtccacctaggaactggcataaatgtcagagttcctacatacaggaaccaaagtcttagattttatgtcttagtggtatttggctatcaggtggctctccctgaacatacaaattaaaatatatttattgattcaaatactgtatatatgcatatgaaaaataatgcaaataataagggaattacaagacagcccaggattttttcttgcttttacttcatactctcaatggacaaaataaaggttaaatataacaaattacttgaccactgcagataatatttgcgctgagacagaattgtaagcaaattttaaagtgaccgtcctttcccttaaatgttcaatgagatacctaactttaattagataatattcataaaataaatgagaaagaaaggaaaaactaggcatatttaaaatatacttctacttagtacttttcttaatatataaataaaaaataatccaaaatatgcaactagatagtagcatatgagaaatgattctagttaatcccattctaaatattactttcaggatgcaaaaactgagaacagtccatagagattatttagtataatttctttgttttatagatgagaacactgagtcatacagctgaatccttccagggttaggacgataagcactttacagatctatattcttcccatatcaatcattgtattgactctagtgttcacatattattttattagcatctaagaaatataacctagggctctacttatatatttaatttcaagtccacctataaaacagcaggaatttattttaactttttttaacatctgtcttctatcctttctacctcccactaagaatatcatcttctttgatataaatcacacatctaactgtcttccacttctttgggggtaaatgttattaaaaataaacaaacaaacccctgattgaatataaattatatgttgttcaaaatctctaagttcagagaataattaatagcttgatgtatcatcttggtgtatgattaatcttgttacttaattgctattttcagataaatatctttgtaccctttgacttatgcttgctgcagaatgatgtagttttcagaggggtgattatttattgttatgccattctggttactttgcttattgccaaagtatatgcatagtgtatgtgctctgctgctatagataggaatgaagattggagattgagacatatggggatagagaaagtgaatgtttgggaaatctaaaattggatataatatagaatcttactggcttctatgtgagaaaatcttctatgtttctgataattctatccttctaagcaccctcacctataaacaggtgggaaaccagaaatagaaataaaaatttaagagatcatttaaatgcagaactgataccttgagcaccagtgaagcaaatttgcaaagaaaccatgaaagaaaggaacagagggagaagaaaatattacaggaaaggcaagagaagggtgagaaaaatagaaagagtagagcaaatactggggataaaaatgtaatgtacatatttttcaaagaatcagagatttacttcaagttccaaaaatatttctgaacatatataaatccaagcttttcattttcaccagtaaaaaatgttttttttttacaaataaaaattattagtaacacagttaaatgaaatggtgaacagatttaggggacaaataaatgatcatgaaatggctaatctttaaacagccagagagctatgatcagagaactaccaaattttaatgactagttcccattataggaaggatgaccttgtagtcataagttagaaaacttcaaaaagcttatctgaaaaagatgctggcactatataattgaaaaaggtcatggtattaatctgttaaaacattcatattctgtaggagggtcacaatgtttgagtaggagcataagattaaaaatattttattagcttttagattttgtgacgtgaagtactgacagtagagccagtgtttttgtaagaactcacaaccacaggatatcattattttaactcagtattaagtctcaaaaagaattgtataagtaaaatagtatctaacatcaacttcaatccggaaggaaaatgctaccaatatttgtgataaaatacaaacaaaatgtgctgaacttgagtaaatttttccacttgatctacatttcaggacagtatcaattaatgctctccaatattaagattgatatattggaacttaaaaaaactcatcagagaattataaactctataaaacaacgtcttttttttattttgtgagtagagattaatggaatcacttcaatcaccctacatatggaaggcccagctaaaaagattacctctttgctttactcaggttctcacttgacatatcaaaccacgtctgacgaggaagtggctcccacagctctcctgtcatgcttccgaagtcgtgggcagtgataagttttgactgtgcagccagcatatgtcatgataaattttcaactctctaaataaagaaaatacacactgttcttggatcaagattaggcttggttttccacccacctttgtcctcaaacacatttgtaacaaacataagtaaatacttgacaggtgaatatcaccggtgccattaactgaaataaaatgaaccatgagtagaaagtgttaattcactatttcaatcacatcccattcgcagaaaaaggatcacagattctcaaccctttaaatgtaaccatggagagcagaaaattccgttcctgtgggcaacaagataagtctatgtgatgccattagggactttttaatgagactttctctatattgctatgtgttgtcaaacgtctacgtttatctaaatgatctccttggccagacttaaattcctacattatttctctgctgcccacatgtcaaaatctcctccactcagagaagttgcttttcctgcacacagtttactggaattagggaggttgataatgcatctaccaagtagagtccatgtgaagggctcagagaaatagaaaccccatatagaggagaagattctgcaaggctgagcagcacattacatgctttcatcagcctccagggtgcgtgcttgaccagtgtgcgtgcttgactagtgtgcaagcaccttgtttgatcccccccaccctgctttagcacatgaagagccaacaccgacctctctattcactcactcaagcataagcattggcttcaaatgcagagacaaaaggggcagctgttcttattcacagcaagtaggaaaaacatcactatgcagagagatttgggacttggcagtaatggcgagcccacatggttctggctagtgtgtataggattcagcatattgtggaaagttgaggctccctgcaaaccaataagtctcactggatttctaaaggagaacaggttctttacatgtgagtccccataagaaaccattaagtttcaaaacaataacaacacataaaccagtaaattaggggtgagcatttacatcataaaattaattctttcttgaggattcagctaaagattttttcttagtgatataatatggaatttaacatacaacagttttaggcatgtaccaattccataacattggttacacctgcaatctggtatcttcaaaggcaataggaaaataaatacatgtctgctcgaaattttgtgtttgcatgaatctgttgaagatattttccattttttaaaagacataacagcagttaacagcctaatgacttgtagtggagtttagtaaatagagatttgttaaagtgtagttcttagaccaggagcaacagcagcaccagggatattgctaaaaatgcaaattctcaggctccaccccagactcctatcagaaactgtgtgatgcagttcagcaatatttttaaacaacttctccagataattctgatgcaaattaaactttgatgtccactaccttagcaaaagaaaaatgttagtaaacaatttatactacatattattctaaaacatttgctgggattaggggagtgaatagagagaagtctcataaaacatataaaaacccattaaaatctgacaaatttaatcattgtaatgggtttcttctagccaagaggatgaaagcataagttccttagtctgacacagagtctttacacaatgtttgccgtctatctctgcagcctcattcattagttcagccattcagtcacttaactagaattcattgagtgcttactacatctggacaccgagtaagtaaatagggaaatgccaataacaatagcaaaccaccctaacccccaaatacctaacatccagccccaggcattccattccctgccctttgggaattctgaaatgtgaacatgcttttcctgttctaaaatactatcctattcctccttcttgtttccttatcagaaagattcttatccatcccataagatccagctcatattgataaagtcttccctgacttcctgggtaaggttagttactttatatattggggtctcacagaaatacattcatactactatttttgcacttatcacatggtattggaagtcatttgtttacatattttaaatccaattctgaggatcagagactgacaaattcagtaagtaggaatttgagatatttctcatatgatacacaagtggcttgaagtaaacatgtggaaggtcactatagaaaatggagtaacattaaaaaaattttctacctattttagtttctgtgaaaaggtgaacaattctactttaaactaaaaaggcagagaataacaataattagtagtgaaggatgcattaaatttgaaatgtaattgcttaatgtagtggtttctcaaaatttgatccacttttcattgctcaagactgaccactaacaatttgccaatgatattacatatgagattatttgcaagaagttgtacaaagaaaatcctccaactttggtatttttatgaggataacaataaagaattttgggatatcaatgtgacagttaatgaaaaagtgattatctttgtgtctagcacacgataaaatgcacaatgaaaaaaattctatattggctatattatgaaatgctatcctaagaacccttcatctagatccaattctggtcagaaaaggcatgagagacattctagtccaactttctcatgttatgagtaaaacaaatcaagactcagaatgataaaaatatcttgactacgaaaattcagttctgctttcactaggctagaaacttcttcaccatatcttcatgtctgtattagttatctattgctgctatatcaattaagagtaacttagcagcttaaaacaacacacattcattatgtcacagtttctatggaaaagaatttcaagcccagcttagctgaattatctgcttcagtgtttctcacaagatgataatcaaagttttggccagggctgtgttctcagctgaggcttggctggggaaggattaaattccaagctcactgagattgttggcagaattcagttctgtgtgcatgtaggactgggggctttggtttctggttggctgtcaaccagcagactctttcagctcctataggctgcctgtagttcatggtcttgtggacttcctaacataggcagtccacaatattgcagcttgtttcttgacatctgcaagcaagggaaagactcccgcaaggcaggccttacatacaacctgtattagtctgttctctcgctgctataaggaaatacctgaggctgggtaatttataaagaaaaaaggtttaactggctcacagttccacagactgtgcaggaagcatgacagcttctgctcagcttctggaaaggcctcaggaaacttatgatcatggcagaaggcaaaaagggagcaaacacccgacatgaccagagcaggaggaaaggggaggggtgctacacacctttaaacaaccagatctcatagaaccctataacaagaacagcactaggggaacagcactaaaccattcatgaaaaaccaccaccatgatccaatcacctcctaccaggcctcacctccaacattgggtattacaattttacatgatatttgggtagggatacagatccaaaccatatcataatcttatgcaggtaatcctgtatatgcatcacatacatcctatccccttttctgtgttctgttggttaaaagcaagtcatatggccatacctgtgatggttaatactgagtgtaaacttgactggattgaagcatacaaagtattgatcctgggtgtgtctgtgagggtgatgccaaaggagattaacatttgagtcagtgggctgggaaaggcagacacacccttcatctgatgggaccatctaataagctgccagcaaatagaaagcaggcagaaaaacatgaaaaggtgagataggcctaggcttccagcctacatctttctcctgtgctggatacttcctgcccttgaacatcagactccaagttcttcaggtttgaggctggaattggctcttcttgctcctcaagcatgcagacagcctattgtgggaccttgtgaacatgtaagttaatacttaataagctcccttaaatatatatatatatggaatataaatattctctatatatattccatatacatatatacatatggaatgtatatatgtgtatatatgtggaatatatatagagagaatatatatattacctatatatattctctctatatatagagagagaatatatatattctatatatagagaatatatatgtaatatatatattccatacatatacatataatatatatattccatacatacacatacatggaatatatatattccatgtatgtgtatgtatggaatatatatattccatgtataccatatacatacatggtatatattccatatatacacatacatggaatatatatattccatacatatacatacatggtatatattccatacatatacatacatggtatatattccatacatatacatacatggtatatataatatatatttataatataaatatatattatgtatatatatttatatgtgtgtatgtatttatatatggaatatatatagagagagaatataccatatatatatttgggctatatatatgaatatagtgaatatatgaatataatatatataatataaatatatatgatatatacacacacacacacacacacacacacacacacacacacatactgttctattagttctgtccctctagagaaccctgactaatacaatacccatacttataaagtatgcaatactggagagaggaatcatgggggccctcctagagtctgtctgccacaggatctgatagaacttccatttatttaaacatcctgcctttttatcactgattaattcttcttcattttttgcttccagcaaccagctattatgcttttgaaaaacaatttactaaccatcattattcatcacaggtcaatttttttctaccctgaggatgagtgtcatttggatagaaaacatttctaatctcccaaatttgatgataacactgagtttctgttaatttactttttttctgctgttctgcaagcgttaacaaatataacagtataactaagtgttaatccgttaccacattcagtgctttacctcaccagattttatatttgtatcatgtactctgtcttgaaatctgaatgtatctttttgagccattcctttttctgattctcccaggcctgttttttcttattaaatacatttttagagccattttagattaatagcaaaattgaagaaaggtacagagagttcccaagtacccctgcccctccacatgcacagcctcccccattatcagcatcctccaccagagtgatacatttgttacaattgatgaatctgcattgagacatcattatcacccagagtctatagtttacattgtggttcactgttagtgttgtacattcttttggtttgtaataataacatgtatctaccattgtagcatcatatatggtattttcactgccctaaaaattcaccatgctatgtctacccagccctccccctccatcctttctaacctctagcaactactgttccttttactgtctctatacttctgtcttttccagaatgtcatatagttgaagttatatgttgtcttttcacattggcttcttttactcagtaatgtaaatataagttttctccatatcttttcatggcttgataattcatttctttgtatcactgaacaataatccattgtctggatgaaccacagtttatatatccacttacctcctaaagaacaacttggttgcttccaaatttgggcaattatgaataaagctgctataaaggtctgtgcacagattgtggtgtggatttaagttttcaactcatttgagtaaataccaaggagcacaattgctagttcatttggtaagagtgtatttagttttctaagaaactgccaaactgtcttccaaaattgctataccattttgcattttcactggcaatagatgatagttcctcttcctccacatccttgccagcatttgatgctgtcactgttctggattttgggcattgtaaaaagcgtgtagagctatgttatttttgtttcagcctacatctccctgatgacatatgatgttggacaccttttttatctacttatttgacatctggatgtcttctttggtgaggtgtctgctaaaatctttggcccatttttaccattgagttttaagagttcattgtgtattttggattgcagtcctttatcatatatgtttttggaaaatgttttcttccatactgttgcttttcttttcattctcttgacagtatttttcacagagcacaaagttttaattttaatgaaaagcatcttgttaattctttctttcatagattgtgcaaagacagtgtcatgtctaaaaagtcatcaccaaaccaatgtcatctagattttctcttatgtcaccttctagaagctttatagttttgcatttttacatttaaatcttgatttattttgagttaatttttgtgaaaagtaccaggtctatgtttagattcattctagattcatgtggatgtccaattgttccaaatccatttgtggaaaagactattcttcccctattgcttcgtctttgtttctgtaacaaagattagtttgactatattatgtggctctatttctggactctttattctgttccattgatctacttatctaatctttcactagtaccacactatcttaatcaatgagagtaagtcttgaggttatagtgtgtcactgctccaactttggtcttttcctccaatattgtgttgtctgttctgagtcttttcctctccatataaagatttgaatctgtttgttgacattcacaaaataatgtgctggcatttctatttgaattgcattgaattcatagatcaagttcagaagaacagatatcttgaaatattgaataatcttatccatgaacatggcatatttctccatttatttacttctttgacattttaacagagttttgtaatttttctcatataaatcttgtacatattttgatggatttattcctatgtatttcatttttgtggtgccaatgtgaatactattgtgcttttaatttcaaattttacttgttaattgctggtatataggaaaacaattgacttctgtttattaatcttatatcctgcaaccttgctacaattgctatgagttcccaaagttttttgctgatttctttagattttctacatagagaatcgtatggtttgcaaagacagttttatttcttccttctcaatcagcataccttcagtttccttttcttgtctcatttcattatgacttccagtaaaatgttgaaaagaagtgttgaaaggggacatatttatattcctggtcttaggaattttctagtttctcaccattaaatatgatgtagctttttctagatattctttatcaagttgaacagtttaacttacatttctagtttaatgcctcaggattttttacccataggagaaattgttcttttcatgtcatttttttgccacagtttggctcttagtacgtattctttctctacactgtatctcagatggaatcttcctccctactgccaccactgctgtctcatcacatctcacctgaatagcatagcagctttctcctcaattcaattgaatgcacttcctctctcttctgttctgttgttccacacattaaagtcacactttcctcctaaagcactggatttattttgtcacatggctttcttttgcctgtcatattagaattaaatatttaggatctgttatccattctctccaatctaccctcccagcttttcaatgtgcctggagtaagtgtttaagatttgtaggaaggaaggaatgaaggaggaaggagggggaaaaacagaatgcaaggaaggcaggaggttaaaagttgtaactttttatatttgttttatctccacctatgctttccaaattgtgcgatagaaaacactgcttttattccaagcatgtcattacacttgtttttacctccattattttcctatgccacatttggattattcaacaatactggatcacttctgctaagaaaactaaaaatcacctctctatccccattgaccagatggcaatctctgctctaatcactacactcctggaccacttcaacctaatttccatttaacctcactactctcagtctatgtcctttctaatcagcagaaaatactgctgccaaaaccagctttattgcctgccagtcctcaaaccctgtgtttgctccctgtcactactgtacaaaattcaaattcttcataattgattttctggctcttcagatgagttcctctgccgagaattcaggcaaactaaggtccattaccgccccccgccccacgtgttgtctccacttttattgtcaggttgaatagccactggttcccaaattaatttacagctttacatttttatttttcttctgaattatccaagtttactttcatttatacctctttaaaagtctactctggccaaataagaatggaaaaagtcatccacccaggattatccttagaaaaaaatgacctatttgatttttccattccaagattatcaccttactggtaacaggtgaggccctctctcacaccacctcctcctacaacacagaataagcatagccaggaaattaaaaaagaaacaaacacacggtaataaactgaaatatactttacaatatagttttttttgacgataggtcttaagaaaatcacatcacttctttctaacttctttcctgtgtcagtacactgtgatttcttcatgatcatcaaatgataaaagtgcattgttatattttgttaaaggataaaaatataaaatgcgatattcgaataaaactgaatatttggctatctttctattaaaagggcctaaaatcacttctattataaaatgtattactacatgtattaatatgttttacctttgtttaaatactggtttaactcctattagaactcataagctgtaattcacaatgcatcagaaaagaaatattccactactattttttaaataaatattttcataacggctaaaagtaggatggaagtaataaacaaaaataactttgctgtttttctcagctcttcataaatttgcatcagagtttgtagatgatacaaaaatcattgagacaaagtattctcataaaaacactatttctcaccctcccgttttgttatataaaaataaacaaagctctgtgagataaatgagcacaaaataaattgcctttaaataaggtagttatttttttcacagtcactcagaagttttattattttaatgaaggtcattatcacttcacatataaaaattacgtaacatgagggccgggtgcggtggttcacacctgtaatcgcagcactttgggagcctgaggtgggtggatcaccaggtcaggagatccagaccatcctggctaacacagtgaaaccctgtctctactaaaaatacaaaaaattagccgggcatggtggcaggcgcctgttgtcccagctactcaaaaggctgaggcaggaaaagcacttgaacctgggaggcggaggttgcagtgagccgagatcacaccactgcacacccagcctaggcgacagagcaaggctgtctcaaaagaaaaaaaaaaatatatgtaacatgaaaaagtcagttatgtgatgccagctccagtagtatcacaagacgaactatgcatttgatacaggaaacatttttatggttttaaatgcccaacctattgttggagcatttagtataatttgaactcatcacagtgaacattatgcatcacaatgcagatgttaaagaaacctgatctggccagtatttacactgaacttctatctcaaatcacattctttaaaattatccattcagaagtgtgctaagtaaaaacagggtcgtttgtatagaattctcctgccttggggagtacatttatgagccacatgacattttggtcaaccacagaccacatatacaatgttggtcccatagattataatactgtttttttctgtatgttttctaggtttagacatgtttagatacacaaatagcactttgttacaattgcctacaccattcagtacagtaacattttgcacaggtttgtagtctaggagtgataggctataccacatagcttaggtgtgtagtgacctataccatcaaggtttgtataagtacactctgtgatgttcaacactgacaaaattacctatggatccgtttctcagaaccatcgctaaatgattcacgactgtttactgtaggttggagagaggcatttaaaccaaatattccaaggtgatgtggtaggtagtgttatcgaaaaaagcccagataatagggtgactcagataaggaacacttaactcacccttggaagatgagagaaggcaaggtgaaggtgaggtacttctgtctgagccttgaaggctgaggagttattcggagtagtaggtgaaggggagaagggaaagggcaggcatttcaatcaaacacagtttggcatttgtgtggctggagcacagggagtgtcataccagaggaagccaaagaggttccagatgctggatgtggatgcattagcacactgttctttacatctccagttagttagacccttcctgtcttaagacccatagagaaaatgcaccttatgaatccaagcgggaacagtatacaatataaagtcctctaaattgcatctgtttcagtcctgcctacttgcttgtaaactgtaagaaaaataaaggtccatttttaaaataatttgtaaaacacatttttataaaagctgtccttgccataaaaatcagtaacccaagtcaattaccctaaatctgcatcttgtacacccacattccaagtgtttaaggcatttgtttaaaagcacgtttgcatatatgaatatttaacatagagtatgtaattaaacaagtctatgtgtgtgtgtatatatatttactgagcattatctttagcagaaaataatggaatgttcttcaccctggcattcatgattctgttgtcctggcacatatggtgagtaggaatagtacttgaggctcactcaagcagtcgctttaatgaaaccatcacaatcaggcactctgcaaagcagtattctgttcctctgttcattaaatccaccccccaaccctttcaactttgcataaattgcataggcagtgttatttaccaattggaaccggcaggagtaaattagcaccggctgattgagagacttttgcccagtgaactttatgttcccccattgaatccatttattgttgccattcctgctttggaatatgacttccctagaaagcatttcttcattcagcctctgtgctggaaacagacaacagcttgaatccagcagctgctcttgaacaaagcaggtagagaggcaagaaaggctgttgaataagcgcatcatgacataattacagtaaatctccagagtgacctgcacacattcaatgccatatggttatttttggtgctagaaacgtgtagctggaagccatagtttaatctagtcactttctgaagcttcctgctagcatgaaattgatttttttacctagaaaattaacatgaatatttattgacagaagtgaagactatatttgcacagtcagctaagagtgccagtaaatttaataaaaatatttgggttttgttttacccaaaagtatacaaataggtgatagaaggttttgttttcttttgttatggagttattgactttgtttgttttgtttttcaagctctagcagtacctttataatatgtcatatatgcccttaaaccatctcctcttcctcttcctccttgtttttttattggatagtgttttttcagtagtgcatggaaagactgttctttgcttcttttaatgtcttcatttgtctttaactaggtaaacaggatttactgctactgtagcctacccagaaaaaaaaaaaaaaagtagaacctcagaacagattttcaatatggatgataccttgtggtccatcagggattaataaacaaccctttctgcctctgcttctgaaaatactttagactgcagaagatttagatacaaacgtatatgtcagagagattgaccagctcagaacaccagccatcaaaactcatttaagggtttcttagggcaaatctattcttaccaggacaatagcatgaatctcagacaaatattttaaagatctcataactctcttgcaagaattttccttgaactccacttattgatttgattctgagagctttatgaaggttaaatattgttctgtgcattcacataatgcaatggtcttatattgataacagtagcctgagtaaccaaattttaagccatgtctattttaaaacgagagttctggcagatatgaagaaatctgctttgtgacttgaaaggacatttattttcagaggactatgttgcattaaaaaatatttcattttcctattaccttaagtgaaaaaggaaatggaatgcaaactcggctaaagtaggagggttcaaagaacacataggttcatataggaaggagggctgcaggaacagaaagatgtgctatcttttctcacccatcataagggccatggccaacactcctctaagtaaagactggttaacaagagaaaggcataacaaatttatttaagcaaaattttatgtagcatgatggcattcaaaatgaagacccaaagatgcaggggaaactgcttttgtgcttaggttccttgaagaatggacagccttgtagacatgtgattggacataatggtgggatctaatggcaatagactgagagggcaaactcatctgtctgttcagattcttcttggtctctctgtgtagcatttcatcctctcaggtaggaggaaggacctctgtgagagtcttcagggagaaggtaaagagtgatctttctagatttgattgcttgctttggaggagaggggttctagcttccatgacctaccttggagaagatgaattctggtttgtatgaatcactttgcatgcgaatgtgaagtgggagacaggaggaaaggagaagctcagagagagagtttgcttctgaggctgcttctgaggttttccaatttcctttcattaaaagtactcagtatgcctaagtgccatattttggggcatcattttccgagccccaaaagggccacatacaaactggttttgcttcagagttttctccctgccgcaagccacctcccatgccctgagacctgcgggattgaaaataggcctccagatttgctgtctaccggacaaaaaatggatgttcctcttataagcctgatattgcctcatagctggtctttcttgtgctatcatcatgggaaaacacataaatccctcataacagaagcaaatacttagctatctgtgtcaccctgacaagttaaattgctgaaacctcaagcatgtttaggtgtcttcttgagaatcaaacccaattgatatgttgttttctgcgcttgattgtataaatttacaaaaaagtaaaaggatctattttttttttttttttgcaggaaaataagtagctgtataggtcaagaagattgaaataacagaatttagggaacttgttccacagttgaaacaatcagtacttatttaggctactgtaatttgtttgacacttgcatgaataggggttccaaacaaggtcacttgcgatttagtaagtgcctcagtagcaaagaaaactaaaagatggatttttttctattgactccctgcatgaccttcaatgagttatttgcgcatagcttttgttacctccattataaaataaaaatcataatattaatcgtttttccccagggttttctttaaatcttgaaaagtttttaaaaattaaagtgcagtataatcattaagggtctaagagtcagaacacataacctgggcatctgcagaatccctaggtcttaaaattcccaaaacaaatcaactagattttcacaatgtaaaggtaatgaatatgacaacagtagtggtgaggtgagatgtaggaatcagaagaagaaggaaaagatgtcttgtgttgaaaaacacaattaaattaattagatgatggtgtttctggcttaatccttggttactcaacagattttttaatctagtggctcattaaccatgtaatacctaacttatattctaagattttcatcacaatttgtttcttcatataaaacatctattattttttcatatcgcagttatgagtacacttctgtgtctttatcacactagagctctcctaaatgataaacattatgacaatttaatatttactctgtataagctatgcttttataaagtccagcagaaactgatgcaggatttcagcctgcaaaataagtgtaggttaataggcatttgttttttacttgcagcacttcagctaacttttccagtctatattgtttctgtttcaaatgctacattttattattcctataaagcaaacattaggtaatatttctattgtatactaacagggatcagcaaaagatgtatgtactagaatatattctctaagaagaattcagggtttcatttagtcctgccgctaaaactcctatatcttacacactggcaccacatagacttgaaatccatcttggtggctggtctgtctaaatgagtcagcaaggatggtgtgtatcttacattcagaagtcttagtttgatggggttgtacgatccctgacttcattacaagtacacctgtgactgaacaggtgatgaaacatggagcaaatacacagagacagatggattcagactggcataattgtagtcttacttcattattattttcccaggctccaggtgatttctatttttctttatagcatcacttgtctcaggaagtcccagtggaccttgaaacagaagagaaagatgcatcctggtttttatctaagccagtttgcagtgtgggcacttcagagggttgtgctatgaaaaagcaattagcttcttgagtctagggtgccatttaaaatatctaagctactgtgcttcatcataaaattgacctttttaattttttatgttagaaatctccactaaaagtgttagcataaaaaaatgtgcagctccagggaaaatatgaaaggcttgggaaggagtagtgaaagtctgtgttaccctgaagaaaatttgaaatcagctccacttggatataataaataccatgtcatgaagtaccctgtgcttaatttttaaataattggtatcattaagtaacataacaatgacatagcaacaccagttttgcataagtaggcaggcagtgtatcttagatttacaaccgacttacaatcttgcaggataattactttgctctctagaaaagaagtccttttctcattacctttgactgtcattcctatgccataatcatcttaatgtgattgtaatttatgtattgtgtttttcaaagctatatcagatttgccattttaattttcctgtccaactccaaagtttcagtgggaaaaagtcaacgtcaatttacaaaacgtagggggaagttatttaggaacaagagaatttccacagaaggtcatcatattcatttatgcatcccatagttttgtcactgccagtaataacacagaatgttttctagaggggtgtagaggttagtgcagggtaaaggttgagagttaaattacttgtgatccaggcctagcaattccactcattaactgtagggcttttggcaaattatttaaccttttggtccttcagcttccctgtctataaaatgagattgcaatctagttagttgtagttgtagatccaccccaaagcttagtggcttaaagcaataatttagtaattacctctcagagttctgtaggttaaccaagtttggctatgtggttctggcttgaggaactcagtcacatgatgtctgggcctgaggggaagtcatgtggactgagcattcaaggtggctcacagttgatgctagccattgttgaagcttagctggaatgtgaaccagagtgcctcctgatggccctgccatatacttcagcttctcatagcatggcagctcagtttggagggggacggcaacccaggaaagtgccttcctagtgacccaagaggaggctgcaaggcctttatgaaccagccttgttatacggttttgatctctgtccctgaccaaatctcacgtcaaattgtaatccccagtgttggaggtggggcctggtgggaggtgattggattacagaggcagtttctcataaatggtttagtgccattcccttggtgctgttcttgtaatagagagttctcatgacatctggttttttaaaagtgtggagcaccttccccactctcttgctgctgctccagccatgtaagacatgcctgcttccctttgccttccaacatgattacaagtttcctgaggtctccccagaagcagagaagatgccagcatcatgcttcctgtacagcctgcagagtcgtgagccaattaaacctattttctttataaattacccagtttcaggtatttctttatagcaatgcaaaaacggactaatacaccttggaagtcacagattcatgtaatgggaaattagactctacattctgatgggaagggtggcaagatcacattgagaagagcatatggaatgggagaaatcattatttttgtcaacaaacaaatgggggaacaattacatttccttttctttttctttctttcagttaagtaagatttagaatccagcagaattctctgctcagaaaaaatacataaagaagtgtgtatttataaagatgatttatcgatatatttttaatttcacattttgatgacttccaacacacctcattactaatattcagaacaacctgcttaagtgagtgactctaattattgttctacacatgaatattatgggagttagatgaaaaatcaggcaaaatcttagaagtcacaagggaaaataactcatgcattaaatattttaataggatctcaccaagatgtgggaaagaacatttaaaaatacacttccctctgaattgattagtattacttctgttcgctcagaatctcattaatgaaaactcaaagtgttgagttacatcagcaactttttgccaaagcaagaggttcataacaactgagaagtttattatagtcacagttagaagactttatgtccaaaacacagttcagtcccttgtaaatgtcagattacaaacctcagtttgcaaatgggtaacagtattttatttctgccagctttcttcaaaaatgaactaataattaaagataaatgatagaagctataactgaccaaagacaggaagttgtgcccccaaaacagttactagccagctcactgattttaacctagaggctaacttaacttataagcatttagagcaagaggaacataaaatttctgacatgaacctagagagaaaaatacacctaaaaaaattgagtgccctaatacagaagctcattttccaacctcagataacagattagggtgctttccttaaattccaataaaaaggaatctactaggctcttcatatagaaattgtctctttcctgacacacacacacacacacacacacacactctctcatcatgaaagagacaatttctatgtatgcgtgaatatagaaaatacacacacatataaatattgtaattagaacattttaaaataatgccctagaattctgaaattttggagactaagttctgtaacacttccaaaactaagcttattataaaatattttatttattcatacactgtgatcatctagaatttttggcataaaaattctagttgataaaactaaggagagagatacacacacacacacgcacacacacacacacacacacacaccggatgacatacatataaaaaactgagctaaaactttggaatttcatttctttttttataatgttttaccttctcttgattatttctgttgtaatactataagaaaggatgttaaattgtgtgatctttcaaagtctttcttaaggacaattaattaatggtgactttctttgtttgagctgctcaacttaaacatctgtccatatgagttttatacataatgttgaaaaatatactcagaagagtattaagtatgtatttttgcgatttgttctctgtcaactaaaaagttgatatagctttataaaaattaaacaatacaaactggcacaataaataataaactgaaaacaactaattaaaggaagcagagaagtaagtgataaagtgagttaactgggatctattacctataacactgatataataattgtttctcaggagaaaaagaagcatgacaatagatataaagaaaattttatttttctaatcaacaggagcgtacatacatttacatgtgtttctcttctttgtgtcattatcaaagtttgagtcttagtattttttacattaagaacctagaaattttttggaactacttttggtcagaaccagttttgccataaggatcaatcacttcatttttttatttatcaagattattgcatggcctaatagaacatgttttaataaagacatcacaaatttttaggatattttgagagtaagattagtcctgtccctccatcccaggttgggctgggcatttgtgctaacctctggaactacagtgagcccataaaggagaactatgcagattcaaagactttggacatggctacagtttgaactattggtatgttcaaaacattcctcatggaagaatagtttgaagttgggttacattgaactgacagatacaacaatttcaaatactgctatatatatatttgcctatcaaatatgcatgataaaaatgacaaaatatcaaaaccaggcatgggaagcattccaactccattagaatcctttttgaatatttgatattcatttttttgtgtggataaatagatcatattttgaatttcatgaaaatgccaaccttataaatcataaatatgaaaccttgtaaatcataaatccaaaacttttttgagtgtgatatatttacagttaaatataaggacaaagagcaaaaagatatttatattgacttgaatgatgagtaagcattgtgaattgtctccatgaattccatatctggctgagatgaacagccagcaaattcttgccaacacggttttcattttctttcttaatggggcttttttagatacattacagtgtttaagtaaagtgtcagaagaagtcaatttgtggccaagaaaacgtagaggagggggagaaaagaaatagtctcatgatgcttgtttcccacttccatactcatcacactccccatttccccaccttgatgctagtattgttctttctccattaaatcatcaatgcttattagccttctgagagccacagaatgtaaaattttgaaagcccaactgccagcacaaatgccctgacatcggtcattacaattccacgccctaaaggcaatcagagcttttttagtcattaaaaatgcaaacatagcattgaaactacagcgacattatttcaatgctatgtgggtaattttccaaatggaatatattccttaaatatatggtttcataaagttaaatttggctcactgctttattcacatgataacatttttatttgaaaacaaattaaaagtaaactctgtgggcttaaaagtcatcttgagctcatgtgctggatagagtaaaagttgcatgcaaaaaaagggcattactacttgtttccatcattctactgggtatatttaaattcagattcatccagtactttgtcagcaaagtcataaaccttttacaaatgtattgtcaccaaaagacaaaaactacaatctggaacaaaccaatgatccttcaagactacctctgactggatttactctgggaattttcaaaagtaggtatgatatgtcctccaaagtgggaaagactaaaggaaaaaaaaacaacaaaaaaacaaagacctacatgagaaattttcttccagaccttagagaatcaacataaactttaaatcatgagtactgattaccgcttagcattgtttccttacttgggcaactttggaaggtgcctatgatgattgtatatagcacaaaattctgatatttagtttggctatttaattcacacatttcttgattttcatataatgtttcaataattacattaatccatgcattcaactgtactttttagtctgtggtactgtagacaagagaacaagagaaggaaaaaaagatacccagaagattgtacagactaaacactggaagctctgacaagtgtgtggaaaacacttatcagtcccacgagcacaagcctagtcataaaggttgatgccttttgctaagaagtaaagaagtgactccgtgctggctctgacatatctgttaggaaataaacaatcttctcagaatacaagtgtgagacataattgagcatctgccaagaaatataaaatttaccaacagatagggatttgtgccagtttgtgggtgaatctggaatatgccagcagagatctggaatatatgtttagtaaattcaatgtcatataggacataaaaaggctttttcatgtatatctgccatctgaaatgtatgtctctagaaaaaaaaataaaaatagaaataaagaactaactaaatttatggtaccgaagagtagtatttgttttccagaatcataattgcatgtataccaaaatgggagttctggaaaaacgttggtgtagatcatgagaaaggcccaaaaggcaagtcacaatgacaaaagaactatttataagaagaggctcactaacacattgattgagagaaaaaatgcactgaggtaaaaccaatttgaaatgtgtcatagattgaagaataaaaattaatatattcattaaacatttcttgaaacaataccatgtagcagacactctgtttagagcttcctagaaaaaaaaatcacaaaagactatagaaagaagaaatacagagcattggtcacaaatgttataatttctatactcaaattcacagcaactaaataaacaatgtaagttgaaatttaagtacagggttacaattaaaatcccacaggtacttatacccaagacagaccaagatggctgatgaattctgaatagcagtggaaggctaacttgttccaaataataataataaaaaaacatgttggagaagagcatatgtcacaaatacatacctataaggaaaaaccataaccctactgggagaaaataatagacaatgtttgactggaaacaaaaagtgagagagagaggagtgagaaagagacagagagagagagagagagacgtgcatatgatacaccctcctggttggatgtttgcattatcctaacaccaattaaaggcaatataccttaattctgagagactttcattatctgaaaatctactatgatttatatcctgatagaaccagagcgtctaatacactctctacttaacttcctggtgattttacctctcagcaggaaatggaaacaacagagggagtgctatctgcatttaatttttaccacccaagaaaaaccaattaacaataaaatggaaaaatggaaactttctgtgaatatatttatttaatacttataatgaccataggaagaaataatttatttaattacaaatctaccctcttttctttaaaaaaagtttctgctaaaagatagatgtcatccaatggccaaaagctcttaaaaggaatatggcttggaaagaaactagatgcttccaagaacaagatcatgatcacacaaagacaaatgtgataaatagtactaggaaggaataactaagtagataaatgaatctggatgcacagagttttctataagctcttaatgaaaaggaatacatataaaagattgggagtcctttagttattattaagcagtgcaagctgaggcctgtgaaaaataaacagaataataaaaatgactttttagtatgttcagaacaagataaaaataagagaggaataatctgctgttagatggcttataaaatgataccacatgacacagaaaatgcagaaattcccagctgctttcttgttgttgtctgtcacagactgatgtggggatagtgaacattgtaagaaagaattgaaccctaagtggagaaaagaagagtgcctgccatgggtacaagtctcctgtttggtaaaaattgcatcccagggtatttaaaaagtttgtgaataagatggttgagatgttatcagtagcatttggggaattatgaagatggagtcattgggagactagaaacaggcaaattatgtcctgattttcaaaatctataaaaacaagctttctgaagggaacgagtttttttgtagagtcacagtaaaatcataagacatactgttaaaccctgaattttgagcacctaatgcagagagcagtcactaaggctcaaaatagtacgggttagaaaagagtttatggaaataactcaattaagcatatgttattttaaaacagacagtcaaagaagtagcatgaagagctctgaagcagcagaggaaagcctagagagaatgtagacttcaccaaattgagggacccacaaatcctccacacatactgttggtgaccattatgttttttgagagattgataatgatgacaacaaagagaaggttatcatgactatggcgaccttgatgatcacaatgataatgattgtaggatctctggagcgttaagttcccgaaaacaagaaccacatttggtttttccattggtctgttccagtacctagtacctaggaggatatccacttgttttaattgaattgaatgataattaataataataatactcaacaaatgtctaaacatcttatgagtctttacttcactttattattacaacaagcctatgaggcctaggtaatattattatctctatcttacagatgaagaaatgagccttaggcaggtccttagccaagattactcctaataaatgagaaagttctagttcaaatccaagcctatctgattaaagggctcttcattgctgttattatatattgaattaaaataagcgacatttccttctggctgaaatatgattctatgtcagctgagacagtttcttgctccatggaggtcctcaaaaaaaacaaaaaaaagattgaatcaagtccaggcagagctatcagaaaatctagaaaatttagagaacaaaatgaataaactgagaagttccaaacagggcagactcaaagagctgaatccaggaataaaagatgtgaaagcagatagaaaagtctcagtataaataagtggtcaaagagcagcaagtcacttagaacatggatgccacaacaacatggcacctaatcgtcatttgactccactgcttaatctggcatgtaatgactgtccaactgaaaaactaaaataaaataaaacagactgaatgcattaaaggatgttttctttatttatagttggttttattttttttttattatactttaagttttagggtacatgtacacattgtgcaggttagttacatatgtatacatgtgccatgctggtgcgctgcacccactaactcgtcatctagcattagtatatctcccaatgctatccgtcccccctccccccaccccaccacagtccccaaagtgtgatactccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcatattttatggctgcatagtattccatggtgtatatgtgccacattttcttaatccagtctatcattgttggacatttgggttggttccaagtctttgctactgtgaatactgccgcaataaacatacgtgtgcatgtgtctttatagcagaatgatttatagtcctttgggtatatacccagtaatgggatggctgggtcaaatggtatttccagttctagatccctgaggaatggccacactgacttccacaatggttgaactagtttacagtcccaccaacagtgtaaaggtgttcctatttctccacatcctctccagcacctgttgtttcctgactttttaatgattgccattttaactggtgtgagatgctatctcattgtggttttgatttgcatttctctgatggccagtgatggtgagcattttttcatgtgttttttggctgcataaatgtcttcttttgagaagtgtctgttcatgtccttggcccactttttgatggggttgtttgtttttttcttgtaaatttgtttgagtccattgtagattctggatattagccctttgtcagatgagtaggttgcaaaaattttctcccattgtgtaggttgcctgttcactctgatggtagtttcttttgctgtgcagaagctctttagtttcattagatcccatctgtgaattttgtcttttgttgctattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattatatagggaatcctttccccattgcttgtttttctcaggtttgtcaaagatcagatagttgtagatatgcggcattatttctgagggctctgttctgttccattgatctatatctctgttttggtaccaataccatgctgttttggttactgtagccttgtagtatagtttgaagtcaggtagtgtgatgcctccagctttgttcttttggcttaggattgccttggtgaagcgggctcttttttggttccatatgaactttaaagtagttttttccaattctgtgaagaaagtcattggtagcttgatggggatggcattgaatctgtaaattaccttgggcagtatggccattttcaggatattgattcttcctacccatgagcatggaattttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaagaagagtttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttctgcccattcagtatgatattggctgtgggtttgtcatagatagctcttatgattttgagatacgtcccgtcaatacctaatttattgagagtttttagcattaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgccaggctttggtatcagaatgatgctggcctcataaaatgagttagggaggatttcctctttttctattgattggaatagtttcagaaggaatggtaccagttcctccttgtacctctggtagaattcggctgtgaatccatctggtcctggactctttatggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtatttgtagtattctctgatggtagtttgtatttctgtgggatcggtggtgatatcccctttatcattttttattgcgtctatttgattcttctcttttttctttattgccagcagtctatcaattttattgatcctttcaaaaaaccagctcctggattcattaattttttgaagggttttttgtgtctctatttccttcagttctgctctgattttagttatttcttgccttctgctagcttttgaatgtgtttgctcttgcttttctaattcttttaattgtaatgttagggtgtcaattttggatctttcctgctttctcttgtgggcatttagtgctataaatttccctctacacactgcttcaaatgtgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaatgtatattctgttgatttggggtggagagttctgtagatgtctattaggtcttcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcgtatatatttaggttagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgcttattttgctcgttagttgatgcagtttcttcctagtctcgatggtctttacgttttggcatgattttgcagtggctggtacgggttgttcctttccatgtttagcgcttccttcaggagctcttttagggcaggcctggtggtgacaaaatctcttagcatttgcttgtctgtaaagtattttatttctccttcacttatgaagcttagtttggctggatatgaaattctgggttgaaaattcttttctttaagaatgttgaatattggcccccactctcttctggcttgtagcgtttctgctgagagatccgctgttagtctgatgggcttccctttgagggtaacccgacctttctctctggctgcgcttaacattttttccttcatttcaaccttgatgaatctgacaattatgtgtcttctcgaggagtatctttgtggcgttctctgtatttcctgaatctgaacgttggcctgccttgctagattggggaagttctcctggataatatcctgcagagtgttttctaacttggttccattctccccatcactttcaggtacaccagtcagacacagatttggtcttttcacatagtcccatatgtcttggagtcttctctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcatttctctgtattggttattctagttatacattcttctaattttttttcaaagttttcgacttatttgcctttggtttgaatgtcctcccatagctcagagtaatttgattgtctgaagccttcttctctcagctcgtcaaagtcattctccatcaagctttgttccattgctggtgaggaactgtgttcctttggaggaggagaggcactctgcgttttagagtttccagtttttctgttctgttttttccccatctttgtggttttatctacttttggtctttgacgatggtgatgtacagatgggtttttggtgtggatgttctttctgtttgttagttttccttctaacagcaggaccctcagctgcaggtctgttggaataccctgccgtgtgaggtgtcagtgtgcccctgctggggggtgcctcccagttaggctgctcgggggtcgggcgtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccgcccagttggagctttctggctgctttgtttacctaatcaagcctgggcaatggcgggcgcccctcccccaggctcgctgccgccttgcagtttgatctcagactgctgtgctagcaatcagcgagactccgtgggcgtaggaccctccaagccaggtgcaggatataatctggtggtgtgccgttttttaagcccgtcggaaaagcgcagtattcgggtgggagtgacccgattttccaggtgcgtccgtcacccctttctttgagtcggaaagggaactccctgaccccttgcgcttcccaagtgaggcaatgcctggccctgcttcggctcgtgcacggtgtgcgcacccactgaccggcactccctagtgagatgaacctggtacctcagatggaaatgcagaaatcacctgtcctctgcgccactcatgctgggagctgtagaccggagctgttcctattcggccatcttggctcctccccctaaactctagttggttttattttaagaagctctatttcttaagcagaataacattgcatctcactatataatagagatcaggttttatgttacatagtgaaaagaggcttaggtcttaaattatagagttttttttctcagttatagtcaagatatttatctctgccttgtatacagaaatagtacagatgaaaggagagcataactaatatgttgaatgacagagtaaacatttaaaataataataataatatcatacatttatggagtgttgcctacatataaagcaccacaaaaaaataactttacataactcattaatcttcacagcaatcctatgatataggattatgcttcctgttacatagatgaataaagtaagactcaacaagattaaattctttgtacctggtcatagctatcaagtagaggagcaaatattcgaatccataaaatatttttcttaatcaccataataaaccagcaataagcatggttccttcctaagaaagcctgtaagaatggcctgaattatagtacagagtagggtggtatgatttaacagatactggaagataaagcttcagagatttctagttgacagcaagtccactatcagtcaacgctgtgctaaaactttccaataaagacaagacaagcttaaagttgcattaaaggatctaagaattccaaataatggagggggtagagcttacatttccatactcgtagctttgtggtttcattttaggaaatgaaaatgcacccaaaaaacggagatgggagaaaggttttagagccattgtgcataaaaaatcagagctttgagcaaacttagggtgttagggtggctgtcttcacatgttagaaaagcagtcttttagaagaggaataagtttactctctataactctagaaataggagggtaaaataaagaggcagaattttactctaagaaatatttccaattatcagaactatcccaaaatataatagaagtgatcactctatcaatgtcagcattcaaggaaatgttgtctggccacctgtcagagatgctatagggtcaggggtgattaaaggaccttcagtagtttttatctccaagaagtttatttgctcatctagcaactttaaaattggtttggacaaagtctagctgttcctagatctgactgcagcatccttaagacattctcctgaatgcgtcctttctgtcagtgtaatttctacccctatgggatgtatacctgaccctaactcattgtttccagccttttaaatatgtgctttatgcaccccttctcttgctgtagtggctctaacttccagagattcggatgtaatctacataaatattggagctgagggctctaaattaagctaaagcttcccagttttctttcaaaacagacgagcattatgaatacagccataaagcacagtcatgagttattcaaccagaggcagctatttgattgataaatctatttgcaggaatatattaaatgattaatgaatctgtcatatcaactaggacacttgctaattattttcaaggttccaataaatgtgatggcaattaattgcacctgctacaatccacttcatgcttggagctgacatggaagtttaactttcatttttcactggtgaaaagccttttgtctattcttgggccttctccacacctgccagatataggaaaacaacatttgtgtgtggcagagtcctacttattacgggctacacatttaaagcctttgcagtcttccctacaaacgaaagtaagagaagtttcgcaggccgtctaaagaagaaagtggtgtacttacagatctaattttcatctgagcatagtacattgtagttccctgaggcaggctttgatatcacaaaagcaatttctggcagattggaagggctattcccttctgggtttcaagcatctgacaggagatcagagtggaggtcctcctctcaggggaactgacaggctatttccaagaaacggaggctctgaagcaagaagcaggtatgcctgactgagtaatgggagactcctcatttaaactgggagagccacagcccagtgatggcagtaggcatttattcatgtcagaggagccttgccagctgtcccagaaaccatgagaatgattcagagagtgctgagcacccgggtcacagaaatcattagggtttaaccctataaatgccacccactccctgaaaatgctgggaagaggtagatttcattccattaccccttgtggcaattcctctctggagccctctagaatacagacattttctccattttctcttctagccagatcacactggttatcctccctaacttgtagctgctaagaatgaaaatcagctatggaatctcccttcatgctccacatcaaggtgtgacaaagcttgagagatcttgtggcttgccatcccaaacatgatgcttgaccacatattaggagaacggggtcacatgggagatacaggtgaaaggctgctccaggacctcattgttcacgcgtcttctgacctgctatcttcatgtccccttctcctctcccctccctgtggggctagaactagacttagccttgagctctgctccgtgagccactctcccctgagccactcttccctgatcactctgtaagcagatctaggaagaatccatgccccttctgaagccaggctggtttgacaccatagaacagtctcacccaaagcagccagcaatatcaccaggtgggagtcactgaggtggacgagcttggagaatcaaggaccacgatgtacattgctagcagctgcagaagaccatggaccatcccataaattcctgccccctgtcactgcctctgcccaactccacaaaactgctacctgatttcttcctcttctttttctttagcctccttcactcttcctcttcctcctccatatacccaaaccaaagggaaaatataacatctagattctggctaaagcgaatgctctagtgccattttttggctagagttaaggaaatgtggttgatagaggaggcacaggtgaaatcactctactacatattttcactccagaataagaacaatgtctcaaagtaaagccccgtgtttgggctgttctttggtattttcctatcagcttgataaagcttatttttgttctctcttttcacagcaataggctctgaacccagagatttaaagtctattggcaacaagagttatttattaaaagatacacagagaagttacatacaatggtaaaagaatttggagacctgtataattaagacctcatcttgctttgtgaccagggttcaaggttcagaacgtaatttttagataatagacattcctctcagctctgtgcatgcctactgcacccaccaactttgcaaattacagggtagttgccactttagcttttgagtttcccaaacaagttttttatctgccctctatgggaacacccatggaatctgaagaggcctttataaataaacaaagcaagagacatctgtatccaagatgtggcatggagagcataaaaacagccagagtctgagaatatcagttgagatcatagagtgatgagatggacccttaggaaacatgcccttgccccacatcagctaaacacagcagcacaacaatcaacatgagtttcgtgacatcccttctctccttagaagcctacagtggctcctaatatcacttagttaaaggcaaattcagcacactatataatctgaccccttttatccctctaaccactttttcttgaacatgccaagaacactccagtcttagggcttagcacctgcccttcccgctgactagaaccctcttctcctgattaacccccatagctttctttctcacctcttgctttatttttctccattgtgcttatgtcatctaacatactatatagtttactaatttttcttgtttatagtcatcttcatattatatagtttactaatttttctagcctatagtcatcttccctgctaggggataagctccatgagggcaggaaaattgtgtctgtttttgttttctgcagaattcccaatacctacaacaatgtctagcataaatacttgtcgaaagagtcaatgaatgaataaatgccatcacatatgtgtaggtgtttgtaagcaaatgttcttttacaaaattgtagtgcagacaatattccaattaaaaagaggatccagaactacagtacacacaactagctttgagccccaccttgacactttctcattatttgtataagtgaacctcatgttcagttaaaatgggattttaaaaaattggagttcttataatgttctaagataaattatgtaaaattattctataaattgtagcactattaagtgttaattactctcctcttcataggttgtcactttatatatgtaacattttcccactgtctaagacaattggtgatactcaataaatatatgtgaaatatcaaataaattgcacaacaattactccagataattaaaaatttccctttggaagaacccaggtaggtatcaatggttgaatcccagtggcattattcagtgggatttctggtcatattcattcgtgttgagttcaaataacttttggcataactaaaaaacaaaatttgtccccaaataattagttagtattattattccagaaaaaagtattaaaagttttaaaaataattccagaatgacaataacagtaattataacaataataagccttaatatgtgtagacatattttcagagtaaataaaaaccatcccttcgtaattattgtgaaaggaataacactagttcagccattgtattaaaaaacaaatctcttcaactaagatgactgtaattccaccattaaaggcctactttaatgagtgaattgtgtgttctgaagattcataagcttgaaagtttagcccactctggttctgcccgttggtaggtcactatgcctattctcctggatattttccgtaaaacaagagaataaaagggagcagaatagttgctattctggaggaggtgttatccccaggcatattcaaaagaaaaccctgagttaaatggttttatctctaagggatcatctaattaacagaacaaaatgaagaaaaagcatgaggtcactgtgatgtaacaacagagtcattgcacgttgtcttttttttaacatcttaccaaggtataattccacatactatgaaattcaccaaaacaaaggttgaattcaatgatttttttagtataatcacaattgtgcaaccatcacaacaatctaagtttagaacatttttattactctaaagagaaaccctgtacccattcgccatctctccccatctctcccttctcccatcccctggcaactacaaatctttctttatatacagatttccctactctgtgcttttcgtctgagtgcaatcatacgacatgttgtctttagtgactggcttcttttatttagcataatattttcaaagttcattcatgtcatagcatgcatcagtatttcattcatttttattgccaaacgtgttccagtgtatgaatgtgtcacattttgcttatctgttcaccagttgatggtcaactgggttactcccactttttgtctattaggaacaatgtgactatgaacatttgtgtacaactttttgttcattgtcttttaatatttctaagattaatattccccatagaatttcctatgaagaaattcacaatctttgcaacttcacagtctacacacaatcaaaccccaccctcaccacacttactgtgtgattatgcatctgcttaacttctctgagcctcggtttttttcatttgcaacatgtgctggcagaaagttaagtgcttgaaagtgacgcttatgcagaatactaaaaaatcttccgaatcttctatcctgtgtctatcttcacagccaccttagagatggcagatttggagtgcttcctttctaagtcaatttcaatatctaaaaaatccaggtaaaatttgagtaataaaaaaaaatgaactacaattcataatatttgttaatagagaaaaaattcaatttaacatgtcatttctgtcgaatgaaggtgactgactagtaaagaagacttaaataatacttatgagtttaaatgtaatttttattgagtttttctgtctgctaatttattgatataaaagaaaaaaggaaaaatgttggtatgatttatcatctatcattagtcaaatagactgtttttttccataatattcttaggataaattgctaatttccattttgtggtaaaaatccatttctatgtaaccattctatcccaacctattccataaaattgggatttactgtagtcaagtgctgacactggttcaaactttaatggtagaatatatagggaatgtttcttttctttttttttctgactatggtacattaagtccctagagggggcaaatgtttagcaacatgttacttatcactatatgactatataggactctaattcagaaatgtcttttgcaatcatcaatgacttcttcctgaattgtgcctaccaggcagccattagcaaattctctacctttagaaacattctgtagacaaatatcaaatagttttctttatttatgatctgctttgctagcatagaaacagtcccaaaggaaggagtttctttttcttttgttttgttttgttttactttcccaaagacatctttcttttattctcttctgtaccctaaacagctttcttctcctagaaagtaaataccatggctgacctatgagccagatacttctgttcattaaactgaccctgctaatcaaaaaaaaaaaaataggaaagtttgtatgcgcaggcatagtattaatggtatgacttatttctgcttgttcatattgtaatggaacttttctcctatggttcattcatcactttaaaaaattaagccaatttagaaatacaatttgaatgtataattgaatttgtcagttgattttagcctttacaagttaatcaaatagcagagactcaaggaagtttctcacacatgctctcttttatgggcagccaatcattccccaaagagaatgtcaaattctttcaggaatttttgctgattagatcctcattctttctttagaggactgaatttttttttcctagcaatcaagattcatgctatcagtcaaactgaaaggaataaaatggcataattttagctaaaatattagaaatgacaaataagtgaaatatgttaactggagtggaaaagaaatgtgtaattaagcaacacaaagaccatatgtcagacacttctacagtcatagatgggaagagagtgtagacttcttgcaaagacccacacagctgtcaggaaacttcagtcctctttaggattcactagacttattggggatatctcacctttacccgcaattgacaagttagttgttgtttttatttttgctgagtattaggatgcttgattaattaattttaacatgtggtaaattaagtaaattataatgggaaaaagatatttgcacgatttaaatgatttaaatacacacagaaataggcttatttgacatgttgaaaatctgaattgctacctttcaaatattactcggtcctgtttcaagcatgttttgaaatttttcatggaaatctgtgtcatacttaaaatgacatttatttctctatgttctaatggtgctgaagcatagagccctatttggatattctctatctaaaatagactggagattcagatagccacacgggtgttgcaaacctgcatcgtgggactgggcgacacctcagtcccagtgaccacatctgcagagcccagaggatcccaggaaccaggtggttccatttggtgaaaagaatgggagaatctacaggattcagtatgagaatatttctaaactctgaagaagacataattaaatctaggtcccagtattaaaatcagtcttccttatcctcagcagtatagtgggattgtcaagattattatattttgaaatactagttgccattttagtcatagaatcaatgtgataacccatttcataggggtgtgcagtacaaaaacagtgatgtgaacctcttttacatttggcatttctgaaaacttccaacaaagcattcagagctagcataattccagccagatgaggacttttaaccatgatactgacatggcttagaaatatgaaacgttggccgggcgcggtggctcacgcctgtaatcccagcactttgggaggccgaggcgggaggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaagaaagaaatatgaaacgttacagtccatcagacatttcaacaaattcactttctgatgcagagtgtacactgaaggattcaagatactgagaacccgctggctgccaagttttacttgtgaattacaaacatatgtaatatattttatataatatttaaatggcttgcattatcaacatttctctctccattgagttctttccttcagtttagcgtctctttcaagtcattccaagaagtctttttatctttgtccaccttcaaactgccacccacccccacttcctttcacagccagtgttttttgagaacagtggcaatggcccgttcacccattggtgcctcaatgtactgtcaccaatggccccagcagcagctatttttttaattgtagtaaaatatacatagcataaaatttacctttttatctatttttaagtatacatcagtattattaagtagtattaagtacattcacattgttatgcaaccaatctccagaactttttttgtctgtaaaactgaaattctatgcccataaaataacagctcttcattatgacctctccccagcccctggcagccaccattctactttctcctccatgattttgactactcagcgtacctaatatgagtggaatcagacagtacttatctttttgtgactggcttacttcacttagcaaaatgttttcaaggtttatcaatgttgtagcatgtgtcagaatttcctttctttttaaggctgaataatgttccattgtataacagaaattctttatccattcatctgttgacagacacttgagttgctttcaccttttggctattgtgaataatgcttctatgaacatgggttcaaaaatatctctccaagactactttcagttcttctgggcatatatccaaaagtggaattgctagatgatacagcattttatttttaatagtttaaggcagcagtcctcaaactttttggcaacagggaccagtttcgtggaagacaatttttcaacagatgggacagacctggggtaagggaaagaatggaggggaatagtttggggatgcaactgttccaccttggatcagcaggcattagagtctcataaggagcatgcaacctagatcacgtgcatcgcagttcactatagggtctgtgctcctatgagaacctaatcctgccactgatccaacaggaggcagagctcagatcataatgtaatgctcccttgcctgctgctcccctcctcctctgaggcccagttcctaacaggccacagactagttccctggggaaagggggacccctggcttaaggaactgctatactgttttccatagctaccaccccattttacattcctgcaaacagggcacaagggtctcagtttctccacatctttgtcaacacattactttctgtttttttacagtaaccatcctaaaaaatgtgaagcagcagctcatttttagatctactattttagagtctttcaaggtgtggtttgcagatatgcctcagagtcacttcaaaaacacatgaggaacatctagattcctgaatccaaagctctagagattgggcctcacaatatgttaacgggtgcctgagatgttgttttcaatgacttttgatacacaacctaccatattggatggatatgatgtgaaagtacctcaagataagaaagaaaatttgcagagaatcatacagataccatatagaacagaatagttgatataataattgtcactttgcatgtgaatacataaactaagattatgtagaaacaactagcaacttgttacctctagatgtataattttgcaaatataactaagtcccaagccacacagtgacaatttacatcacggtgctgaacgttaccattatcatcactgaattgatgggaaactataagcactttcattgtgttcaatgggaggggtgagtatcacatatataatgatatctgcctcactgctgcactggcaaatatttttatttttatctatttcccttcttttaatcagtaaaagtcagggttggcatttcagttattttatgattatttgaggcttttagattgactactgtgctaggcactgtttattttctgcagggtagacagtgccttagaccttagctatttgggaaggttccagtttattatgggagaagaccttagggaccaaaatgaaattgtccaaaatgacagcgggtaggaacataaactgaacaggaagaaaatcagtttttactgtaagtaagaaacaagttaaaaggtgcttaatgtcaagatttgaattaagaagctttagcttatgccaaagaatttttaaaattttaaactacttgtgctgattttgcttcagcaaaactagatttataaaatcatgtataagcagatcttttacttccaaaatgctgggcatctttccaatcctactctttagattttgtgtttctatagttctgtgctggtatttttatgcttctgaaaccctgtctgctttcagcaattaataaaaatactatgggttttgatttgcatcactgcagcatatgaactaaattactttgcatctgcaggtttaaagcagaataaaactctttgtgataaagtttcataatgttcagatgtaagtcactgaaccatggaatccaatgagccaacaccaaggcagcaaggaagagtggctgccgtttgttccagtttatatcattccagctaaactgtctgccattctagagaggtttaaatactaagcccctacgttgcttttaaaatataatgagtaatttcctgaccaaaagcaaccactgagacaaaccagagcacagcacaagatggcaccccaacttgtccatcatggcttaaccatggtaggtgccaagtcaatgcagaaaagtttgctctcacagggtatttaaagaatagctattataagttattatatcttcactagaatatatctcttattcaccattcagtgcttccacccaagggtaaaattaaagtgatttctcctactacagtttattctgggtgacctgcctgccttcattgcttcttccctttgttctagttcagtccactgcagtacaattcacacaggtaagatactcatctacttttcactatagtgtaaaggagtacatagataatctcctagaataaaggatagaatgagttatagtgatataacaacttcaacattgtttcaaagatagggaatagtttattaataatataagaattaaggatgaggattatgtttcattaatatgtacaactcttcagtctttagcacagtttattacatgtaaaaagactcaaactctaaatgcataaatgaattaagcccagttttttgggttagttccatccaggtttaaatatttccctttggcccataaatatgttcacatagcttggccttagttttctttttcttctggataatttaccctaaattcttctagttccaagttgagttgatcccttttaatcactattttatcctcttaaggtcaaaggatctcataaaattacaatgatttcatgtgtatccctttcaacaactctgctaagtttacccagtgtctactagggaattccgacttgcccctttcttccttcttcaacttttgacttagaccccttgctggtatcagcatttattttcaaatgaaccatcatgttaagtagctgctttgaattacctagaatatcttctcacttctcatgccctctatcacacataccccactcttaagttacaatttacatactagaaaactggcttttcttttggccattttttttgaaatggggtctcatttgtcacataagctggagtgcagtgtcatgatcatagctcattacagcctcaaactcctgggttcaagcaatcctcccaccttggcctcccaaagcactgagattatagatgtgagccatcgcacccagccccttatgctatttttaagtctttgagttatttgggcctcatcatcctggaatattcctaagccctgttctatttttaaaactaaagatcttttagagaaagaatctttagtttttcctgtcttcccatgaatatcatatgccaagttgtttgtcctttattacccaaacttggccattacatttcctttaaagcaagagtcttccaaatgatacagtggggtaatatgctgaaagggcaatcagttgtttaaactccagaacgatattccacataaaaatgaatgtggaagcagagaggagccaagatggccgaataggaacagctctggtctacagctcccagtgtgagcgacgcagaagacggtgatttctgcatttccatctgaggtaccaggttcatctcactagggaatgccagacagtgggcgcaggtcagtgggtgcatgcaccgtgtgcaagccaaagcagggcgaggcattgcctcacttgggaagcgcaaggggtcagggagttccctttccgagtcaaagaaaggggtgacggacggcaccttgaaaattgggtcactcccacccgaatactgcgcttttccgacgggcttaaaaaacggcacaccaccagattatatcctgcacctggcttggagggtcctacgcccacggagtctcgctgattgctagcacagcagtctgagatcaaactgcaaggcggcagcgagcctgggggaggggcgcccaccattgcccaggcttgattaggtaaacaaagcagccagaaagctccaactgggcggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctagagatctgagaacgggcagactgcctcctcaagtgggtccctgacccatgacccctgagcagcctaactgggaggcaccccccagcaggggcacactgacacctcacacggcagggtattccaacagacctgcagctgagggtcctgctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaaccagagcgcctctcctcctccaaaggaacgcagttcctcaccagcaatggaacaaagctggatggagaatgactttgatgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcaatcaactggaagaaagggtatcagcgatggaagatgaaatgaatgaaatgaagcaagaagggaagtttagagaaaaaagaacaaaaagaaatgagcaaagcctccaagaaatatgggactatgtgaaaagaccaaatctacgtctgattggtgtacctgaaagtgaagtggagaatggaacccagttggaaaacattctgcaggagattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaacggaagccagagagaaaggtcgggttaccctcaaagggaagcccatcagactaacagtggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaacccgtaccagccactgcaaaatcatgccaaaatgtaaagaccattgagactaggaagaaactccatcaactaacgagcaaaataagcaactaacatcataatgacaggatcaaattcacacataacaatattaactttaaatgtaaatgggctaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaacggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaacacaggagcacccggattaataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacattttttcagcaccacaccacacctattccaaaattgaccacatacttggaagtaaagctctcctcagcatatgtaaaagaagagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaaaccaggagctggttttttgaaaggattaacaaaattgatagaccgctagcaagactaataaagaaaaaaagagagaagaatctaatagacgcaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatgtattcacagctgaattctaccagaagtatgaggaggaactggtaccattccttctgaaactattccaatcaatagaaaaagaggaaatcctccctaactcattttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataagcagagccaaagacaaaaaccacatgattatctcaatagatgcagaaaaagcctttgacaaaattcaacaacccttcatgctaaaaactctcaataaattaggtattgatgggacatatttcaaaataataaaagctatctatgacaaaaccacagccaatatcatactgaatgggcagaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagatgacatgattgtatatctagaaaaccccattgtctcagcctaaaatctccttaagctgataagcaacttcagcaaagtcttaggatacaaaatcaatgtacaaaaatcacaagcattcttatacaccagcaacagacaaacagagagccaaatcatgagtgaactcccattcacaattgcttcaaagagaataaaatacctaggaatccaacttacaaggcatgtgaaggacctcttcaaggagaactacaaaccactgatcaaggaaataaaagagaatacaaacaaatggaagaacattccatgctcatgagcaggaagaatcaatatcgtgaaaatggccatacttcccaaggtaatttacagattcaatgccatccccatcaagctaccaatgccttttttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactgataccaaaacagagatatagatcaatggaacagaacagagccctcagaaataacgccgcatatctaaaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaatgaaactaaagagcttctgcacagcaaaagaaactaccatcagagtgaacaggcaacctacacaatgggagaaaatttttgcaacctactcatctgacaaagggctaatatccagaatctacaatggactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccaggtagaatggcaatcattaaaaagtcaggaaacaacaggtgctggagaggatgtggagaaataggaacacttctacactgttggtgggactgtaaactagttcaaccattgtggaagtcagtgtggccattcctcagggatctagaactggaaataccatttgacccagccatcccattactgggtatatacccaaaggactataaatcatgctgctataaagacacatgcacacgtatgtttattgcggcattattcacaatagcaaagacttggatccaacccaaatgtccaacaatgatagactggattaagaaaatgtggcacatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagtgcaccagcatggcacatgtatacatatgtaactaacctgcacaatgtgcacatgtaccctaaaacttaaggtataatttaaaaaaaaaaagaatgtggaagtttcatgaaaatagagacttattttatacactttatcatagctattgctactcatctgctcacttttcttctaagaagctatctggaactattctgtctctacataacaatctaaatattaataggcagtgtctataaactattagtagtgtctacataacagtatctataaagtcccagttaaatgtccatatgaaaatgaacacatagtaagtgctaaattaatattgtttttagaatgaatataataaatggatctcaggcaagactctaaaagcctactttacttagccttcatgtgaatgaaatatcattctaatagtgcagtatcatatgaccttacctccatttattaaagaatttatcatgaaaattccatagaactttaaaatagagatgagaaaaaaaaatcatctttgcctgctaggacttcatcagaaagaggctccatcttctccagcccttcctttaccttttgagtgggaatagccttcttcaattctagtttatttctggggattgcaaataagaagagaccatttgtacatatttggtgccatagagaagagtaaggaatagagatacgggctcttacggaagctgaggaataggacagggtttggtgaaatcccagggaagttagcaaaggctaaggctaagaggcaaataaggacagaagttaggtcacagtgatggcatgaaacatgcaatgattccattaataaatggtcactatacgccaagtactgtggtaaacattagctcatttaatctttacaagaacctagctaggtttatatcattactctccattttatagagagtgagattcaataatttactttttctttggttacactcttaaaaaagtaataactcaaataagtacaaatagaactggtgaaatctgaataagattgtatggatggtgatatcctggttgtgatattttaggattgttttgcaatgttacctttgggagaaactgtgtagagtataccctcaatttttaagaattcttatattgtgaatattcttagaaaactaaacataattttactttatgttctagtaatcattctactagatattaacccaactgatttgaaagcttatatccatataaaaatcttctcattaatatttatgtatgtcttgttcttaattgccaaagattggaagtaaccaagatgttcttgagtaggtgaatggataaataaaccgtgatacatccataaaaagaaatattatttaacaatacaaggaaatgaacaaaaaaaagtggatggaccttaagggcatatgttaactgaaagaagtcagtcagaaatgttcctagactttatgattaaatttatgcggtattctgaacaaaccaaaactatagcgacagtaaaatatcagtggttatcaggagtgaggggtgaggagaggaaggttgagtagggaaattacaggggatgttttagggtggtgaaactattctgtataatactataatggtggatacatgaaattatgcatttataaaaatccacagaatattacagtataaagagtaagccttaatatatgaattttttaataatatcatttaggaggttggaagagcccagtaaataatgcagactgtgacaagagagtctaactgtattatagatgtatgaaacaacttaactaaagagagtgatcagaaaacgttctgacataagcagttttggaaatgagtagtctggaagactaaaggaaaaagaaactgtacataagcactgtactctagttgataagtattgttccatgttagcaatgttagcaattctgatactgctatacaactgtactggaattgaacaattaagtaaatagatggagaatgctaaaagcccaattttttcactgttttagtgggaggttgaagataagaagagaaggctagaatgatccatggggtaatggattagaattggggacattagtgtgagttcatatttagctgaatatagatgcatatagttacatatgtaaatatatatatttacatagaaatatacacatgtataagcacacatgtatatatgtgtatatacatgcatacatacatgtatccataggttagtatacacacacatattttcttgcactgtcagttgacagggcctaaagcaatgacacctcagtagcaatgggcacatctaacacccagcttttggtttctaacaccagtcttcaataagggtcatcttggaaaaataactcattctaggactagagcaggaaatatataagatcagctgggagtatcttataataccagaaaatgaggaaatgcacacacacacacacacacacacacacacacaatgatgggggtatgtcaaaacaaaaacaaactgaaaaacaggagctgactgaaagagtcttattggccaaagtggaaatcatatgttcaagaaaataagtaagtattggattataacccttattattcatatccaacaagtatgtaaattctatttacaaaaatctcttaaatcttgaccctatttgctgttatctctgctgggcttttaattatctccctctaaattattatcatggcctcaggactgggatcttgccttcagccttatctacagttcactgtattttgcaaagtgacccagagtcatctttttaagtgtagttctcaccatgtttctcctttgcttaaaatctttaaatggtcccttactacctaaattctttatcattacccttcaaaatttgatcccagattaccttgttggtgaattccacaatctccctgacagagcccagaaatcctataagccaggacaaaaaagactgacactggagaacttccagaaggtacctcctaagaaaccttaactgacagacactccaagagtaggtagtggaaagaaaagagggttggtggaatgttaagcaaattagtaacaggcaaacaataaatattacctagttcaaggcacagagtaaatgggtaacattccataaatgtttattgaacagaactgaagtggatccaaaatggcagataatggataaaaggtcattacagcttatgatcctgttcctggaaaaaatcataataatgtactttacatatagcatgtgcttaatacatttttccttgaagttcttttagacttttgaaaatacttcacatggtgtatttaaaatatctgcaaagtttccttcatccttattcttcttgccttctctactgctctagaaaggttaaatgtcatcaacattatagtacagattttaatggtccacactcactgttttttgatttgtgaaatgttgaaaaatatgagaaaaaaatttaaaaatgaagaattaacattaaaatctgaattcccttaaaaatggtaagatgtgtaactcaggaatttcatttctgcacaatattcaatgagaacagagtggcacttgcagctgcccagatctactctctcacctctgtaggcttctcagtttgagttaaacagacttttatttgaatcttggctctgccaaggtgggtatattatataaattctctctaccccagtattttcaactataaagtagagataatcataatcactcatcaataagtttagtatgaagaataaatgaaaaaatctgcaaagattttgagcacagaataattactttataaattttatttgttgaaaaattatgcttttgttatcaagtacagagttaaaaaaataaaagtagtggtagattgggagaaacaaatatagacatatcttgttttattgggctttactctattgggctttacggtaattttggtttctgcaaattgatggtttgtgggaactctgagtggagcaaggctatcaacacaatttttccaataacatatgctcacttcatgtctctgtgtcacatttgggtagttctcacaatatttccaactatttcgttgttatcgtatctgttatggtgatctgtgatcagtcatctttgatgttttgggggtgccacaattcacatccatataagatggagaacttaatcaataatgttatatgtgttctgactgctcaattcactggccattcccccatctctctccctttcttccagcctccctattctttcatacacaacaatattgaaattaggccaattagtaaccctacaatggcttctaagtattcaagtgaaaggtagagccaaatgtctctcgctttaaatcaaaagctagaaatgattcagcttagtggaggaagaaggcatgccaaaagtcaaaacaggatgaaagctaagcctcttgccctaaacaattagccaagttgtcaatgcaaaggaaaagttcttgaaggaaactaaaaatgctactccaataaacatataaatgataagaaagagaaacatccttactgcagatattgagtggtcaggatagatcaaaacagccacaaaattccccaaagctctcttcacttgtatgaaggctgagagaggtgaggaagctgcagaagaaaaactggaaaccagcagaagttagttcatgaggtttaaggcaagaagccatctctataacatgaaagtgtaaaatgaagcagcaagtgctgatatagaagctgcagccagtgatccagaagatctagctaagatcattgatgaaggtggctaccctaaacaacagattttttaattagatacaacagctttatattagaataagatgccaaatataacttccatagctagacagaagtcaatgcctggcttcaaaacttcaaatgataggctgactctcctgttagaggctaatgcagctggtaacaagttgaagccaagacttatttaccattgcaaaagtcctaaggacctcaagaatcatgctaaatctactctgcctgtgctctataaatgcaacaacaaagcctgaatgatagcacatctgtttacagcacagtttactgaatattttaagcccactattgtgacttactgctcagaaaaaaggattcctttcaaaatatttctgctcatttacaaggttcctgtaacccaagagctctgatggagatgttaatggaaattaatgttgtttttatgcctgctaacacaacaaccattctgcagcccatggatcaaggagtaattcaactttcagctcttattatttttaaaaagtatattttatgacttatagattacatagataataatttatatgaaggagttaggcaaagtaaattgaaaaccttctgcaaatgaagattttcctttttattctagtgccattaagaacattcaggattcatgagaggaggtcaaagtttcaacattaatagaagtttggaagaagttgattccaaccctcatggatgaatttgaggggttcaaggctttagtcattaatatggcttggctgtgtagccacccaaatctcatcttgaattgtagttctcataatccccatgtgtcatgggaaggatgcggcgggagctaattgaatcacagggatggttacctccatgctgctgttcttgtgataagtcaatgagttctcacaagatttgatggttttaaaaggggcttttcccccttttgcttggcacttctccttgctgccaccatgtgaagagggacatgtttgcttccccatctgccatgattgtaagtttcctgaggcctccccagccaggtggaactgtgagtcaattaaacctctttcctttagaaactacccagtcttgactatgtcattaatacagtaaactggtaccgggagtgctgctatgaagatgctcgaaaatgtggaagcagctttggaactgggtaacaggcagaggttggaacaatttggagggctcagaagaagacaggaaaatgtaagaaagtttggaacttcctagagacttggagggctcagaagacagaaagacgtgggaaagtttggaacttccttgagatttgttgaatggctttgaccaaaatgctgatactgatacagacaataaggtccaggctgaggtggtctcagatggtgatgaggaacttgttgagaactggagcaaaggtaactcttgttatgcttcagcaaagagactggcagcattttgcccctgccctagagatccgtgaaactttgaacttgagagagatgacttagggtatctggcagaagaaatttctaagtggcaaagcattcaagaggaagcagagcataaaagtttggaaaatttgcagcctgatgatgcaatagcaaaggaaaacccattttctgaagagaaattcaagccagctacagaaatttgcataagaaacaaagagccaatgttaatcacccaagaatcctggttccatatttgtctccatccatattctattttatattggcattagataagttagtatcaacttagaatatttaaaaagtaacaataatattacctacattgaacagcacacttaactaatttttttctatgtttggcaaaattgactgcaattttaaaagttttgttacgtgagcaatctaaataaataagccaagatagtatgaacatagttctattccttagataataaaataaaacatagaaataataaaaataacttttaaaataatataatttgtctatgtccaaagagtggttcaataatgtatagctttttaaatatatattctttatctttattccacaaagcaaaattataacatttgcttgaaaacgcaatgttgtatttttctgcctacaagtggaaaaacaatggaaattattgctatgctatttaacaatattttacactgctcttaattatgtgtcatgaactcttattttcacatagaccatgtgactattgctatgctatttaccaatattttacactgctcttacttatgcatcatgaaccttttaatatgcatgtaacctcttttcacctagaccatgggagtataaagagcagttaccagaagaccttggctgggttcctggttctgagagtcatttggggaaaatcacttaatctctttcaatttcattttcttcatcataaaatagagctcaccataaatgttacaacattgttataagaactaaaggacatattatatgagaaagtgattcacaacctgcaatgtattacacacattagcaattattttctttgttattcttaataaattattttcccaattatttccagtaaattttacctccaagctatgctttttaactctaattctgctataagtgtgtttaatatattctcttaaagttttatttatagataatgcatataactaccataggcataatgcacttttgaaaataaagcaaacaaaatagttaagccaactgttcaatataggcaatattactgttactttttaaatattcaaagttgattctaatgatctaatgccaatataaaatacaatatggatggagataaatatggaaccaggattcttttataggatccaagatcaaggttaggccacatttgtttaacattcattagctctcatagaccattgaaaaatgtataaaaacacatcttcacctttccagattttgattcttgaagcagtggcagccaatatcagcatgggcagaaattaatcataggagattagagactctgtcttattctgtgtgtgtgtgtgtttgtgtatgcatgcgtgcacaccattcttcacaactaggaagtgacccacaggtaacttaaggataatgtgtcagaaactattatcttctaaccaatgacccttccacagtgtgatcatcaagagatgttacctgataaagattggagccagctcaaggttacgtagtctgttatcattgtagcatgtcccttgggataatggaaggcatgtggcttagttgactgggttgagtgcatgaaaaggaaggaagaggcaccatacacatcttgaaaaagggagaagcttacacaattttcaacagggtcacaaacgaagatgaagagtgagcactgcatcaacctgatgcctaggccagcagaaatacaacacacttcatgattcaaaaacagcccgtgtgttcctgcttccttttatcctggatttatagggcatctaaagaaacttaatgatatctgaatagctccctcacaatccacatgttctggcagggggaaggtagaaaggaatggactatgctgggcagagagcaaagcatgggaaaggtttaaatgttctctggtgttgggagtgcccctccagctgtttcatctgagacaaaggggcctggagagacacttgtttaatggctggtgcttccatttgtgcacagaaatcaattgcttttctcctagtcttcactcaaaacttctcattcaaaataactaaaagttggttgcccctgtttttttttttctttccatcatctcgctactgtgactgaaatgtatgatttaagtatggtattaactagggaaggaattctaatggtgaggagtcaggagtgaagacatggttagttcatagccacataatcttcccccagataatttatgtatgtatgtttgtagttccacaaatatttactgagcgcctactaaatgccaagctctgtttgaggcccaatggacccatcagagaagacaaagactcttccctcatggagctcatatttcagcgaaggagacagaagattaacatatatatatatacacatatacacgtgtgtgtgtgtgtgtgtgtgtgtgtggtgataggtgctatgaaaaaaaaactgagcatggtacagaaacagaaaaagaaaaaggttgaaggggcaatttagatctggaagggcagggatggcatctctgataaaatgacatttgtgccaggacttaaatgaagtgataaaatcaaccatgttaatatctatgggaggaacgttccaggaaaatgggttagcaagggcaaagttctgcaatggcagtgagtttgccgttctaagaaactataagacagctagtgtgtgtgaagaggaatgagagagaaggagcacagtagagaacaaatttggagaagaaaccagatcaagaaggacagtaaaggttgtaataaagaatgtttatttgatctaattatatattaggaaaagttttaaggactttgagctattgtgcaaagaactgactgtaggaagtcaatatggaatttcacagaaggaccagtttggaagctctgaatcctttagttgagaaaagatggtaacttagactatggtggcaaagcagaaaaaacagaaaaaataattccaattctggatatatcttgggatatgctcaaaagaagtgtatgagaaagacagaaatcaaggagaactcacaaatggacaataggtgaatagtgattcttctcactgagatggggacaacgtgaaggagtgtagttagaggaggaaaatcagtgattctgtgttgaacatattaagttagatgtctactatacaaccaagcagaaatgccaattaggcaagtggatatattgatctgagttcaggggagatcagcactggagatagaaatttgggattcattaatatttagatattactaagaattatgagagtgaatagcaacattaaaagaaaatgattctatgttttcaatgaatattcatttgaaatgaatgtagaaatccagtagaaatggtttttcgattttatagaaactacaactcaggatgtatgagtattgaagatgaatgctggaaataatactggtgtgaatcacaaatactacacagcctctgactaacccgctatcaaaatatgagggccctcagatagaaacaaagggagtgcttatctctgactaaaacactaagtcaggtaagaatagaaaatgaggagctgaacttccacttaacctcagggcaaaagcagctgaaggtggctactgtgattattgtgatggtggttctgtattgtaccctcatattgcaatttgtgaaggcaaactgctttataattgacttcagtaatccatcacaacctactccatttatgtgtcttttggtcttttttattatcctcatcatgggtttcaatgtgtaagccactttgattccccttagaacataaatcataaatataaatgctttataataagaaagttgtgtccattaatagggaaatggtactggtttaactttatcagtgaagagtagaggcctagggaaattcattctcccatattatttaacaacgaaacaatgaaagtgtggaatgttcagattccaacaggtcagtgtcaaggctgggatactgcctccatcaactctatgtttctcatatcccaagtcatagccacccataacatgcagcaaacaatagcttctctgaatcacatgtgcctctggctctgttttgtcatttaggtaatgtgcttgttaattttgcactatttgactgggttacagggtacccagatagagggtaaaaaacattatttctggatatgtctccagaaaagattattatttgaatcaataaactgagtaaagaaggttcaccctcactaatgagggctggcatcatccaagccattgagggcctgaatagaacaaaaggcagagtaagggcaaattctctctctcctctgaggccaagacttcatcttctcctgccaatggacatagaagctcttgtttcttagggctttggactctgggccttataccagtgacacattctcaccatcactatcaccccccaccccagattctcaggactcagactgaatgacatcactggcttccctggttctctgacttgcagacagccaatggtgagaattcttggcctctataattgtatgagccagttctcataataaatatatattggttctctttttggttctgtttctctagaggacccttaaccaatacaagtcgactgccttaacctcactcctctgtcacaaacatattgtgttctcaggaaacatcccctccctagaaagttacactgtggatcccaggtgagtctcttttcactccctgccatcacgcccttacctaggacatcatccaagccttgggcctgtatgagtcctggagttctgcttcctggaagatgttcagattttaaaatcacagggcaattactttttgtaaagatgatggagattttataacataataagatcaaaacattaaaattacaattcactcaaaaatgaattccttcagcattcagaaatgttagcctgaaattcacaaggacaatgatgttattaatctctttcactgctccatgatcagcatctggcagtgtgtccagcacattgtaggccatcaactaaatggacactgtggcatcacagaggcaggggatagtggttgaaagtacagacgctggagtcagatcacctgggacaaactgtatctctgcccctcgcttgctgtgtggttttggaagcttgcctaaccactctataaaccagtgtcctgacctgtaggaacacatagttcctatgtcagaagatttttatgagattcaataagccactacacaaataaaagaatgtggtaaaccctcaatgtgtttttgatgttaatgatgaattacttaagaatttagaatgttatgtgtggaataagttaaaatcctagcctctccatgtagtccatcattaaaattagtactttaataattaataaatcgatcattattaacatttttaaatcaataaattgccatttattctacagtgtgctcttctagctttggtctttgtcaatgaatttagtgaatctcccgaccctgatttcctctggcaaacttgaatatctggaaatgtggaaaccttaacagcaaacagtgaactgtaatgataacatgatatccctctctgagatatgtgcaaagcttcaggcagctgtttctgtgtctttcctgtttctctcctataaattccatgacctttataggtgtgttgaaattagaaaagttagaagtattgttggtaagttcactgctcccaactttcaaagagaaagttatcatctgttatcaaggtttactatttgctattcacatttccatgttccaagatactcaagtttgccagagaaaatcggggtcaagagattcactaaatttattgatatagaccaaagctagaagagtttgctgtagaataaatgacagtttattaatttataaaattgtgaataatgaccaaattattaatttctaataaacaaaataaaaactacccagtagacaaaataattgtgatcagttatgttttcaaaattagaaaaaatctacataaaaagcaagttatagtaagaaaatttttgtttctttttttcttttctgttttctttagggatggcttggaaacagagcatattggttactttgattaatggctgatgatattaaaacagcatagcctgatacatccctcacaactgcaaagataaacctgaataatagttttagttgcaaacacacatatccccctggcttccatacttatatactggagaaacgtggacaatatcttactctttctggccttttgtttttatttatttggagggaaaggaagatggatttagtttataagaccatctgagtgacttatgacagtgattgtatataacttttctagttacttacattctcataatgccttcttcctatttcatccaaatgactttgattgaactttgacttcccaaatctcctctgcttatctgttaaaaaacaataataagtaggtccgaatctatttatttttttttcaattttccttcaaacttggaggcggggtagggcgagatcttacttttatccccgtgtagtgaacaccagatatttccagaaagcttataatctaaaatttagttcccagccacttcgaaagtaagtacatttattacatctattctattttgcgtatttggggtcgtacatgggcctcattcattgtttaaatggtgatgcaagttctttgtactgagttaacaagggtcatgattacggaatacagagattttagcagagatgtatttcaacacatcttttcttcagcattttctatcagtaatgaagagatagatgctgtccatttagaagcatagaactaaaatgttttccaagaaacatctccaaaatggtaaagttcaaataggtgagatgtcatccttggctacgtgctaactccactttccagtaaagggcaaatgtctcacacaattaacaaagattccatcaagcccataaaacgccagccactttcaaattgccaggagatctttggattctcttctgattttttttccatttaattttcttcagacatcctaatactatggtggaaaagacaaattagtctaatgcaggatactataaaatgttcaattacttcaaaaagatatggccatttcccaaaggaaggaatttaatcaaaactagatcaaaatgggaaaatggatgacagaatatataaatattctaacatatttgaagttaaagaagactttacaaaaaggctttaaaaatgaatatatcagagtagatgtacaaacacttagaagcatacagtttgtccatcacctagtgggattttaatgttcagattttaccgtctaatatgacagaatctctcagacttcagttttatgtaaggatgaatttaatatttagaatatttcccattagtggaaattttgtaagtatcacagcttttcaaaaatctccttatagttcaacatatgaatctgtaataattttaaattgtcttttttctaaacaaaaattattatgaaacaaaaacattacagaggtccaagttattttacatggcctttcttttaaatattatttttaaaaccattcgctgagatctctgtttaaccaccaaatctagaataattgtagagacttaaataaggaaaatgttcacatatccaaaaacagtatgaattttactgttatttctcaattgtgtttctgtgtattctttagacatctgttatgtttcaaagatcagacatatccttagtgtgcaaatccatgtaaatatcctcatcctataagattgcctacttaccaaaaataacaacaataaatatgttattaagttgttcattaatcttgagacctcctatggcatacatttttttaaaaagccaagaattattaactgaatgtcaaaggccagaaagagcaatgggggatgtttccagtttcaggtatcaatgagaatcaaaatgaaatgtaaacagtatcagatattgtaactcattacctatgtaacaatttgggaataaaccacacttttcagatatcaactctacagaaaagcagtgtgaggtaggttttgatgtggcacccctgcttttgatgacaggtctgtctcagagccatgttatatggggttgggccagttacttaacccataatacagtgcatggtaagagctgaacttcataatgattattccaaattacaataaaagtaaacatgttttaacattctacctgtgagggcaggagaaaagaaaattagtgcttttaataagtaaggaacattttaaatcactgagaataatattatcaaatattggaaaaacagacaaaagaaaaggaatgaactagtttaaaaagaagtacaaagaactaaaagtcttcacttttaccagtgaccaaacatgtttatatttattgtaccatattgatatagaatattattcagttattaaaataatagcaggagaagtttttaatcacagcataaattttttgacacattgaataaaagaagagaatgtcaaattatctatgaaatgagatctcagttttagaggaaaatttatatctgtactgatatacagtaaaacatcatcaagaatgtttatctctgaattgtggaattatgtatgattttcatttattttatacctttagtatgtcccaagttttctacaatgagcatttagtacttccatgatcacacaaagaaatttttcaatgccaagaaatgtaaaaacttctagactcggttctaccatcaataagctaagtgacctatgggacgtcgcttcatcttacagagtctcagctttcttatccgtaaaatgagaaaattgaactagatcacctcctaaggtcactttcacttctataattttatgaatcaataatgtactattaacactattatatccaaagaaaacaaagactaattgaagcaattgtagcaacaaaagttatgacatatggattaagcctagtaggtatttttttaaaactacaaatgactggccattattctctatgaattaatatcttatcctgtttatgatactaaattctcaaaaccatttcaaagataatattcaatatttctttaataatagccctgtaagttttgcaggacacagtcacccaagctgagtgatgctgaataaggccagagctggggtcacagtcctttcctggtccctaaccacccacaggtcttttctcactctgtgagtctctcctgagctgtccttgtcccttattctaattccatcaggtgtgtgttgcagttttattgagccattttcagagccaattaatcagaaaacactgtttttccatgatttgggggattcctctagtaatgactttgcagccataatcaagaaatatgttaagccttatgtcaattaacttaactgatgtgaaaacttgactggtccagggagcaatggatttccccagctgcaccttatcagagaacagcttagtgtgaaggagagaagttatgctgaagccagagctgtaaacgtgccaggaaaattagcacaagctccaagtacagagggtgaagaagaaaacttgcttagcccatgtatgggtgttgcttaaacagttatgaattattttaaaatctttcattgatgggatgaatagtcgcatacatttttgccacatgtaagtttctccaaagaattgggcccacaagagaaatggaggaggggggcctacatgcaagcagatgaggggcatttgcttccccaaaaatattcttatattttttataatgtgcctcattaaaatatgaaacactcaattcaaagcaaaaattgaaataggatactcctgactcttccctttcttccctctatttcctcatgatatagtcttagcacttcttttaaatgttacaatagtgcttcacaaacaattttttttgccagtccgtcacaatgaatgtttttgaaaaatataataaaaacaaattatcacaaaagtgaaataagaagatgaaaaaactaagcacactttgtggttattatattcaacagtcatgaaaatcacaccacaatttgccatgaaagtttcttaacatttaactctgtacaagtatcgttgcagaacaataaggccacaacacgtacacaagcactttgtcttagcaccatatcaacaattacctgtaaagctttatcttggcattttccactatgcaactgttggtttacacagccccattagactgggagttctgtaatgggtaagccagcagttaacacttggaggcactcagtaagtatttattgaatgaataagtcaatgaataagtgaagcacaaaagagcataagcctttctgctcttaacacctacaggcactcttcttacatcaggaaagctcccatgctctcctgattcctttgccccagattccaagggtacagatgcttttctcacctttggtggtaactgccacctgcttgtcccaaagagcttctttgtttccctgtcttcccacaaaggtgataacaaagattttttttacagtttaagagtatcagtgccaatcacttttcagacaaaacaagataaaatgcaataaataaacacggaggaagttataaaaatttcaacataaagcgcagatctatcgtcttgttttctgctattcagagcactaaagacactgggttttgtgtctttatctgtgggtttctctagtttatccatttgatttactgagtttgtgtgaaaatattgattaaatcttttcttagaaccagttgagaaccatttgctactttccccagctctgatattaacttctaatttaaaaaaaaaaagaagtgtgcaagtatattcgttttctattgcagctgtaacaaggaaccataaacttaatggtttaaaacaacaaaaatttattgtctcacgacttctgtaggtcagaagtctaacacagtctcactgagctgaaattacagtgttagcagggctgcattcttttccagaggttctaggagaaatttcatttcattaatattcaggtcattgaaagaattcagttctttgaggttgtgtcactgagtcctcatttccttgctatcaactgagggctgttccaagcttctagtggccaccaggtctctctgcttgagtcttcctccatcctgaaatccagcaacagctagtggagatcttctcatgatgaatctctctgacccaagctgggaaagcgtctctgcttttaagagctcctgtgactgaacacagtccatctgtataatccagaataatttccccatctcaagatctgtaacctttttcatatctgtgaagttcctttagctatgtcatgtaacaggttcgcaggttatagggactaggggatggacgtatttggggacctcaccctgcctatctcaacaacaaatttataaatttattctagggtaaaaaagaaaattataaatgtatgtttttaactttacatcatccttggataaggtcctaatcttatatgagcactcaggacaaggctctaagagattttatggtggagtcacactgtgtgcatcgtcatactgggaaaggactttgtactttgtttattttgttcatctggtcctttggattgtcccccacatgctctttcaatcccagtgcaccctccagatttctgtcattgtcaacttatgccccaattctctgcataaaattctaaaattgtagatcaaaaatccacactataatattaaatcccatttattttgtttggcaaatctgattcttcataatttgatctcaccctattttataaccccatttcccactatttccccttcatttcctataatacaccaaaatacttgcaaaattctgtgccacttatgcttatctttgcacatgctcttctttctgcttggatggaacttcctttctgcttggatgaaatttctctttggggacatgtgatataattgaaatagcatcagcttggaaaccattttgatttgtatttgacctagtcactctgacacttactaggcctgagactttcagaagctcctttgcctgtggtgcaaaatgggattattaaaacctactttgtaagaatattttgaggctttgaaataatacacatgaaagcgtataacacaacgtctgtcatatgatggacatttactaaatgttagttattcttttgccctagagaacctcatttttcctccaggcttaagttcaccacttctgtcacattgcccagacccatcaggtagagtaagattctcaaccttgagtcttccataactgtgtatatttagcactatcacattttagtgggcaatgtctatacccacctgtgtcctctaataccttataaacttcttgagtgaaagaatgtcttgtttatcattttagccatagcacctggcaaaggtacaaattagtcattcaaaagtctggaggaagagatggatggatggatggatggatggatggatggatggatggatggatggatatgagataaatgtagaatctagcataataactaacaaataatacatatgcttcatttactttaaatataccagttgtgtaagtatatcattctggctgtgttgttttgtctttttatctctttggctgccttgttcactgaataactgtatgtttacatttttattcctatagttatgttaaattcctaaaaggttgtgtctttcatttctttgctaccttcactcaagcaaaacatttgcattctatacattgtgacccttcggtgcagttcaacagagtaatctgtttttaactttgcaccattcttggataaggtcccaatcttatatgagcactcaggacaaggctctaagagattttatggtggaatcacaccataaaatctacctaaaaaactaatatttagggtttctggatagagcaagagctgcttcttagaaagcaaaatgatcacacaggaaagtttcaccagccaacctaaatacagtaagaaatactgtagactttgtagtgtcaaaaccacctgtgtttgctcattggccttatgcaaagttaaagttaaatttttggaatcttcttgaaaagaggtagttttacaacttggagcaaggcacctaatgacgttaggctcctatcctcccatagaaactgggagataggggcactatccttcttgattattacatttcagagaatggtctctgggtccttaagaaagacattccttagttgtaaaactggcaagaggcctttaaaaagatttacttccccaaaggacagagaaatgatttacaaatacaggttttgtaaagtaaatgcttaaagaaaaggggtgttaggagcctagagtcaagaagcctgcctgtcttaaagtttagtcaaccagaggggaatgctaaggtcctcttggtgaggaggaacctaagtgtatatttctggatcagaaaggatgggttcctgagatgtcccttgaaaaatagggtagttacaggagaggaaattatttaaaggaatcagtttatcatagtgcagctcagcaggtctattcattagcaaattgcactgaactagcccgtggctgtagtagagtaggtatacctccaaatccttatgtattaaggaaatttacattaaaagacagagatttaggccaggcaccatggctcacccctataatcctaacactttaggaggctaaggcaggaggattgcttgagcccaggagttggagaccaacctgggtaacatagtgagaccccatctcaataaataaataaataaataaataaataaataaataaatacctgtagtcccaactgtgtgggaagttgagatgatgggaggaactcttggtcctgggaaattgaggctgcagtgagctgtggttgcactgctgcactctagcctgggtgacagagcaagactctgtctcaagcaatcaaccaaccaaacaaaaacccagagatctcaatctggtttcatacaatatatatgtacaagtgtctgtatttcagaaagtattactgctttagaaaatgcctagctttactttttatttcacattttactaacaattaaaaggcagtggaggttacaaccccacatcatggcccgtgctatcccttccttacaattctgtcagaagggggtgacttagaaagaaaagcttacatattgctcttggtggagcactgtgattaatctcagacattctccagaataattttaaaatcataatattttagatatgtttcttcctttacccttcacatttatccaaagctcttggttctgcaattccctaaaacatactttaggcattaagtaaaaagtgagaagtaacgagagtaacattattcgcttctcttcttcctagggtatcttattttcttcaagctttctttcttccttcttactcctatcccatctttgttatttcctctattctgaacatgatcaaactttctggttatcaaaatgtatatgtgggtatgtgtgtgtgtgtgtgtgtgtatacatgcctgcatgtttggggagtgtaagcatttacaataagcagctaatttcacaggatgacagtcccacaattatctggttattatttgtaaccaggtaacttggctagacttgtgggtaggtcagcagagctcataggcacacttctatgctcattatacaaagatggttaaacaaagaatgtatatctaagtatgcatccaatgtaggaagaaatgaattctgcttgtgaaatgaatgaattctatttttgaaatacatcgtatttatgaaattatgcttgtgaaatgaatctgacatatatacagaaaatatttcaaatgcctcatagactacacatcaacaaaaggaacaaaagaaatccaaattttgtattattcttccctctctttcttgtcctcttggctcttcatgcttgtgttcaggcataatttttaaacacttttcttaagccagttttcactgaagaggtcaggtgaggttaggttctttacggtaagtcacactttatcagtgtgaaattctgttgtacttgtcatttctcagttaattaagccagatatctccttagagatctttttcatatgaaattggaaactggcttcatgttagtgattgtaccaaaatgggctttaaaatgtaaaagtctctaatcctcttttagaagggcaagtgtttcatgtcaccttgtctgcagagcaaaatctctttctgaatgaaagatgcagctttgcaaaactgcacactatgattataaatcaaccagtacaataacagtactgcagacaaaacctcctaagataatctctttagcataaaattgtattcagcaagatgaaaatcctaacaagattgtgatttctgtcggtttagctttttacgcatgccatttacactaagattcttttttcatactcatattaccagttcacctggagaaaaatggcttattatataatcagggttcatatgcatggaccacaatgggcatgaagcatatgaggatttatatcaagagtcaaaattcttaacagattggcagttgctcaaagaaaggaaataaaagtgattagatggccacgattgctcctgaattcagaataaaggaactgaggtgcacagctggactacatcacaccaggaaagaatgaggagtctctgaagagtgtgacttcagaggagaagctggaattgtttattgttgccccagggaggtgtaattggggttaatgggataaaattaagcacagaaaaattcatgatgtctatcaggaaatactccctaataaagaggtcttttataaaattgtcccaatggaaggattagaagtccttttgtttgagtgattcaaactttacgtggggaaatatatggaaaaataggctgcaaaagacaatctcatacaagtcctcaagggatgaattacgtagaacaatcagatctttcttggctttaattttcatgagtctattttagtaagctccttaaagactcaattttcaaagcgcttgttgaatcccttctgcattgcacctgcattagtagcaggttccaaagaactgagtttgcaattgtgtactatgacgattgagactcttacctgagaacctggaaacctgaagtcatttgcaatgacttcagctggtatttatggatgtaaacatagtttatgtaaaactcagtatagtaaataaagttctgaagaatgctaacagcaaactgaactaattggtacactgaattccttgtcttatttgagttcatcacatcctttaattaattaaattagactttattgagaatcttctatctgctggtcgttgagtaaatgctggggttaacatgaaatgttaacattttcatgttaaccccataaaaaagcaggcaaacgacatgaacacttttttttccatatgattgttggccacatgaaaagacgtatatgtggccaacaattatgtggaaaacaagttcaacatcacttatcattagaggaatgcaaatcaaagctacaatgagataccatctcacaccagtcagaatggctattactaaaagttcaaaaaataacagatgctggagcggctgtggagaaaaaagaaggcttatacacttggtgggagtgcaaattaattcaatcattgtggaagacagtgtggcgattcctcaaagacctaaagacagaaatactattcaatccagcaagcccattactgagtatacacccaaaggaatataaatcattctatcagaaacacacatatacacatatgttcattgcaacactagtcacaatagcaaagacatggaatcaacctaaatgcccatcaatgatagagtggagaaagaaaatgtggtacattcactgtaatagttaagattctccagagggacagaactaataggatatatgtataaatgaaagggaatttattagggagaattggctcacaggatcacaaggcgaaatcccatgataggctgtctgcaagctggggaagaaagaagccagtagtggctcagtccaggtccaaaaacctcaaaagcagggaagccaacagtgcggccttcggactgtagctgaaggcctgagagccccacgcaaagcacttgagtccaaaggctgaagaacctggagtctgatgtccaaaggcaggaggaacagaaggagacatccaatatgggagaaagatgaaagccaaaggactcagcaagccagcttatcccaccttcttccaccagctttgttctagccatactggcagctgattgaatggtgcccaaccacgttgagggtgggtcttcctctcccagtccatggactcaaatgtcaatcttgtctggcaacaccctcatagacatacccagaaacaacactttaccaactatctaggcatccttcagtccaatcaagttgacatctaatattaaccatcacatgtaccatggaatactatgcagccataaaaaagaatgagattatgtcctctgcagggacatggatggagctggaggccattatccttagtaaactaacacaggaacagcaaatcaaataccgcatttgctcacttataagtgggaactaagtgatgagaacacatggacacacagaggggaacaacacacacttgtgcctaccagagggtggaagtcaggagaagggggagtaacagaaaaaataactaatgggcactaggcctaatgacacctgggtgatgaaataatctgtatgacaaactcccatgacacaagttgacctatgtaacaaacctgcatatgtacccctgaacttaaaataatagtttaaaaaattttttaaacatttttaaatgaaaatgttaaatttgatataattttccattctcttttaaatgcactctggctaaagactgtgtcttttctacattttcatgcctagtacctaacccaatgtctggcacagacaatacttattaaatgaatgaatgaatgaatgcttaagactaccacatttggtatattaccttagtttccatgaactcatttatgcctgtctttcagcatactaattacaaagatatatttttacataaataaataaataagcaaaatgaacaacggtttaggtgccttgtccaagatcttctaacttgttttattccaaagtttctggataaaacgccttcccaaaaaactggctgcctgaggccccttcctcatctctaactgaaagtaaagcagttgtttaaagaaagtttccttctgctttcgacactggcctttttagacacaggtgtgaacccatttcgtttttgtttgtttgtttgttttggaagagggaggaaagattaagatctttctatgactttctttacccttccactatgaccagccctgcaaatgcctagactcaagatcgctaatcttccacactgctggatattgaaagaatatttaaataggcaagctgggcacagtgacttgtttctgtaatccagaactttgggaggcctaggagaaggatcacttgaggccaggagttcaagaccagcctgggtgacatagcaagatcccatctctatataaataaacaaatgcaatttttaaaaaaaatagaaagaaggcaacttacaatgaaaaaaactagaagcaaaatgaagaaattcatagtagagtggaaatatatcagtaattgaaccaggagctctggtgctttttcagactattgaaaacccctccttcctcatctttatctttaggtctctcatgtcattagtcttccttcatgttatatatcatagaagcattttatttctttaatctgcaaaacatatttaagtgttagaagacatttgcttttattttagtatttaatatggctctcatgtagttttcagtctttttttacaggttttccaaaataagttatttgcttcattttagttttttctactttacatctaagttttgtacaaaacctgtaggaagaaagttttagtgacattgctagaattctgtgtattcatttgtaatcttttcttctattccctccactgtcgccctttttattagcaaagagcaactctgctgctattaaactgaaattttatgctaaaggacattttatcccttgccaactttaaaatatgtatttgaaacatcatttatctgtcctctgatgtgatcttccattcattctctacattttttcccacatttccttttgttgaacagatatagatttgtttggtcattgacaggcatcatttgccttgctgttatttctctctgcacgcttcaacattcctgtcactctcatatattgatacatattattacttactggatccctgttctcattttttcccaaatttactagatgtgtgtaccttgtgaaggagtcaaaagtcacttacattttattcaactaaacatgatcagatatcaaaccagatacctgcacttatgaagttgtggttcatctgtgacaagagcacatatgacagtgaaaagatgtttcatctaagtttaggccaattgatgcatgtctgtagaattaaaacaggcttctttaagatatgtgttatgttttccaaagcagccaaacagaacaggctgtagtcattaaaagataattgtcccagtggggtggagcttcctgagacatgtatgtttgtgtaaggttgtccagaaatgaggcaatctaatgagtgacttgttatctttgaaatataaaatatgccaggacactaaattaaatagacccaaatagtcttaaacagaatgggctcaaataggaaagtcaatgttattgagattaagaataaattaactcccacttcaatatgtgtcaacaccatgtttattaagtttttaactaataaggtatgtcactttatgagattctctttattgagggaagatagaaaaacaagagaacaaagttgtgaatacttacagtatctgacttcctttttgtaggcattccagttcagtgaattaaattgacaagagaatgtttgcatattatccccaagtttcatttggggattattttcttaatgttttgagagaagactcagctttagactccagttctaacaacctgaaatgctatcagcagtcccagatccctccctctactgcacacttgcctcccccttgactttcctgttacaaacagctgtagaactcaatgtttgcttgtgtctcctcaaaactcatatgttaaaatcctaacccccagtgtggttaggaggtggggcctgttggaggtgattaaaaccctcataagaatatattttagaaagctctcttgccccttccgccctgtgagggcacagagagaagacagtcctctatgagccaggaagaggaccccaccagacgcagaatctgccggcaccttaatcttggacttcccagcctgcgtaactgtgagaaataagtgtctgttgctaaatctagccagtctatggtatttttgctatagcagcctgaacagactaagacatcaacaaagacactccggaagccactgcttggttaggccgcagttcccacctgaccccagttgcagagcctcactgattaatctctctgtctcctacactatccattctgccagggaattctgcttaagttacagcttcaattgggtgatttttctcttttctaaaacattcaatggttcctcattgtccattgaatgaactacaaatacctcagcccagaattcaaagccttgtacaatatagctccaacctctctctccagctacatcactttctattctctgacataaaccctatcttttagcaaaattgaacatcttatatttcctcacattgtctggtatcttctcctctcaagggcagtgtttccaatttcctttatgaggagcctatccttcagaattattttaaatattgcctactataacaataacttttctgatttttcagtcatatatcctatttcacttccttaacgctattcatttttgccacatgtattgtactttgtatcatgttgattttattgggcatgcccctagcattagcccgagagagtaagcactgcatctaactctacagaacacctcctgcagccaccagaacagggccagacacacggtggcagatcatctatgtaatcttgttttccacaaagactaatcaagtagacagcatatggatgtgcaaagcacaatgttactaactttacaatagggttgcataggtaaagtcaaaacattgttgaatctcattttctaacatgcattgacaaatttttctaagccaccaattcttaccaagagtttagaatattattttaagttagtaaatattaactaaaggatctagtctatattatataaaatattaatttaacatttaatatttcaaatgatctacaacaggaatgctcatccttctctcagaaaccctctgcgttctctcctcactttctttcggtttttgtccacatggtactttctcaaggaagtctgccccctagccaccctgtctgaaattgcaacacacacacacacacacacacacacacacacacacacacacacacacacacacacacacacacacaccccctatctccctttcctgccttattttcctccgtcacacttatcactaatacactgcaatggtctaaatgtttctcccaacattcatgtgttggaaatatatttcccaatgcaacagcgttgggaggtggagcctaatgagaggtgttgaaagcatgatagtaaaagtaaaatagtgcttatcggagaaaacattcacaagcagagaagtggcagagtacacatgatccatgtgccttattagcccacagagtggcacgcttagacaaaggtgaacagaggcacaggaataaaaggagacactctcctcttgccatttttcataatcccaggagaagtgaatggaacagggaacacctagttgactgtgtaacagtgaaagcttccgctcagagaatggccctgttaaaaatgggcagtttcataaaaaagaatgagatcatgttctttgcaggaacatggaggccattatccttagcaaactaacgcaggaacagaaaaccaaacaccgcatgttctcacttctaagtgggagctaaatgatgagaactcatggatacaaagaagggaacaatagacactggcgtctacttgaagcaggaggatgggaggagggagagcagcagaaaaaagtaactgttgaatactaggcttagtacctgggtgatgaaataatctgtacagcaatgcccgccccccgccccacctacacaagcttacctgtatagcaaacctgcacacgtacccctgaacataaaagttaaaaaaaaaaaataggcatctcctcttgagccagattcccgctactctactaaaaaaaaataaaaataaatttaaaaaaagcttccaggcgcttccagaacaatctttcctcagtccactctgggtctgcgggaactcagtgtagataagtctattaatcagctgtggccaataccagattttttttgctgtttaggagtttggtattaataagtgtctcctgcagttaataagtgtccctttcatcattcaggtaaagaatgatgtcttaaatattaggataagttcatattaagagccactgcttgggaaaatcttagaaagctgtttgaggctgtctgtccacatctgcaatagcaatgagttattcaaatcactcacttcaccctgaaatcttgatcctcctatttagattgtctgagtatgtgtccaatccaatgaagagtatcaacgtaccttgagaatgagccacggatttttgtctgcttttttcattattgtatccaactacacagaatggtttctggcacatagtaggcacccagcaaacatttttttgcctgaataaataactgaaatattgacaatcaatgcagtgccctgccctcaattccttctctcatgtctgcatcatcagtaaagatacaagggttgtgttaattcaatgtaagagtttattgccaatttagccacttataaatttccctttactacaatgtgaataagctggtaacggaacaaaattccttatagtaaccaactttcaaaccttgttattaattatagtatgtgctatattatcatgctaacactttattgcttttcctattgcagcttcagaacagatagttaccacacatgatggtgcggggaggctagttagatggccttcaaagtacttggccctccctgaccttgataaccccatttatactcagatgatgctattacttcataccacgtttccttttaacttcttattatctctaaggctctctgccaggatgagaaagatgccactcatttgttctctaaccacctctttctgccccttatcagtgggctttcacccactggctctcatagacacttttctccagattgcataatattacatatttctataccacatagcttgtatcttgacaaatagaatactataatgccaaatagctcctaattctcctttacattaccttctgaaaatatgctttcaaacattttaccccttccttactacgttttctttgacatcctctaacataactttctcttttctttttcatttataaaggcagtatcaaacttgcatgttgcaacatttgtcattgttatgataaccacataaggtctattaacaatctgaatggggaaaaacttatattaataacccattctgttgtatttgtcattataaatccttttgctatcacattatgaattttggaaaaaacagaaataggaaggggaaatatgtctccaaaatgtgcagatgtataccccataatctcaatttcagtgtcctttatctccttatccctctctttctccctagtttctctcactccctggttctctcacacctttctgttgttatatttagaagtaactattagatgtttggtgtataagagttcatagctcatattagtttaccaagggctgctataacaaaataccacaaactaggtggcttaaacaacagatatttattttctcatagttctggagactggaagtccaagatcaaggtgttggcaggtctggtttctcctgaggcctctctctgtggcttgcaggtggccaccttctttctgtgtcctcatgtcatgttttctctgtgtgaacccatccctggtgtctttttgttcatccaaatttcctcttctcataaggacattagtcagattggattaggaccccctccctaagagccttattttgacttaattactcctttaaaggacacacctctaaatatagtcatattctgaggtactgggctgagggcttccacatttgaatttaaaagttgggaggggcacaattcactttataaatatttcttcataagagagaaaaatatagtcataaaagtatagaattcaaagtaagttatgaaaaatgtgataaactctaaagattaggttacaatacacgatgctttttgctttagttggttagatatttgattgttattttgtttttgaaagaaataagatatgagctagaccacaagaggatacaatttgacttcaaaggataggatttctgcagtgaaattggagaaaagtgaagggaataaattgcacacatcccagtggcaggaaaacaaaggactcattaaagaatagagaattgatctggctggaatgttgactatcggagagcgttggtttgcaggagcaggagcaggggtgcccctgggtaagaagaagtctagagggatttcagactagaaaaggtaagtagaacttcactgtaaatctgaggaatttggattttattctgtcagtgacaggaaagaattaaagtcaaagtgctcttgatagttcttttgtttgcatgtactgttcagtgttgaaaatgggtaaacctggagaacattatgctaagtgcaataggccaggcacagaaagtcaaacaccatgtctcacttatacgcagaatctaaaaaagttgaacttatagaagcagagagtaaaatggggttgggggaaagcagggtgattggggagctgtttagccaaaacattcaaacttttagttagacagaaggaataaattcaagagatctattgtacaacatggtgactatatgtataatattagttcttgcactgctataaagaaatatgtgagactgggttatttacaaagaaaagaggtttaattggctcacagttctgcaggctgcacaggaagcatagcagcttctacttctggggaggcctcagataactgccagtcatggcagacgcaaagagggaatgaggcacttcttacacagctggagcaggagcaagagatggagggaggtgccacacacttttaaacaaccacatctcacaagaactcagtcactatcaggagaatagcacgaagggggcaatctgcccccataatccaatcatctcccaccaggccccaccttcaccattgggattacaattcaacatgagatttgggtggggacacaaatccaacccatgttactatagttgataaagggttgtttacttgacaactgctgaaagagcagattttaaatgttctcgacatgaaaaataagtatataaggtaataaatatgttaactagattgatttagccattccacagacatattttaaaacatggtgttttaaacaacattcatagatactgtttttatttgtcagttaaagtgtatataatttaaaaataaaataagctctatattaacagtagtctgtattataaagcatttgcttccctcaaatgtttcaacatttcctatgtcataactggaccccaaacttagctgaaattttcatatacatattcttaaggacctaaaccagtggtttgctttggtcctatgatcacccttcacaaagtctgacacttctgcattatttatatcagtatttctccaactatagtctttggctctttagatatctatgaacttattctgaggagtggaagaaactagtcttttttaatttgtaggttcttaacatggggttcttgagcagaggtgagaaaataattgcatattttattttcactaacttctaactgaaataaaacatttctctttaaagtaaattggcaacacaggcagattttttataggtcattacaattactgtgaaaaccttgaaagttttttaatgcttatcactaatttaaaattatgggggttatcaaacctgatgacagatctcattatttattggtaataaaaattcaccaataatatatttgtcaatgttatgattttttagatattttgattactgtaattctggataattggtttcatcttactggttgaatttagttttatgctttgaaaaactatcctgagaagcagcccgtaagctacaagagacaggcagaagagtctatgggataaaaatggttaagaatccacaacttagaaggagtctatagtattactccagtctaggggtggagggagaactgccttctgttatcactccttgctttaagaaacctgtgttcaggcttttgctttgaatactaaaccatctatttctgtatttatcatatttctttgagtcgatacctttgagccttcctagatggcttcttatcacttgaagttgactataaatggattcttttattttgtttaccctggagtcagaacaggcaggaggaaatcaggttgagaggagtaaagcatcccaaggaaaattttatcaattaaatgttaatgcaaaaaaaaacctattcattctcttgatttgtgttactttaaggtgaaatccagaatatcaaatgaacttatcaaaaggatgcctaaatgctttcaactttttggtgagttctttaactaagttccactaggtttaaaatataaatatattgtttccacttaagcaatctccagataatattttaaaagataatgaaataatatctaagaccctcagatggaagctactgtattaagtgctaactctaatcattattttcttaaatatttggatatttggatctcactgaaacatgtaacattcttttgaaatgacctgtgaatagaaaaatgcaatcaaagcatgttgcagtggaagcacctgcttctctccgttctgtaagaatagagtctcaatgaatagcctgctgaaattccaatggctttatcaaatgagaccctgaccaggttttccaacaatatttaaagcctcccttagtgatttcactgcatttacagagagacctcaacaatcaagaaggaaatgtgtgttttgctctttcttggctctgttcagtccctggttttatcaagctgccgcacagcacttctgtcctgaaagatgcctgtgtgacttggataccatttcatagagtcacactggatcctcttatgtcctgccaattaaattatcttctccagcctttattcctgccaaagaggctcaggctgagataaggtcacactcctcttaagttgtttttgaaatagtgtggaaggcctcatgaagaataagaacatgcacaagcattaatgcctcatcttccccagcccccttggtagatactgaatttctctgcagaagttccttctattgtgtaccaccaccctgaatctctaaaaactgaagagtcctccttaatctcattaaattaaactatagcactacacaaagcatgtgctaaatgtgagattccattatcactgtgccagttgaattacagatcagacatcataggaactgagaggaggttcttaaattggtcctgttcagggaatctagggaacaatacttgactctcttctgtatttatataaaactatctctattctgctacacatctaaaacaaaattaaatttttgtaagctatctagataatggctatttttcatgttttgcattctacacttctccttggcttttgctttccccatcagaatgtttcacaagacacaactaaggtaatggatctttattttataaaacacacaaagtgtaataattgagctttcagttgatttcatattttgcaccaaggtactacctttccatgaggagatgcctgcaaactcaagctctagacttataggagactataaagtgttctctaagaccctcgtttaaagtgcctcttaggacttttgagactgtcgagatgaattctactttctgggtcctgaatccaaaatgagcggaagaggacctacggttgccctgtaagagtgggtacaagggtaagaagtcctcagggtgtggcgctcagactggctcacagacataccaacttcctctgaaacttaaacattcccagccacctgtcccttccacgcaccctctccgttgcctactcacaaaatcattgttgtattttgtgtaaaacctcatcattcctttatgtttccgatgaaagattcttgctgacccttagtactccagttccccaacccttgcaagggatttcatactcagagaacacatggcccagattggagaaactgcaaaagcacagatagtcactgtttgcttgcatatctgctgacacagtttctggcacgatagaatattagcacgaggaaaagctaggctcttgagtatatgcttttcctaaactctctctctttatggagtcttctcaatccaaagaattataacagaatgaagagtttaaaaattttaggtaaaggaattgaaatcagagatgattgagaaggcttttgagctgattgagagatctgtgagtattttcctcctttgagctgtcttgttttttgttttttgtttttttgacggagttttgctcttgtttcccaggccggagtgcagtggcgccatcctggctcactgcaacctctgcctccctggttcaagcaattctcctgcctcagcctcccaagtagctgggattataggcatccgccatcacgcccgggtaattttttgtatttttagttgagacggggtttcaccatgtcggccaggctggtttcaaactcctgacctcgtgatctgcccaccttggcctcccaaagtgctgggattacaggcatgagccaccgcgcccggccctatttttctctttcttagcttttctgtttcatcctatgcttaagtaatttctgatttatactagatactataaataatattttgtgaaatcttgggattttattaattttccctgaaagttgttgagttattttccaccaaagacttttaaatgactgacaggtaaccataaatttgtagaggtttggttttctgctttatgaaagtgggactattgtggtttgcctcctaatcctgaggaaatcacttagtcctaggccattacctttactcttaagatggggaagtctgagtatttaccaagcttttttagcttggcaggtcttaaactccaaattttcttatctcttcagttaaaatatctactcagctctttatagccttcagctctattttttttctccctggacattttgggacctcataagcacgtatgcagttgaggagtcacacaaggatttgagaaaattttataggcagatcttgatatctttcactgttgttctctcctttcaacactctggtggtcctgcatccatgctctgaagccagtaagggtgtggttttctgcttctattttagctgatccacactgcacttgcccatttatttattggtccattcattttttacttttattttcgtctggtgcctcccactaaagtgcaatctctgggagaacagatttctcttctggcaccactatatttcagcacatgatgctatgcacagcacacagtagattcccaacatatttacctgacttttgatagttttacatcatatcatgtgacaatggctttatattaaagttatgttaaattacattaaatttataatttaatcacattaaattaaagtcatgtaaattcttgaaagaccactaaaagtaaaatcaacagagtgtttacatcctcattctagagataggaaagagtccaaaacatttaaaacaaaacactaatcattttgattcaaggagatgtcttaataaactatgtaaatgtatataatttgtagatggtatattactgtaatgtgtgaaagtattgagtataacaaaccaggatggagccatttaactttttattaagcttctatatccaaccttattgcaaaggaaagcatgtacaagctccccacttctgtcaatgtggaaatataatgaatttttcctctgagagtgctgaacagccatctcagctaagttcttacctctacagcaaaacatcaatctaatctgtcatctcagcagcactcactggccattctgtgaaatatccttctgctatttgagagctcaggctcctaaccttcattatcagaaaaataacgaatcacaccatcctaatcctacagtgtttcctaagctaaaaatgcaatatcataaactttatatacaacacttttgaggtagctacaaacagacatcagtcaccaaaaacatactctcaaacatttcctagatataagaattgtctaattattcataggaattgtctaattattcatacattcaaaatttttgtacctgggggaaaaaaaaacaaaacttttgtttgattttctccatcttaccagcaggattttagtaattggcatcatatatgaaagaaaaatttatacttagcctgttcctgtgttgtgtttctttccagggacataaatattgatgcaaacaccatttaaaaacccattttatagtgtcacatttacaaagctgttttgggtcaccacaatcattggaattcattcacccctcagaaaatactttattctggtcataacatcacatttttcctctcatgcagaatgaacaatctatagtcacatgttgtttctttctttaagccacagtttctaaattgagtgtctagcatttataatcaactgcttcatttaattcaggtcgattttaaatgctagccattcatttggtggactgtgagcagcctgtggttttgttagatctacagcataaagaaacagtttttcttatcctgatcctatagttgtctgggaaaggtgacactcggtgagacataatgataagaaaggctacagatgccctaggcagtcagaaccaaagccagatgattaaaccattctgcagcattccccaaagacaaagcaagggaagcaatgttttgaatgtttagtactaaaaaaattctccagaacagaagtcacacatactgtatgtgtttttgttcctgcaatcccccaccctctgtttctgtagttcctcctattaatgaagaattcagagagggaggaatgatagtttttgcatgcctatttactgggatttcttttattcatctgtagagtggaaatatcaactagattaactttgaaagattataaaaaaactcagaattctccatgtctcctcatgaggaagattgttttccctgtttcaagcaatgcacctaaacgatacactccttcattttactgattcctcttacttattgttctagtagaggcacatcagtcggtaaaggaattgaaatgcattcacgacatttgagtttgctagattcatttacaagtgattgatgggttcacctggcaacttcaagacctatttgcttttaaaaatcaaacccttaatcctaaacctaacatgaagattcatgacttgagaagataatttttaggtccctgtagcacactctatattgacattcttgttttaggtagagaaatgtggaagagggaggaatagtgtgtatagtttcatatgtcacaccttcttctggaaattcaagagttaatctcttttcctttattatcttcaacttggtttcaggcaggtagtggccctctctagagacagattctgtcagcactttaatagctccctcaaatgagaacagtcagcttcaataggggttagagaaaatagagtacatatttgctttaacaggagaaaaggaaaacattaacaaactaaacattactttaaaaacatgaaaacatcacattttaaatttaaaactgcctaactaaatcttgcagtatgttattggtatcacctgttcctagatgcaactccagcccttttcctactggacttggcttccctcatgtcaggcagccttccccttgggaattttctgtttcctgtctgttagtctccattcacacccttacactcatttcagcctttctgaaaaaggaggtggtaaaacttcactaatctcttagcgaaattctcactgtgtatctgtgtacaatgtgctgaaaaacaccttcaaatcccatttccatttccccagagaattgggcttcctggagagagatattaagggttttgtctgccttttttaggttgacaatatcttttattttaactgcctctgcatgtcatctatttcaagatttcttatgtaatttacacattttaatttactctattctcttattttagttttttccccttttctttttactacctgaaatctgccttctcttattaacgatgctctgattcattatttcacttcttatgatctgactgttttaagtgcaccagaggccacttaaaagactattaagcctccagaggagtgacaggtacttttgcactagcccaatgattcttacttgttttctatctgctgccctcatgagagctttctttccaagcatacactctatcatccctataactaaaataataccaaaaaaagccacgtacacagttcatcttcctttgccatatcaggagaaccagaaaattgtaaagaaaagagagtaagaggaaatctaggaagagctgacctcatcattaattaacagctactggtaattgcacgtttctatttataaagcttctcagaacctcctatgagacttccctgcagatcctaattccatgagtatcttgactagtccaaaagcccttactcctaatcccaacgagagctaacataaataggtgtattgcctaagacagttgcttcaccataagacattttagagaatctgtacctttgaagtagaacaaaaagtgttgtggatatgtcttatttagtttaggctatgtttaacacagagattcatattgtttatagaagaattaagaaacattttgcataatatatgaaatgttttaaagtgtccatgacccagcaatctcatttggaataatataccctcaaaaaaattgataattgaaccaacaggtgtgttttcctaggatatgtcttttacagaaaaaattgaagctacctgaaaataggagattgagtgaattttgttgtatcaatataaggaaatatatgtaagcattacaaaaaatgattgagagttctattattgtcattgtaagacgatattttgctgagggacaacagtagatttaagcagcatatataatacaatgggatttaacacttttgcaaaattgtgtttttatatgtagattatagtgtattaacagagattaaataaatggcagaattatgagttatttctctttttctctttctactttttctatagtgagcatgaatcaattttgaaattaatgaaatctgaatctaaattttttttaaaaagtgtttatttcttagagtaaaaacacccagcaaaaactgaggaggtgacacttaagctgagttttgaagaagccagaagagttctctaggtgaatgcagtggttctccttcatgcaacagcaggggcaagggctgatatatgttagaggagttgctagagagaatggcatttatgaatactataagtagctcaatgagactagaacatacagtgcaatagaaatataatgggtgtgaaagtcaggaggcaaattttgaaaatgccacatatgccaggtaaaataatttgaattttgtcatgaaagagtgagaaagatattttttaaagagtaatggcataatagaattgcatttttagaaagatcactcagaagcattgtgaaaaatgaattggcaaccttttatcatacactctgccagactgaggcagtggcaatgaggtgggaaaagaaataattgagtttatggtcttagttgtagaaacttagggctttgtagggtggaagtataggtgtaaacattgtcaatgataacctctgagattcaggataatccaatggaatagtcaatggtgccattccctgtgacagagagcaagagacgagggccagagttaagggggaagaggactctgtgctgtacatgatgagtttgagacacacagagtttttccaagtgaagatgccgagtgggcagctgcacattagagcctggagcactgaagggagatatcagcagcatatgtggatttggggaatctacttcccatgtgcaggcatgattttaaaggattattttacacttgcttttcacatgcttttcatttcataacttagagaaatctggcttccccacctcctcgtattaaatactgttctcactaaaatgatctccaatgacttgcaggaggctaagtccatatacagtgaaagttgtggaacgaatagagaaatatgtaaaggaagaagcaaagagggcttaagagacaacttagagatcacaattacttaaagttctgttaacgaaaaaactcagacactgtggaatccaaaagcaggaaggatgggagaggagcaaaggttgaaaaatcatctatcaggtataatgtttactctgggtaatgggtacactaaaagcccaatccctactagtatgcaatatacccatgtaacaaacaagcacacatatcccctgaatctaaaagaaagaaaaagaacccaaaactaagactgaaattcataagtaggtgggagaaaaaaacataagagactattgttactaaggctgagggatgtgagaactgcaagaccccagaggctttttagtggtgttggaacttggccaagccaaataaagtcaagtctgaatactttctgtggacttagtaacctgaatgtcattagacatcctcctagtgagaaccgttttaagatagaagagaaagtggaagcctaatcgctctggattgtggaataaaagacacacaaagagcaagtgtagaataacccttcaacaagcctggcagcaaatgggaaggagaaagaggagggagagagaagaggtgcgagtggtgggggggtcactggaagcctttttaagatttgcatttcttttttcctgcggggaaaggaatggtagaatgggaaaactgaggtaattgaagaaaagaaacagaaggacacagcattcggaccagaatgaaagatcagctatggctcagaggttaaagactttacccttggagatgggtttataggcctgcaggctggatagcaatggaggtaaatttgaatgtgggaaaaatttgggagaatttttctaagtagaataccaggtacaaattacaagttatattcagtttctcaaagagggactagacccagcaatttctatgcagattattggtgctaaaataacccaggttaaccacattaacttcagaaacacaataaaagggactttttcatgtatccgattaaattactatggaaaaataatagagtggggttagtagtgtgagtgccaagaaaggtgcaatttaaaatagtgatcaaagtaaaacttactgaagtgacatttaaacaagatttgaaagagatactgagaaaatattgcatgcctaaaagctgccatgggcttctattttcaagtaataacaaggaagctcatgatagctagagaagagtgagtaggagaacaagaggaggagattgagtcaaagaggtaatggggagacacattatgtcacatttggaagcctctgtaatgacactggcctttactgagagtagattggagagtcatggaagattttgaacaaaagaatgacatgatcagacttacattcttagatgatcaggctggctgctgtgctacaagtagactatgagtaaggctgaattgttgcaagtggggagacgagttaggaggctattgcagtgatctaggtgaaagaaatggcaaattggacctgggagacagcagtgtagatggttaaaaacggtcagattctgagtataccttgaaggcaaatcttacagtattttctgacagattggttctataatgtcagaaaaagaagagtcaaggatgagtccacaagcttgggacttaacatctggaaggatggcattgtcattacctgaaacagaacagctatggatacagttaggtgtagtcaggtattagggagtagagcaggattgtagtttgcacatagtaagtttgaaatgtctactaagacgttctgaggggagatgtctggtgggaagtcagacacacaagtatgtccaaagatactgtcaacaccttggctgggcacggtggctcacgcctgtaattcgatcactttgggagactgaggcaggcagaccacccaaggtttggagtttgagaccagcctggccaacatgatgaaaccctgtctctagtaaaaatacaaaagttatctgggcatggtggtgtgcacctgtaatcccagctacttgggaggctgaggcaggagaattgcttgagcccgggaggtagaagttgcagtgagccaagatcacaccattgtactccagcatgggctagaagagcaaaacttcatctcaaaaaaaaaaaaaaaaaaaagatactgtcaacatcttgtatctttgacagtatctttggacagttgttgtccaaagatacaagcaccaaggatactgttaatgaatgtgatgattttaaaaaaataaacctccaattctagagagaagagaagagaaaggtttaatttcctgacctctaaaccatctgtgctctcaaaacacttgaacatagggtatggaagaggcacagtcaatatttgataatcaaataattcaagcatattttttacttccatgaaaggacaatgcttcatttcttttaacaacaggcttttgaactattgagtattcattggactgggagtgaggaaaaaagcagatattcagacaatatttgagacaggcaaatgtggaactcagaagtgagttttccatctgccacttttttaggaggccgattgggccaagccattctgaaccttcttttgcagctttcttgggatgaagccagcctttaatctcctcaaaggaacttctgttcgtattcattgaattaatggttttacttaagaagttgatacagtacagctttaaaaacaacaacgaaacctacattataaattgaagtcatctccaagtagtatattcaagttctgaattaattatataggagattttgaccatccagagaacattacattatttctgtttatttaatcccatttcattttccttcaaaaactcttcaaataggatatagtcatatacaggtaaaactgaatttttcatgtaaaagtgaattgtaattgcatgtgactataaagagatcgttatctgtgaaatgggaaaatgcctgcaacatcaagcttgcactctacgtgagcagtgaccctactatcttagctatgataacactgcaaggagctaaaccatcagtcagggttactgcactggacagcttcagaaccctcttgacactgatttaattgaaataatgatttttttttccttttactatcctgaacatttctgttcttttagagaggtcaagctactgaaataccaatagtatccaaagggtccaaagggtcaaggccaagggcagcaacaaaagtttgtcattgtacagcataagaggatctggtaatgtggaagtacctcactcctgtgccagcttcagtacacggctccttttccctgaggctggcagctctggcagaaattaaagcaaaccttagcctcctaaatccaattgcagtttggattggaggagtttttgttctgaaagaatatgtagtgatctgtgttcatactgtccatcctgtaagcaatgattaaaactaatttagcttggttattcattaagtctccatggacatttttgcataactatggactttatatttctacccaacagtttagcactgactagcccttgggtttattgtaccctacactggcttcttgctgacagtaccatgcttgagactgacttttgagtttgaaaagagcagaaattctagactagaatttctagaggaagagtaggaagtggatcacttcacctctcatttttatttgcactccagtcactcaatacactgctttagatcaaggacaggaaccatagccacagaaaggtcgtgaggaagtacatcatcattccagtctgtagtctacctaattccaaatagcatgtgatatgtgtatgtgtttgggaggtgaaagggtaggatgcccttgccttacaaatagctaaagctcttaagggtagggttgtgcgttttatttctgctatagtcttgtattcatccacacttccactttaatatagcctgaactctcttattatacaccgtaatttttatcacatctttctattatacagtgttttctaagagataaaagtatggtttccactgtttttttctttagcaattgctggagtattatgcttcaaattataggcactctagattgacaattgttcatatatttttgtgccaagtagtcttttatcagttacttacatttagcagaattagaaggtctcatttttctattgctgagtgtctatattcatcttagtcgtagcatattttcttagttatagatattcaatttagattaaaggcttagatgttgtattatcattaataaagagaaatagttggtttcaacctaaaatttttacctcttcaaaataaaagatattcaaggtaatatatgctcatgtgatcagattttttagtattttctaaagatttaaatataagaattctgtataattcagatttttaataaataatattaaagtgcagatggaaagttatgcttttgtgtatttatttatgtttactttcctaatcagctgcatataaaggaagaaatttcagtctatgaagtgtatattctaaagagctatcaaaaatgcccatggatgccagggagaatgtagccttttacatcctgagcttgactggcagacagtagagtggttaagaacatggattctggagtcagtcaccctgggtttgaatctcagctccactacctattagcaggtgactttgaagaagacttttaacttctctatgccaccaattcctcatctataaagagaatataataactatacctatctcataaagtgattgtgaggagtaagaatttatgcataaacagtgcttggcacagaatgaatactatactaatgctaattgttattattcactaatattctcatattgaatatattcatcagagatgaggaacagcaaagtctgcctgccttttaggaagttgtgaaggttgaaattgatatataacttggaatagtgaagttgcaagtcactgggagtcagagttatctaaagaaagggatttagaaggaatcatactcacaaacaaattctagctgaggaccttttagagtggaggaaagaggtgaggtataaaaaatttctcttacattgtctaattttagaaaattgacctgcagaagcagactgaggctaattacagaattcagccatccttcataaaagaccacaaaaatcagcagaatgtcatttcttactcagtatttcttgctttattagaaatcacattcacacacacacacacacacacacacacaaacacacacacatgtacacagagatgacatccagtaatgaggttttaacaattttgaagtcattaaggtacagtgaggagatagacagattgtcatcaaacttcgcttttctgggagaacaagtgataatgacagcatctttaaaggcaagaaaaaaatgcaaacagcttgctctccccctgagctctgatgctgtggtaataacaagctcatgcctttgtatcttttcaaatgtagtcggaaatataatggaatggaaaacatgttttcctgaagttaagggaaaaaaactacaagtcaaaggagatattaaaatgccgagtttaaggaacgaaaacatggttcttatagcacttgatagcaatttttaaataatacttcaaaaaaaaaaagccctgcataggggacaattctcagcagtctccttttttgatatttgacaaattatcaaattatttttcttctcctactcttgtgtttctttaatagagtcatcaatgttgtattctccttgatattttttggcaagtgtataataaaaaaattttaatgatataataatttaaaagagaaagtaagaactgatgatctggatagaattagtttgatataaatatagagaaaattcgagctcagaaatatgagtgatatttactaataaagataggtaaataactcttaaagaacttttaaaatttgagtagtaagagaagcaattccaatccccatatttaaacttctcttttagaaggcgattccaaaaaatctctaaattagctaaccattctcaacctctgcctgcttaaaggaaaaaaaagaaaaaatcagaaaccacttgagccaattaatacatatactagggagaaaaagagacattaaaaactaccttccttcttgtaggaatggctgaatagagtcaaaaaccgatgaacatttacaaatgaggagaattaatatattttttgcttctcctaggagctcaaagtgcattcatagttatgatttttttatcttcatcttgggcccataaacgagatgaaatatattgtcaggagcgcaagaccagcctggccaacatggcaaaacttcctctctactaaaaaattatacaaaaattagctgggcgtggtggcacaggcttgtaatcccagatacttgggaggttttgagatgtgggagaatcagttgagccctggaggtggaggttgcggtgagcagagatcgtgccactgcattccagcctgggcgacagagccagactccaacaaagaaagagagagagagagagagagagagagagagagagaggaaggcaggaaggagggagggagggagggagggagggaaggaaggaaggaaggaaggaaggaaggaaggaaggaaggaaggaaggaaggaaggaaggaagtcctcctgtcactatttaatcatgaaatcctaaagcaaaattatttaaatgagttggttcaagatataagattggaagtaactgaaaataaaaaccagttaatccttgagagcctaatgtcctttaacagatgagtaagtaaataaattgtggcatcctggaagagttttgctataatggcctccaattgattttgacattgagatgatagcaaacatcatacagagacctgagaagtgcaccttactattattgctctttaagcctgccacaccagtgtgaacaagcccagattattctgatgaatgattagatatgtgagaccacaaatatggggtccatttatttgacttcatcacccccacctaacaataagccaagccccagaaaaaaagtgctacccagatgattcacagtcaaccatagactcatgagtgagcccaaccaaattcagcagaagaactgcccagctgaactcaattcaaaatgttgacctaaaacacaatgagcaaaaatgaatggttgttactttaagccactaaattttggtttggtgtgttatgtctcaaaagttagtgataaaattatattcacatactgatagaacgccagttgaaaataaaacaatgaattactgttagatgcagtagcttggattaatctaaaaaatattatattatgctcagtgaaagaagccagacaccaagcaataagattctattgtatgaagttcaagacccagcaaaagtattctatggttatcaaaatcagaacaggtgtggcctggtgggtggtgtaagggttgggagagtggtgaggatgaaaggccaagaaggaactttcgggggtagtagaaatattcttggttactctagagaatgctgatagtccagtagtccagtttaagaattaatatgcaaaaatgaattaagttgtgcaatataggtatttctcagggtgctatatgagcacagagagtgaggaatgcctatctgtgctttttggtgtttagaaaatatttccctgaggagtagccttgaagtagcccatgtttcatgtaggcattcactatatggtgataaatgttgtttgttggacagagaaatgccttattcaaaaacataaagatatcaaacagcatggcatgtatagtagaggaactgccagagatttaatatggaagagtaaaggggagccacaagtgttggggctgaaagcataggcttgagccaatcatgaatgtccttcgacactttgctatcatgtctttaccttgtgagcaaaaagagttatcgtttagattttcaagctcttagaatcatcccatccatctgactctccacctgatatgagacttgccttgctcaccagcagtaaactgaagacaattagtgactcaccaatatatgtctaacataagaagcccacgctggtgtgtagaagcacgtgtaagcaattcagaggagaactataaaatcatgatgagtcggaaccactgaaatggtaattaaatgagtgggaggagcatgtgcattctcctacatgctccaggtttcccacaagtagtattaaactcctctgtgatttgtctggtagctgagccactttgtttcttgatgatttccaagctctgctaattcaaagctcagtattatcatctgtatccagatttccgacttggaaaactaggtgaacttaattttaacttttttttaagtgaatgtgaattcactctgattattagaatcttatgttccctttgcttgagagtattgtcagttttgccttttggataaactaagaagactgtgtgaaaatgagaagcataggatttagggtccataggcatgaatcaagtcctctcattatgtctgaatcttgggagagcactatataacttctctaagcctcagttttttcatttataaataatagatgatgatagaaattatctccttagttttggaaagaatggatagcagaatggctgtaaagatgttaccacatgcccagaatatagtgaacagtaatggcagctattactttaaatagtaatcactggcatttcctttcctacctcccagctgttaccaggatgtgaggggttggttagatgattggttggttttgaggtttaagcactaaaaataaaaaagtaatgcacagaaatacaattgcactttttcctaggttatatattcccaaacggtaataatggtattgctagtaattaatgaaatcccttcagtctgaggtttatgacattctgtttcacccttgcattggctatgagctacgtagaaagaagacaatctaagatttatattgaaaagaaggtaactcagatggaaaggaagaaagggtcagtgaagaacaccaattatagccaagttctgactccaaagttattcagtccaactagattatactgctacacatggatagacttgacgggccttttaagtgacacttcgattcagtattgtgccttttaaaattgctttgggaaaaaactggtcttcaaatttgtgtcttccccaatccacattttattcccctggagggttctttttcttttcctaccttcactcccattcatcttccttgccacatactgcaacaagtactttgcttcagaggcacgctttattggatgccacataaaataccttttcataagcataaagcttattcccacagatgtcatgggaaagggaccaattgctctaaggttcctacttaactgtattttcaaaaccctaataatgcatctgagtttacgataacattttaaagtcactcttctctctagctggtttgtcctgatgtttccgttgagtttaactgtttcttttttagtgcaatgagagtactactgacatcatttttgtataatattaatcaatgcattatttttgatcactggatatgtgctgaagtctcaggtgcattgtatattccacactttccttatcttccaatctagtacctctaaaaagaaggaaatgttaacgtagttttagcccctttctttttccaaatgcacctatttaatgccagttatttttgcaactaaatattttaatacaaataatcttctctcctagtctctacagagaaatctggccttgtgttcccattgtcatcactggggcagcatactccttccagtgaaattcatggatccttctttagccttgtctactaatgttagagaatattcaatatgggcaaatttatttttacaaatgccttaccttttgtatagttaattttgctattggtaccctattatctctgatcaaaaatgatgttacttgtaccatttgctccccaaagagctatgtagtgattttgttcaaaaattctgtagacagtattaattgtgtacattttacagaacatttaaaaattacactttctgcttcaaatgattcattatgaataaatcagagttccttttgcacattacaaacatacaatcttaaacttagctttaccattaaaatagtatggtattattgatagttgctttttacatttcccaattattttcaatgaatagttttggttaaggactcccctatggctcttatctctaaaccggaaggcgatttcatggtagttctattgcactagattggccatttctttgatcatctcccaaccggcacatgtatggaatggttgaactactgctgtcaatacagttttaaaaacgaatctgatatgtaaaccctgagagaggtattaaccataatgacatttgaatgttattagccatctttcgtcctgcctgagtatcttctgctctgcccagtttactaatacaccagactcctctgaactaggataactttttgataagtttggactgaagaaatctaccagtttccagagactatttcataacaggaatgatttggtaaaccagtgttggcatttagttcagtctatttcccaacttaaatagataataccagtttgcatgtatgtctagttttatttaatcttttaaaaagtgtttaatacagtcatgcttgatgatgcagcagaatacctaaaggctggtattaagatatgtttctgatcctctgaaaagcttttctgacccagtaggctgtgaacattcacaatagccctggaggcaatcctccatgtgttattgcaggttgataactgcacctggattactcgtagcagagaaaatttgcagtgtgttccacaatagtccagccagtggattagtatgagataagaatcatctggtaaacaatacagatgatataccagcccacataataaaatacttcatataaagaccttcattaataacactgatataatcacatttgaatcctttgctgaagcaatctcaaattatgtagatggaataagatgaaaaagagcaagtaaaaatcatctgcaacttaaaattatactttgtgtgtgcataatatccttctgttcaaattcctattacaaaaagcatgggcttagagcctatgaattatgaattcagaacaaaattggattatttaatttaaataaaacatacaaccaatgtatttggaatgtgagataattgtgggtaaaaagtagtgttgctactcctcatttctaatcatgttggcataaaggcacaaaattaaaatgtgtctttgtacttaagaaaacaagcatatctacttggtttagatatatttataactcataaattataatatgaaggtttttaaacataaatagaactgtcctaaaatgtagtatttttcaagtaaacttttatggtgagataattatagatcatatgcaattatatgaaataaaatgagagattctgtttacactttacccagtttctccaaatagtattaccttgcaaaaattagtacagcttcacttttcggatctgggtattgatacagtcaagacatagaacagtttcatcaccacaaggatcccgtatattgcctttttacggccacattcacttccttctaacccaccccccttagtccctggaaaccaccaacctgttctcgatttctacagttttattatgtcaagaatgttctacaactaggatcatataacatacaactttttgggttggctttttttcactaacctcaattctatggaaattcatgcaggctgttgcatgtatcagtcatcccttcctttttcttgctgagtaatatttcatggtatgggtataccagtttgtttaactattaacccacagaatgacgctggggttgcgcccactttggggcgttatgaatagtgatgttatacatattagtgtacaggtttttgtgggaacatgtttttatttctctgagataaaattgcactcctgtgtaggagtgcaattgctggatcatatggtagttgcgtgtttagtttgtaaagaaacctccaaactgttttccagaatggctgtccataaatgtttccctgtttctgctttcaagatatctgtttttgggtttcctaagtttgattgtcatgcatcttggcatgaatttctttagatttatactgtttgtggttcactaagcttttggaattagtaagtttgtgtcctttgccaaatttccgaagttttcagtcattatttctttgaagactttttcagtgctgacctacttctccttttccttcaggactccagtgggggaaaaaaaagttaggtcttttgttatttccatgagtctctgaggctctgtgcatgttttccagtttactttgtctctgtttcttagtttaggtaatttctattgttcaatcttcaagttcactgattctttcctctgtcacctccacatttttcagttctaagttttcagtttggttcttccttatatattctgtttctttgctgagaccttctaatattttaatttatttcaggcatgtttgtaattgcttattggagcatttttgcgatgtctactctaaaatatgtgtcagaaaatcttaacatctctatcacctctgtggttaggttacattggctgtcttttcattcagtttgaggccatcctcactgttggtatgattagtaatttttaattgaaacatggacatttggggtattatgctatgagaccctagatcttaattaaacctttcattttagttgattcctctgatgctgttttgatgggagaaggagggatgctgacttatttctgccaattggggatagaagtccagggttcccacttagcctccattgagacttaaggtgggaagggcttttcattaagtttgggaggctgtggaaggtcctgccccccactagcctctgactgatagctccatatctggcaagagccttattactgctccaaggtggctttcactgatgccatgggggtggcggactggcctcagtactgctgggcattggtaaaagtcctgatcttctactaagcttccactgacatcaccccagtggggagaagagagtgtctgccttgttactggagagtgaggctaaaagtctggattacttactcatgaggcagtggggaagtcttggctccctactctttgttgctgtggttggggagtggggctacaatttttgtgtttttgttttgttttgttctgttttctatggtgttggctaaaacaaagaggtactatcactgtaaaattttctgtcttgctaggctgccttttcccttttctctggtcttttggctagagacagcaagggtttactggggcttttaaaaaatctgtacctgttggcatttcagagttataggcttcttcagctccaagtaagtctggtgtatatgaaataataataataatggaattcaccctcatgtacttttttgagtaccaaaggccatagctggtctgcctcaaagtcttcttgtaattgttatatatataatgttcagagtttttagttatacttaataggaaagatagggaaaggtatccttcccattgctccaacttcccagaaaccgaaatccagaatgtaatagattaaacgctaaggttgctatattttcaattattacaattaaatcttttaaaatacttaccaaaaggctttggtttcattttttctattagcttctaagtgaatttctgggacatacaatcataatttggtctgtggatacaaaaaagaattttaatctgatttagttatacagagaaaatatcatttccttccagtcagtgataatatcaagatgacatgtaattccttaccaggtgaattagaagtgaacaaatcacattagatacatgaaggtgaaaagataaataaaaaaaaaattatacttagctctgctttgaatgacaaagactaaaacaactagaatattttatttctttcactagtggataattgtgtgtttgcctaggataatgccacaggtcccttccattattattctaagcatctttaaatcaggaacaaaataaaattattttctttcaattgaagatactcatatctactctaacaacatgagcctctattatctgctttgtgccgtgttacttccctttatacagcccaagcttctctgaactgggccacttcctcctccctatttcttcccagctctagtctaaactccacttggaagatgtactctccatctctccgtacccctctttattccatttcaagccctcccacctctcaaggtctatctcaaaagtgccaagcaccaacctactccgagaatggattaccagttcttggaggaagcagcacctttattcagccttaaagaatgaattagtgtccattagttgtttttcctgatggatattaactcattctttaaggtcagcttaataccgggagatgaaataatctgtacaacaaacccccatgacacaagtttacctgtataacaaacctacatatgaaccctagaacttaaaataacagtgaattaaaaaattaaaaagaagacccgggaagtaagcaggcagtactgccatgtaaagctttatatccagcttagcaactcaggactctgttttcaaaaacaaatgcaaaaaaagaatgagttagaattactcattactggaggtgcaaggctgactagggaggggaaggaagaggtacagggcattagcattctttgttggcagactgggaaaatgagttaaggaacagagaaggaaagctacctgatagatgtcagcaagctaccaacagctttctactgacatcaattctgacaaggattggtgagagatgaggctagaaaggaagacaagtatcacatcaggaaggatttggacccatgaaaaatgttatacttttgtagggggtgctccttcagctcattgtgtagaaaaatggcatagttccattggcaatttgacacactggaggcccactgattatggccctaatctggtcttcacagctttgcttccattattctagtatgaagtccccaaactcttatcagatgtgactactggctcttacctaaacacaacccctatctttcctgcttgataatctcactctggaaaagcaaattccattttgcctgtcatcagcaaaaatacatataatgctcttccaagggtgtttgagaggattaatgggctaacacatgaaagtgtccaatctactgtttgttgtcacttattaggagtacagttttcttccttctttctgaagatttacctaaatcgacttcaaattacagttatatgtatacctgctacaaaattgcaaactccttaaagctaggactatatttcaaacaatggctctaaccaggggaaattttgccttttagagggcatgtgacaatgtctagagatatttttattgcctcaattgttgacagtcttgattgtaggatgttattgtttaaacattgacaacacataacagcctcaataaaaaagtgcttcccaacccaaaatgtcagtggtgactagaaatctgctttagttcatcattgtagcccaggtagcaattagaagagttgcatgttataggagattggattcgtctcttctcacactgctaataaagacatacccgagactgggtaatttaaaaaggaaagaagttaaattgactcacacttcagcatggctggggaggcctcaggaaatttacaatcaagacagaaggggaagcaaagaccttcttcagatggtggcagcaaggagaagaatgagaacaaaggaggagaaaagtccagtataaaaccatcagatcttttgagaactcacacactatcatgagaacagcatgaaggtaactgctcccatgattcgattacctcccaccgggtccctcccacaacacatgggggttatgggaactacagttcaagatgagatttgagtgaggacacagccaaaccatatcagagacattcagaattgtgggaaataatctgaaacccctttctataggtaaattttataaattgccactggggaggtaaaattaaattagaaatttatattgtgtaggataattggaagatagcagagtttatgaatcttggttaatttgggggacacaaatttccatttgtagttagaagtgaccaatttaaaagctaaagttctcttaatcagcaagcttttgtaacaaaatgcagcaggatttacttttatatcaaaggagctccccagatagttaaagaatgaaaatgaatataattaaaagataactggtaagcagaatgcagtgcagtgcattgccttagctgcattctgggagagtacacttaataatcaagactctagtgacactttaatgagaagtttaaacttattggccatgaatctcagaatgtatcgatgcttgttacctagattttcatttcaaagaaatgaattgatgagtaagaatttttttaaaacagtttgtaattaggacaaattgctttacaaataatttaataagcatttaacactgaaaagaagaggaaaactattgataaacctgtaacatttagccacatatagtaagaactcaatgtggaggaagaggtgaagctataagcaataccaaggggatttaaccaaacccataggccgtttacctagacacagccagatccaagtaccaatgacaagcacccatggcactggctcactccataaaaagagcattttcatgggtcctggtggataaaagatcatgatgtgttagtataatctctatttttccagtacccatgaaaatgctcaaatcactatgtgatttgagtttggacaaatcaaaatctttgctaaagccaaacaggaaaataggagacattggtttttaattagtactcggaactctaaaaataagtcccaaaaaaacaaagaccttgatgactctattatataaagaagtggttcttactatcactatcttattgccaatagttacatataattcagagagaaacatgctgatttgatgagttttctaaaatattttttaaaaagaaaactcattcttctgatatagcatcagtggtatttatttttgactctctaagatgtgtactggtacagatactacagttgggggtagagagggcagggggtacgccttccctctcctccaggatctaaaaacaaaagcgtttgaagactgtgttgcgtaagtcttcttccttcaactctgcctccccagtgtgggcactgctgcttcctgtattgtccaggaatgaccactgttttatcctatgccagttctttttggaagatagctagaatctgccagaacgtgctttctctctcaaatccaaattagggacttaaaagtttcttttcaccagaggccactttgtctcctaacagttctgtgctcattaaatacctattagtgtaccctttgacttaaaatgttccactcacatcctccagaagatcactatctgtcatctaatgaaaaacaacttcattaggcttgtcgtggcggttcctttttttcccgtgcttttgcttcctgattgaagactgcagcttttcctaatgttttcttccccacactgaatattattgtgtggggtcggtcctcagccagatcaatgcctgtctgaaatgtcattgtgaataatcttcatcactattttgaggacatacctttaaggattcctccaaactagatcaatttgcaaaaaaagaaaacaaatagttttccattatccagatattatatttgtttcttttgactagcgctcataagttgactaagtaaatattgtactaataggaaggaatacaaaaacacccaatctgagaaaatagagagatcaagtgactttgctgtgctcctttacaagcacacagacctttttgtagtgtttcagaaaagacgatgcgacgtgtgtaatgccatattcaatgcattttgatgatactccctacttataggtgtccatctcgtcacttctctgtaacatattgtcttaattatactcagtatgccctggctcctgttacagatctgcattttccttacaaagaacccatgcaacaaaccacagaatcaccttaatgtcttccctcaaagcgtttttctgacggtctgtgggtgtccaagttttagaatcgtaggctctgagctaatgaaaagtaaactagaagttgatgggcacaaatgcaaatgttaatccactagtgaatggttataagtctttttctgtattgaaaataatttgttttagattgcctggcaattatcaaatcttacacataaatgcaggtcagagaaaaacagagtaatatatgtatttacaacacagatgagcatcatttgaatgaggaatccacactgaagtcaaggtccagtccgatgagccatgttggttggagccctaagtctggttgtaaactgcctgactttgaaaagccactctccagtgaggtctggtgttggtgcctttttctgatgtctaaagcatctctgttttgtttcagctggcaggtttcatctacgcctgttatgttgtgaaatgtataactgaagaagaggacagctgtaagtattaaagctctattctgtttctttcaagttcaaagcatctcctttactgcctcctacttagccttcctattcctcagacaagatcctacaacacagcattagaatggaaaataagccttttgtgcccatcagactaaagtgtttctcataacagtatccagcaaactgaagaatggagaagcacccattttgaaaacataacttctttcttttcattgaaaaccttttaaaaatcatttcctcttataaacaattctagtagggaacagagatgggagattggagatggaaatgattttaaaatgtggctaacttgaccattctcttttttatgatccctttattaggtattgataactaaccagttttacccaagactacaaatccccaaaatcaacaatttgtaatagttgctaagattcttataaaaactgacttcagattaattcagagaatttgtctttgggaaatcaaatgtccatctgtcctttttgttcctactatttgacacaaatggctagaactctaactatgtcaaagtctcaacattgagacatattgcttgatccagagtttagatcacagtaccctcttacaatcctcccagtggctctgttgttctctgctctccgaaacatggagggtagaaggtttcattccatccctgcccctaaggatctaaaacaggagaactggggaaagtacttctattctctgagggtactatcatgaataattgcctatatagttacatttactctgaggaaaaatcagaattgggaatcatctttcttggtttcaaaaaatatttataatgttgggtttttgaaacagtaaggaaagaggaaggtgagaatatggtgatttgagggaaacatccaaagataaatatctgtttcttcttccctttccaattatactggaaaggaagaggcaatatcaagtgattaatgtagaagaggcacttttcaatcgtactcatacatgatctaaaatcagaagtatacagtatataatttatttcatatataaaaggaaataatggtcctttcactaaataagcatttgtaaaatattcctcagtatttcaagtgctgtgtcagcctttggagattttaggatgagtcatacataatattttacctgtaggaacttgccaactaggaggttaaaacaaacatatgagcaaataagtatgaaactgtgtagtgcacgctgtgggtaaagagaagaaagagatcaggagaaggtttatagagaacagttttgagcttgatctagaaagatgaatagatctttattgtgtagctgatatggaagtgaggggtggtcccaggcaaaaggtgaaaaagcatatcacggccagattaatgtgactgaatttgtttcctgtgctacaggtagacagctggagaaaattggaaaaacaagtatgggtgagatagtagaaaaatgggtatgaagattaaggagtttgggctttatataataaaatcacagatgaaagagcaggtagcttataaaaagagattaacataatcaaaaatgtactttagaaaaaatacattagcatcattataaagaagagactcaagagggggaaagattagggaaaagagaactagttaagacaccatgaaagtgagacatgagataatgtgaatctggacaaggatcagtattggagatagagaggatagatgtgccatgagacatgccgaaatgacatgattagtgggcaatggtgggtactgtgataagggaaaaagaggagactgttagattactgggtatctgatgcaagtgaatgggtagatggaattgccacttgcgaagaaaaatgggaataagatcactagttcagtttgcacaggttgagtttgaggtacctagcgcctatacaagagaagacatccagtaagcacttgtcttatacagaaaagatttattcaaagattaggaaaggcaaaatatatacggattttaaaatgtgtggaccaaacaaactatgtaagttcattgagatattaccattcagtgtctgtgtgccaaatccctgatgaaggggaagtccccagttgattttcatatggaagttgggctttctctgggctatgttgtttgatttcatttcacaatgataccagtgcatttttatcttcagacaatacttactgacataccatgtctcctacatgcataatcagtattttagcagaatagcacctctcaaaggaaatctcagaaatgctagttccacaagacatactgctcaaaaaaaaaaaaaaaaagattccaaagccaagtaagtttgacactgaaaatttagaatgcacatttatatattaacatttctgagagtactgccagaaaaaagtatgtccttttttttgttttctaacccacagttttgttttaatcacattaccttgaggccagatacagatcaaagagaaaaaccagaaagagttctaaggcttgattatatccacagttccccggggagaataccacatgccccacatgggaaggagtggggtcagccatgaggcagagagagagtggaacctttagttcaaatcctacaagaagaaatggatgaggcagggtaggaaggcttattaggataggttagctatgttgcaaagttgcgccccatgaaattcatgttcactgtgactattaatgcataggtttagagctatctaaaatctccacatgctttttggggatgagccagggcttacttggaaacagctagtggtcattttgtagatgttaaagcatcaatttatagaaattaaaagtatggttaatgcaagtctcccaaaatatttgaacacaagactcctgttttccatcaacccctgcccctctccgacctggacacctccagaaaaaagcacttgatattctggagaattcttctaagggaattctgccctaaatcaagttttggccaaagcaatgtaaattcaaggcgattcaaagtcaccaatatctgttgaaagatcaagttatctctcaatcatctaataagcctttttcccctgaaagactccaaaaaataacatatatgtttttatgtgtatcttgaccacacaccacatctgcctttattaatccaaaacacaagcagacttctcaaagacacgttttatcatgttagtcttattgctcagtgcgcaaaatatgaacccttctaaatttttatacacaagtagactgacgcttgcctcagatgttcatgggactagtaaacaggtgggaggagatgttcatttgggctcgctgtctgtccagttgtctttggtgactttcagttaggttcatttacttgtagtcattcacacctagacagttatgagtatcttttggttacaatgctttgggttgatattctctgtatgtaatcactttcctgatgtttatcctcagacgatgcctggacatatgacttccgatccatagagtaaaaaaggtttgacatttctgtatcattttggtaattatattacaaaaaattatcctgatccttaaaaagttgggtgaaaggttaaaataaaaccactctcaagcaaaccctgaaacatgggagggatttaatgtacatgtaaacactgagagggtctctatgtgcctatttttgcccactgtggatttgcaataatgcatcattatttgcagtgaaacatagtggcaggagtaggtgctagctacctgcttgccaaattggttaagtttccattactaagagccttatgaggaacagcggacagttttggctctgtagcttgtgcttagaatggctgtggagataagggcccaatgatggcaactggacaaaatgttctttaagtcaacatgaagctgatcagttatgtgctcagttctgatacctcagcttcacagcaacaggtgtatccaggaaacttcagaggaaagaggcagaaacctccaggaagcaatggagagggtttgagctcaatgagcaaagactcaagcctagacccaatgaaataccaataaatcatcattgaaacagagagttaggctcatgaacatcaaatgcctgagaacttttttcccttatgtatccttttaagcagtatctcattactcttctagggcccagtttgattgatatttatagagatactgttttagttcctttggggtactatagcaacatattataagtaaggtggcttataaatgacagaaatttatttctcacagttttgggggctggaaagtccatcaaggtaccggcagatatggcttctagtgagggctggtttccttgctcataggtgataccttcttgctgtagcctcacatgtggaaaagaggcaaggcagccttccggggcctcttttagaaggtcactaatcccatttctgagggctccactgtcatgacataaccacctcctacaggccctacctccttacaccattacattggtgattatgtttcaaaatatgaattggggagggacactaacatttacatcatagcagacactatattgcaagggtttctgtttttttccattgaaaaaaatctggaccttgaagtttacatctctgaccctttagttatctaagccagagccacagtttggcaggccagctggttgtgcagactcacagggtgccactgccatctgctgtacctaccaggggatgacagcaaccctcagagcagagatcccaaattagatgtgacactccttcccccatgaattagttagctagggatgccataaaaacataccacagacatagtggcttaaacaacagaaatttgctctccaaaatctaggtgttagaaacctcaggtttggtttatcctgaggcctctgtctttgccttgtagacggcactttctgttggattagggccctatccttatgaccccatttaaccttcattacctcttcaaagggccaatttccaaatatagtcaggcatattaggagttaggccttcaacatatgaatttgagggggatcacaattcagtccacatccaaatacacacacacgcacacacactccacgtgtgtcctggacacttgaaaatatctgtggggcacagattgaggatagatgcagctcactggcccatcagatgcctgtgggtaagaggcttcagggctgtattgctgccaggccagctccatactcactgccaccaggcaggaattcccgctcaagatctcctgctgtggtgtgatctgcctctagatgagtagcttctcaccaggataaaagctgaggtccctgctctagaggatgtggcttgaccttagaaccctatttgagtgggccaccttaacaacatactttcatatatttgttcatgaaaaggcagtgatacatcttgggagaaaaggctttctccaggaaagcaggcatctcgctgtgctgtctttgtggcagggctctctgctgtctcatctgtcaccagccatgcagagctttccttatggcctcccgtcttctattcccctctacttgttctcttttacactattctgtaaagaaagaaaatgtttggagattcctggtcgggtgtgccttttattataaatgtggctcttctgtctcacttcatcctcggtttttccccactgcagttggatgtccactcacagtgatagaatcaggaactgtcctcagtgctttattagcactgttcgatgtggcaattaaaaggaagccatgcagccacagaaaatattgctaatccatgttagcaaaaaaaaaaaaaaaaaaaaaaatcatcatgacttctcaatttttattacttctcaatttttattatgtattcttgtaaatcactggcttaatagttaaactaaaactaaatgttggtcctctagcaaatgggttcattttactaagtagtcattttctttgctaaaagagattcaatgtatttgcaaatgttgtttaatgatgaaatcatctggagagagacatggaatatcatttaaaaaataatatcctaagggacttattttgaaatcaatgcagaaaaatgaattcaagatgcttaaacttggagttagacacatgcacatttacaccaaccaagcacaaatgcatcaaaacctgtcctgaattcctcaaaatcaactggccttgggataaaagtcacaatcaatttattgaatctttcatttgaaaagaaaaccacaggaaattattcacttctctggggctaataattttctgttatttttgtttgatttttcttctaaagcctgctggcctacacttctgtgtattgaattccattctgtatgtttttatcatttctccagtttgtcaggatcattggatttgaatgcagttctttgagcacaatcgcgtactctcaaccatgggggagggtagacatgggagcagggaaaactatttccccttgaaaaaaatatttgtttcttcctgtctataaaggaatgcagaaagcatagacaatacagataaataaaaaaaggaaaattaaaataaccccataattctgagttctgatactcagttcaaattttggtatattatgtgcctgcctgcctgcctgccttcttaccttccttccttccttccttcctcccctcttcttttcttcctttcttcttatctatctattatctatctatctatctatctatctatctatctatctatctatcatctaactgcattcctcccatctgattgttagggccatatcatacattctgtttggtagtctgagctttctttcacgtttataaatcactcttcaaacataatctaagaggagacaattagaagttcagaaaaggtgccaagttcttgggtgccaggttgacagggagaattgtgagaagaatatgtttattttacttatctggcatcatactgaagcaatcaagtaaaatgtaacataatcttagtatcttactaatttatcttctctttataacatttgtcttatgaatttgatggtgactgactgaaaaaattttgtccatatctgccagtttcccactaaaccaaaacttggtatttattttgttatctctgaacaggatcacaaagcctgaagacccaggctttgcacgccactaatctctcactatgcctacagaatcctagtggggccaaggtgaaaaaggtgtcatctttcacctttccttcccattcccccctctgcccaaagcacagaagttactgcatttatttaatttaatatcgatttgttctgcttatgatttgttttgaactatgagttgtactgggttaaaaatgatggaaacctgcctactgctctatttcagcactttaattttataggcccagaaagattaaatgacttgcccaaagccactagctcattcatgaccttccgacattcaaatacagtacacactgattcactcaggatggaagaatagtaggagacaccatcaagatccacccctgtcttgttccctgctgtatccttagcatctaccaaatccccaacctagaagaggactcaggaagtatttgcaaaataaatgaatgaatcaattggatctccacaaacattccttgacctttatggaaactgccaaggaaatatgacatctcctcagaattcaatgtattcagagtaaatgaataagtaatttgaataaagcacctgtcattttctaaacaagagtaagaaagacatgctgccatgtataaaactaagtgatcaacacctgagacagatgctacatgcgaattttcctcctgtcaatcaaattcaagttcctattagtgaccacagcattctccaacagtgttacatgtaataattttcacataatctccccagattggtgagcaatggtttgtttttcagccttctattaaattgctccctcttgtgatcatctaacagaaaacacataagctatatttttaaatttggatgttcaggtcaaaactgagtctgattcttcaacattcacttcttattttctttcttttctaataatatcgcctccattattctatattgcttttcactcatacacatacacacacacacatactatgttcatcgttaaataaatctgatatttccaagtcaagaatatgaggggaaagaagctgattcattctctctcctctgttaattaagaacaatcagagctttgtttctacaacacaatatagaggtaacactattcagataagcaaaggagggcctttaactggggtgtaacaaaagaggtattttttatgcaaagaatatttctggcagggtaagttgaagttatccagcagatgaagaatactgatgttgttttaatagccttaataagaaagaaaccatgtgacttgaaggaggagaaagtagtgacatttacagaaatgaataaacaaaaaccttgattttgctgactctgcttcttccagtggtgcagacccccacagcctaccagcagtgggtgtcctggactagctacctcaccatctctctctaccttctcatggataatggcatgagaaagaaagcattcaagtagcagaaaagtggggtgatttttgcagcagaatgttgacatacacactcacaaaataaaatcactgggattctttagtcccatctccaaacaacaaatgagagcaagacaaaacgctggcacaggaaaatgaagtctctttaaaagccctccaaatcagagacatgctgagaagatgacattcaaagttagtctcttgacgaatgatgctggccggtgcccacttccttatgcccggttctgctttagttttagaagtggcatctcatagaaacagaaggctgtgttcagaggtctccttcttaacagcaggagggctaagaaacactagatctctaaggatggccaccaggtttgcggaatgaaaacatctgagcaaagcagcctacacctagctactgaaagagagccttggaaataagtgagctggaggcaaaccctcaatcctgtgtgacatttaaatgaggctgctctggcagaagatactcacggaggcctccgctatgactggttggcgttgtgtggcagggagtgaaagagaaacaaacttaaagctcacaggaggtgcggtttgtttaaataatagaaagtaattaggctgaagacaaaaatcagtgatggcattttataattacgattaatttaaagtttaatttcctttggtgctaaaatcttacttaaaacatttatcgggaaaggaaattaggacgttactatcaagaggcacagagtgcttctgggaatccatgcctattatcacttgaaaattaggttagggccaaagtgggaatttcaattcatttttgagtataataaatggtgaccagacctcagagtcagtggggttggcaggggcaggcagtgtaacatttgcatttgcttgtttgtttgtttgtttataggattaattgcaaatgttttcagcaaagagtgtagtttatacattaacaatcctgctacaaaatgaaaattggatatggattgctgcctttgtaactaatgaagctgatgttgaattcccaaatgtggcactgcaaagggaagcacacagtcacacatccatacaccttcaccactgaattaaacggaacaggggacagtatttctgttggctccaaacccgtcaccccgactgtcctatccaaggccccaactttttcatcattctgttttcccattcatgcctcagtttccaattgccattttcagcagctaatctttctggaaactcacttagtaaaatcaatgcataatagtaacaagcagatggaaataactcctttacactaatttttttcattcattatgcctttgtggatttgctcattttaaatattatattgctaacattcatatgtgaactaatcccagaaatatggaattgtgtataatcataaagttatgaacaatattagtggtcacctactgtaatcccccaattttacagttaaggaaagggacactcaaattgacttgctcaaagttaaacaatcatttagaggcagaactgggagcagaacatcgctgtcaagattcgaagtatactttccatgtcacttcactgtgatacctgagagagattcttgtaacaaataattattgagcaactactgggtggtaggctatttattgtcactagggataaagcagggaaccaaacaggtaccatctttgcctttatggcgcctacaatccagtgcacaatttacgagagaaagagaaattacagtaaatcttgatgaaagttcagacaaggaaaggggatggaggtgccatgggaatgattccaagaagaactcatgcagtttagaagagggaaagaaattcttccccgaagacatgatgattcagctgaaacctaagggataaattagaggactatgtagaacttaacaaagacaggcacgccttttttaaaaggtactacttttcggatccatattgaccaaaggtacaccgtaagtcacacaggaatgatcttaagttcttttaatgaactcgatataggaaatctagtttcagctttcccaaataccaataaaaatgttagagtaaccatgggacattctctttcctgaaattgctactgttgttctaagaagatgattaatttaggctcaggagttttgtgattttcatttctggaggctgtaaaatgatacaaagattatgttagcaaagattacaaggtaaagaatatttctctaataggtaattacagcacgcatgttttatttttttatttccctaaatatgcatatgttaatgtacccaaaaccctaattaaaactcctgcatttaaatgggctgttgattctaaatatattctggatgtcagctgagaagacatacccaatcatgtctaacgagctcacctatagcttgtaataactgctccttccaatttcatctgaaagacatgtcatatataattgaaagcaattctaacaggggagaacaaaacaaagactggaaaatctaatccatccaaatggcatggcacaaagtgagcccaggcacatttaagatgaagttggcttagttatttcaccataatcttcattacatgcttctctacatttactgaaagcatcaaaagatatcggattcataattttctgactctagctttacagtttctccaccctgttagttctcatctccctcatcaccactcccttcatctgccaccttcattcccttcatcgtggatcaccttcattatggtggaaagaggcttctctaagatgcccagttctgaaattttctgcctgaccataaacacctatctattctttttccttgttctactgcctccctcttggaaaaagttttcttcacccttatttggaagcttccctccacctgaacctatgtttttctcatgctttgggtcttcctactcattatctatctccagaattagcaaaagcaatggtgttctcattagcattcttgatttccttccttgcttgcacatcacttgtgcttagactttcaacatctgtgcctgacgatgcccagattcaatttctccacttctaatcctgggtggttgctcattgctggagaaagtaactaaacccgacagcaaatgtgtacttgctacactcagctgggtgttgtctcctgctcaaccatgcttcattcttctgcatttgacaaagtggcactctggccagaggacctgttccacacctttccaggatccttaaaccaagtactgatacctgagaaagtcaaatctatcaaatagaaacttgattttccctcaagaacctcgacaaatctctgtacaggcaattattcttttgtcttcttgcaaccctgcccaaatctgagaggaacaggtaagcttctcctctacaaagtaatccatccaccaagctttggcctatcattctgcctgatccaggacactgagctctcactgtcttcattcttgaccattcactggacagttccttttgcccacaaatgtggcaaagcctcatagaccacagacaaggccagccccaaattctttgtgttctttctgataatatacaaggccatttccaaaaggatttgaaatatggaaattcagttctatgtaattttttaaacatttaacttatttttttctacagtatgtcacacaggctgttcctgttgcttgtccaatcacagttaatcaactaagtgggcatctgaaggctctccatagacctccctctggtctcttcagcttccgtggatgtcttctacacttttgtcactctatataaaattttagtaaattctaatacaaagttctctcttttgagccttgtctccatctactctcctagccttggaaatgctaattatctgagtaaagagcctaaatgtgcattttgaagcataattccaatcattccttttgtataaatcctttttgaaaagagaggagatcccaatcctactcatagtgtatttttaatatatatacctctacgtattacacacatatgacacctgattctctcaataacccttcgaagctgaaattgcttgattatcctcactttacagaggaagaaattaaggctcagagcaattgtgacctgattataggtccaatgatggtaagaagtaaaggcacaacctgagcacaggtcttctgactccaaagccccccatcttgatgctaccaaacagattctacaacaatgtatcaagtagtggcattatgatatatcaagtactggcattatattattaaaagactacctgataacaagatccaggtctcagcagaaaaccatcatttgtttcttaaaatctcacctaaggcactgccctcactgagaattagcagatatgaacaagaacaacaatacaaaatagtttatcaagtgaaccttatatttcattttttattaggcctttagaaccaaaagcttaaagtgatttttcagctaacgatatactttatttattatgatactattatagctattgcttttcactttcattgtttagcacgtgtgaatgtgttaccaagcttaaaatattaaagatctgggggaggagccaagatggccgaacaggaacagctccggtctacagctcccagcgtgagcgacgcagaagacaggtgatttctgcatttccatctgaggtaccaggttcatctcactagggagtgccagacagtgggcgcaggtcagtgggtgcagcgcactgtgcgtgagccgaagcagggcgaggcattgcctcactcgggaagcgcaagggatcagggagttccctttcctagtcaaagaaaggggtgacagacggcacctggaaaatcggatcactcccacccgaatactgcacttttttaacgggcttaaaaaatggcgcaccaggagattatatgctgcacctggctccgagggtcctatgcccacggagtctcactgattgctagcacagcagtctgagatcaaactgcaaggcggcagcgaggctgggggaagggcgcccgccattgcccaggcttgcttaggtaaacaaagcagccgggaagctcgaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacgcagctggagatctgagaatgggcagaatgcctcctcaagtgggtccctgacccctgacccctgagcagcctaactgggaggcaccccccagtaggggcagactgacatctcacacggccgggtactcctctgagacaaaacttccagaggaacgatcagacagcggcattcgcggttcacaaaaaaccactgttctgcagacaccgctgctgacacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtacataaaaccacaaagatggggaaaaaacagagcagaaaaactggaaactctaaaaagcagagcatctctcctcctccaaaggatcgcagttcctcaccagcaatggaacaaagctggatggagaatgactttgacgagttgagagaagaaggcttcagatgatcaaactacgagctacaggaggaaattcaaaccaaaggcaaagaagttaaaaacattgaaaaaaatttagacgaatgtataactagaataaccaatacagagaagtgcttaaaggagctgatggagctgaaagccaaggcatgagaactacgtgaagaatgcagaagcctcaggagctgatgcaatcaactggaagaaagggtatcagcgatggaagatgaaatgaatgaaatgaagcaagaagggaagtttagagaaaaaagaataaaaagaaacgaacaaagcctccaagaaatatgggactatgtgaaaagactaaatctacgtctgattggtgtacctgaaagtgacggggagaacggaaccaagttggaaaacattctgcaggatattatccaggagaacttctccaatctagcaaggcaggccaacgttcagattcaggaaatacagagaacaccacaaagatactcctcgagaagagcaactccaagacatataattgtcagattcaccaaagttgaaatgaaggaaaaaatgttaagggcagccagagagaaagatcgggttacacacaaagggaagcccatcagactaacagcggatctcttggcagaaactctacaagccagaagagagtgagggccaatattcaacatacttaaagaaaagatttttcaacccagaatttcatatccagccaaactaagcttcataagtgaaggagaaataaaatactttacagacaagcaaatgctgagagattttgtcaccaccaggcctgcctaaaagagctcctgaaggaaacactaaacatggaaaggcacaaccggtaccagccactgcaaaatcatgccaaaatgtaaagaccatcgagactaggaagaaactgcatcaactaacgagcaagataaccagctaacatcataatgacaggttcaaattcacacataacaatattaactttaaatgtaaatggactaaatgctccaattaaaagacacagactggcaaattggataaagagtcaagacccatcagtgtgctgtattcaggaaacccatttcacatgcagagacacacataggctcaaaataaaaggatggaggaagatctaccaagcaaatggaaaacaaaaaaaggcaggggttgcaatcctagtctctgataaaacagactttaagccaacaaagatcaaaagagacaaagaaggccattacataatggtaaggggatcaattcaacaagaagagctaactatcctaaatatatatgcatccaatacaggaggacccagattcataaagcaagtcctgagtgacctacaaagagacttacactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcactacaccacacctattccaaaattgaccacatagttggaagtaaagcactcctcagcacatgtaaaagaacagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacatacaagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaataaagaaaaaaagagagaagaatcaaatagacacaataaaaaatgataaaggggatatcaccactgatcccacagaaatacaaactaccgtcagagaatactacaaacacctgtacacaaataaactagaaaatctagaagaaatggatgaattcctcgacacatacactctcccaagactaaaccaggaagaagttgaatctccgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcactttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaccaaagacaaaaaccacatgactatcttaatagatgcagaaaaggcctttgacaaaattcaacaacgcttcatgctaaaaactctcaataagttaggtattgatgggacgtatctcaaaataataggagctatctatgacaaacccacagccaatatcatactgaatgggcaaaaactggaagcattccctttgaaaactggcataagacagggatgccctctctcaccactcctattcaacatagtgttggaagttatggccagggcaattagacaggagaaggaaataaagggtattcaataggaaaagaggaagtcaaattgtccctgtttgcagatgatatgattgtatatctagaaaaccccattgtctctgcccaaactctccttaagctgataagcaacttcagcaaagtctcaggatacaaaatcaatgtacaaaatcacaagcattcttatacaccaataacagacaaacagagagccaaatcatgagtgaactcccattcacaattgcttcaaagagaataaaatacctgggaatctaccttacaagggacgtgaaggacctcttcaaggagaactacaacccactgctcaaggaaattaaagaggatacaaacaaatggaagaacattccatgctcatgggtaagaagaatcaatatggtgaaaatggccatactgcccaaggtaatttacagattcaatgccatccccatcaagctaccaatgcctttcttcacagaattggaaaaaaatactttaaagttcacatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatccgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgttggacctaaaaccataaaaaccctagaagaaaacctaggcattaccattcaggacataggcatgggcaaggacttcatgtctaaaacaccaaaagcaatggcaaccaaagccaaaattgacaaatgggatctaatgaaactaaagagcttctgcacagcaaaagaaactaccatcagagtgaacaggcaacccacaaaatgggagaaaattttcacaacctactcatctgacaaagggctaatatccagaatctacaataaactcaaacaaatttacaagaaaaaaacaaacaaccccatcaaaaagtgggcgaaggacatgaacaaacacttctcaaaagaagacatttatacaaccaaaaaacacatgaaaaaatgctcaccatcactggccatcagagaaatgcaaatcaaaaccacaatgagatatcatctcacaccagttagaatggcaatcattaaaaagtcaggaaacaacaggtgcttgagaggatgtggagaaataggaacactttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcattcgtaggtgggaattgaacaatgagaacacatggacacaggaaggggaacatcacactctgaggactgttgtggggtggggggagcgggaagggatagcattgggagatatacctaatgctagatgacaagttagtgggtgcagcacaccagcatgtcacatgtatacatgtcactaacctgcacattgtgcacgtgtaccctaaaacttaaagtataataataaaaataaacaaataaataaataaaaataaaatattaaagatttgtttctgatacaagtaagaagcaaactgaaaaataaggccctaaaaccctgagaaaacatatttgatgaacaagtttaggaagcgaagcatctgcggtgatttagctaataagtctcatttcattccatgtatgcttcgcctgctcaaagccttctgttgtataacactttagtgacctttcatgcaacaacaggctaaagtacgtcttcctataaaggattgcattttccttatcaggaaaaaaaaaaaaaaaaagctcagagtccctccagggattttagcccagactgaacacctcaagttcacacagtcagcttgaattcctgccaccaactagagcttagtggaagaaaagtgattcttttcaatttggcttatggttgggtatgttttacgttccttttgtattactggagctaagtacccttggaattcatacctatggaaataatggaaagacgctctattttcataggccctgttaatttcctttaatatttagaaaattcattgaaagacatcaaatactttagtgtctttcagtgagttattctaaatattcaggcttagcttcctatgaactgcctgttaaattttcccttcatggttttttacagctctgtctccaaaagggagtatgttgactagtggctttgtcattaataaccaagggacaattttatattacaatacctcattgccaacatgtatttaataaaacagttttaagtttgctgaactcagtgttcatgattaaaaggtttaaataaaagagaggctcacaacaggaaatatattgtcacaaagaatatttattcaaaaacttttttatcttacttggtaatttctaaattccactatcattaatgttactaaatcatagttattaaattgatatggcacttgactaacttaaaataattgcacctacaattattacagtacatccactgaccctacccataggtcaatagatgtaaacatacccacactgcagataagaaaatgaaggcaaaaagaaaatgcacttgcaaagaaaatgatagcattccaagttgtcttttggaggtgatggatatgttattaccttgattgtggtaaaggtttcacaggtatgcacatgtccaaacttatcaaattgcacacattaaatatgtgcagtgttttgcatatcaattatacctcagtatagctcttaaaaaaaaaatcctgagttgtcttcagagaaccaaaggcaaatccctccgacaaggcagagattaagaaagtacaattttttttcaccttctgtccagttgtgtgcctctgtttagggtcctataaactggccagaaggaaaacaaagttattcctacaattatcaagattggtaacactcgatagcattcatcaatgaatgaccgtctcactggagtccttttgatgcaaatgcatgtcctaacctctttctttccactcctcttggccaaaggggatgcagtggtgttttcttcctactggtatccaaaaagtttcttttgtgtatctcacagcacccagacaacaactctgtagattgtctataaaaagtcttctctttattatcattcaaggccttggcagtcagccaaatttcacttggaagttttactagcatcttctgtgctccaatcaattgccttattttcctttacagcctaaagggtctaagagtttatttggtaaatacctattgagtgtcttccgtgagccagacactgttctgggttctgaggctaatgtagtaaacagtagaaaacagtaaatctcatgtagcttgtattatagtagtggaggaaatcaacaaataaacaagcagatttatacatcaggtagaaataggttgcaatgaagcaaaataaagctgagtgaggagaaagaaattcatctctaacatcccagcaagtccccaatttcccttgcactaattagagttacatttcccttttcccaagcgtctcttcacttagatgtactacttataacttaaatactacatttccaaaagaaagccaaacaccaactcccttttgaccttttttttttctttaaaagcagcaatatgcccctggcaaacaaatttctgagaatcaactttgaaccttttcttttcctccctttcccccatgttcaaaaacttgccatgaactatgttttctacctctttgtccattcatctcaaattcattgacatctttccttcctcattctcctaattctaattcaggcttttagtaattcctgtctgtctttcacattttctgttaagcattgaaattacacagacaatatgccaagtcgcatgaaagaaaacatctctcataactttaaaaaaacatcgttgttatcagtcatacaagatggggatgagaatataaataattttcagaagaaaggactgcttaaatacttatttggtgtcctgcataaattatcagacatgaagcacatgaactaaatcttgaaggatgctaccctcttaaagatacattacaaaaaagccccgaaataccacattggcaactatcactggcaaattcagcaaaggtagtttctgataagttattgtttacatccaaatatttctacagtattagatcaaagaagaatctaatactgtagatccttacagtattagatgggaagaacataaagagcaaattttctagaaagaacagagtaaaagatgctggagaacaaataacagaaggaggaatctacaaccaataaggaactcaaagcaagaacttaagacttttgttaaattaataatttagaaagtacataaaaatgtgatttgatgcttttgatcactgttgataacgttccaaaaatgtactagaatggcatcagtcaaatgcagaaatatctttttcaatatacatacaaaggaaatagaatacctggtttctactctcatcctcagatgttgtgtgactcaagataaaactctataaatctgtactgatttgtaaaattaagataattattcctaccaatctcaaagtaattttgtgaagataaatgatatcacttgaaagggcttcaggaactattaagtattttgtaatttggggaatttagtttatttttaaggatataaggagattcttgatagatagaagttactcttttctaaataatgcagagataaactacgacccaaacatctagctgccatcaaaattacctggacaaagatctgtcaaatgttttatgacccttattgctcagagaagttttagaatatgcagtagtctctttagagcctgaataaatgtcattatataaaagaaactgaaaacagaaaaagatggtattatgggtatcttaaaaatgtaagctaaccccagtaattcaatttttgagaaggaaaaaatacctctacctctctatctacatggcaccccaaaaagttccatatgtggttgaagaacccttccataaaaggtgagaagaatcaagtctctctgtgctgacccccataatcttaactgtaatggttggttggatccagttgatgcctattcttctccctgaggtctttaggaagacatccaaacaatttctgagaagaagtgcacatggaaattgactgtacactgtctccttggctgtgaactcaagcatgtaggtaaaataaactacagaaaatatgccctctacttctgatttaaatttgaatgccccctcatgagtgaaatggtaaaaatccagcctggttacattcagagctgcttcttttctcatcttggttctgggtcaccctctgttggaacttcttccatacccaggccatcagcatggtccgaataatcagaatgatcacagtccttccatcagagctttagtgccgtcctccctaatctgagggttgtaagccatctctctctacctacacagcatacagatcatggttaataagagcaagccccaggccactcaagctccattcgcatcacaggctcaggacaccctcatttccctcctggccttttcttgtgtctttggaaggtctacatggcttctgactcaagctttgctgtccatttttggtcctaattctatccattggacttgaagattcatcttgttttcttcacattatcccttggttcacccgaagatctttggttcataattatcatctattttttttctgccatccctcctaaatccctgtaatcaagttaattaaatatttcaaaacaaactcaataataataacaacagcagcagcagcaataaaaatactaataaacctgagtttgacttggatctcaatttcagtggagaccttactgtttttgtctgccctgatcttgatctattgtaacccactctccaccaccatggtagagaccatcctactaagagggaagctcagagcagtgaagctctaactcggtaaatacctcttagaaaactagtccttaatttagtctcattgtcaacaagagcccatccagataaacaggaatttagacactatctgcaaaaaatccccagtcttaaactatatatatacatatatatatatatatgtatatatgtatatatatatgtgtatatatatgtatatatgtatatatttgagacggagtttccctcctgtcacccagctggagtgcaatggcatgatctctgctcattgaaacttctgcctctggtgttcaagcaatactcctgagcctcccgagtagctgggattacagacacgcaccaccatgcccagttaatttttgtatttttagtagagacggggtttcaccatgttggccaggctggtcttcaactgctgaccttaggtgacccatctgcctcagcctcccacagtgctgggattacaggcgtgagccacggcacccagccaataatttttttaagtgcaaactttaaatagagtcactgtgtaattattacacagttcttctggtactgtttatattagctaaggtacaatgtagaagacaaaagaggcaatgtagaagacaaaagaggatcacactcttttgatccatctcctgtaaaatacttgctatagttctatagttgtcccaaattaagaattttctgtcttctctttctgctatgctgcatggcttagaattataaagaaattttgaattttttgaggggctcttaattttcttcttttacaccatatgtctcatccaggactctacactctccttattttatcctcataccaattatatgcgataaatatgataactcctattttaagagatgttaagttgtttatccaaggtcacatagctggcaaagggaaaagcagaattaaaccctggtccttctaatatcagggtctctgtttttgtcattatgccattccactttggaagagaagagacattctgccttggtaaaagggtttcccatgcaaaaaagaaatgcagtatcaagccatgaaaagtcctggtggaatcttacatgcatattactaggtgaaagaagccagccagaaagggctacatgctatatgagtccagtgacatgacattctgtagaaggcaaaattataaagacagtaaaaagatcagtgattgccgggggttgggggaggaaaggatgattaggaggagcacaggggaattttagggcagcgaaactgttacggtactctaatggtagatacatgtcacgcatttatcaaaacccatagaatgtacaacaccaagaataaacattaatgtaaactatggactttggatgatgatgatgtgtcaatgtaggttcactgattgtaataaatgtaccattctagtgtaggctattcatagtggaggatgttgtgtttgtgtgggggcaggaaatatacaggaattatctgtactttctgctccatttttctgtgaacctaaaactgctctaaaaaaataaagtttttttctaagagaaaacaaaggatttccccactacacagacatcacggactttatgttactttgcaccctgctccagtttctatctgtagcaccccaaatattaataagagaataactagaaaaaagtaagccaatagaaggagatgctaggaaagaagtaatgggtgtcctagggcattttgattgtctctatttgactttctttctccttcctcttatcttgttggccttgtgttcttttgtttcttttatccccactctaaaacctctttattcacaaatgaaaaagaaaaaacaaaaactaaactttttcacagtacttttagaattgactgttccagttaccattgctgccaaaacttagtggtataaagcaaccatttattacgctcataggctctgtgggttaataactcagacaggcacagaggggatggcttgtctctgttctctgatgtcagaaacctgagctgaaaagattccaagactgagctgactcaacagtgagggtctagaatcatttaagggacacttgtttgacccacagcccacaggctacatgcagcccaggacagctttgaatacatcctaaaacaaatttgtaaattttcttaaaacattatgagattttttggcatttttttttttggctcaccagctatcgttagtatcagtgtattttatgtgtgacccaagacaattcttcttcttctaatgtggcccagggaagccaaaagactggacaccccgattgaaaggtattttatttcccacacctggatttggatgctggctatcagctgatacattagttatactgttactgaaacacttatccattggtccttcattgatctctccatgcgggctagcttgggcttccttgtggcatcatggctgtgttccaagagagaacatcccaaaagagcaagataaaagtgcatgacacttttatggtctgaccttagaagccccatagtgtcatttatagcatagtcaaagctgccagaaatgtctgcccatgttcaagaggaagagacatactcaaaccattgtatgggaggaaggtcaaagtcacattgtaaaaacatataaaataggagatactcttaccgccattttggaaaatataatctgccacagtaactcttattatatcttattgtatcttacattgctaagtatgtattgaatttgaatatttggttagactgttccacatgtttacctctgattgtttaagatggtaaaccacatttggcagggacagcaatgttgagttaatttacatgacctccaccatagtaccttgcgcttggtaaccataacatgtaatattattactagtgctgcaattgctcatagatacatgcacttgagtggtcattatttatatttatatgctgtaacattttgtagcatgtcacagaaaatctacactaaccaaaaaggcatatagcatctctattgtgtagatgaattctattactccaattaggtcttggttgtttgaaaatagtacatcattttttctaccaagtgaataaattcttgtaaggcaataattgaatcttacaatgagcagtgggggaggggggcagcggaatcactaccttgaaggaactatcatttcttccatttcttttttcttcacaattagttacttttagaagtttaatagattattactaataaaaggtttattagtaatctgtgtgggtgcttgatcatggatgtatatctcttctgaaaagctaattaatgaattgtcccttttcagttgatttcataggtggctttgactcttatggctatcaagggcctcagaagacatctcatttacaactacagcctatgtacatgtaagtattttacttggaaggtactcttctggggtactaaagataatcaagtaactgtatcacgatacaaaattgatggcatgcagcttttgttcagttatatttttccagtattttttctattaatattgtcttggctgggataattttaataacatttttccatgaatttttcttatttgacttataagaaatgccatttctaaagttatatttagtcttacataagtatcacctacatggctcaaaagcctatgttaattatctaccacttctttgagttgccaaaaagttgtattttttgaaaatgatataatgtaggcagttatatataattatatataaaccatatgttctggtttcagtttacagtggttgtcctggcataattattactctcaaaagagttctcatttagatgataaataataggttcaccctagttatatgtagtgttaagaaaataaaaaactgagtaatacactttctctatcatttttctgatgtaaaagtgaaaatgaactggaacattaacactgaaatttatcgaacccttaactctagcactcaggagagcagacatacaatcagagcctgatttttatatctgtgtttaggcaaattcccttggataacaactgataacaaattctatatatcagcatcaagtgatatgctgaattgcaagcgaagatcaaaatagaaagtaagattccaattcattttaaaatgtgaacttctctttgaagatatgtgtttgttgtcgttgtcctccaccattgaatcattttaccttttaatatctttagtgtgtaggataataaatggagtttgggagtaagtattgctcctccaaagaaattaatctttaaacatcccctttttaagcttctctttaaaaaaagaataatcttgcaccgtgcctgcctttttctttgtgtcacttgtagttctctgaaatcatttgctaatagcacccataaaacagactttagcagttcagaaatcaaccagtatgttgcttcattcaaagcattgcttctgtaaacactgtattacacatttcctcttttacatcctcacaacgactgcactaattcatgcaagtatgacctgttaagtttttcggtctcttccttatttcagaacctccattgtatcctccatatggctgccaaattaatcttcctaaagtactgcgctgatgatttcacttccctacttcaaagctatcaaggagtccctattacctactgttgaaacagtatctcttctcttcaactcttaataatgtttgagtcccaaccatatgcagatgacactggagatattaggaaaatgtagtaatgaataagaactagccctgtcctcctgaagtttataatctattgagagcataaacagtctgatagctccccttagccatttttttcttgccttatccaaatatgatatgtatttttccaattcatgctgttctcttgacaacaaacatcatcttttttccaaattccactctttgaaaccccactatcctttgaattttcttaagatatattcctttatgaaacatttgttaatcttttctcctctaatatttcttttatttctttccccatgtactacagttgtttgctatgcatgccataccttccttccctatccccccagaaagattcttgatagctacaacaacaaaacatgatcaatccttcacactctttaccattcttctcaatattttatgtaacattctataaagtgttctatttaaaaaggcaatcaggactagtggttaagacgacctactgaaggcatactgtctgagattaaattccctccgaccgtgggcatgtaactttgtttgaataactctatttaattttaccaagcctaagtttcctcacctgcaaaatagagatcgcatacagactttatctgattgctctgaaattatatgaaagaatatatataaagcacatgaaacgtaggatatgtcacatagtaagtgcttaataaacataattcattagtggtagaataatgcttgtgttaatcaacatcactcatgaaaaggctgtatcaagtcagaagtaacatacactgcaagtcattcctaaaagatctcctctgtaaatggtatattatatataacagcggtcccctgggccgtgaatagtcctggcccatggtctgttaggagctgagcacagagcaggaggtgagcagcaggtgagggaacattactgcctaagctctgcctcctgtctgataagcagcagtattagattctcatagcagtgtgaaccttattgtgaactgcatgtgtgagggatctaggttttgtgatccttatgagaatctaatgcctgatgatctgaggtggaacagtttcatcctgaaaccattccccccaaccctggtctatgggaaaattgtcttccacaaaaccagtctctggtaccaaaaaggttgaggactgctgacatataacatcagctcaagtaacatgtaatactatatttatgctcaagagtagaatatggctaggcacagtgattcatgcctgtaatcctagcactttgggaggccgagacaggtggatcacctgaggtcaggagttcgagagcagcctggccaacatggcgaaactccatctctactaaaaatacaaaaattagccaggcatggtggtgcacgcctgtaatcccagttactcgggaggctgaggcaggagaatctctggaacctgggaggtggaggttgcagtgagcaaagatcgtgccactgcactccagcctggttaacaaagtgaggctctgtctcaaaaaaaaaaaaaaaggagaataaaatatctacaaggtttgtaattgcttgctactaataatattacataatattttactgtattggccaatatgagtgaccaataaatatgatcaagctgtaataaattagaggtaatctctcatctaaagataaacatgagaatgctaattatatacaatttaatatattaaattcaaatcaagcatttataattctaatgggctttaaagaagagactctacaaagatagatatctttgtccagaattaaattgcataaggacaaaacttatgattttgttaaacagagcactttaaatgccaactaaaagttataaaaaatatattgttttcctctttactgcatgagagtggtaaaattgtatcagagatttcaagtctcactggtcatgaaataagtaaatgtttaatggaattcaaatttaggaagttatgtatacttaaggtacatttaaaaattactagtcaaaatactccaatcattccttccacaaaacatcccataggagacctcggatcctagaacagtaaggttttattttacagacgaggaaactcaacccaataaaaggaaaacaaaagtcacacaacttgttactggtgcagccatgattatcaacgggttttcctgaccccttcagttagtgttctttccaaattcttagacagactgtgagtttgacctggtattacattctgatttttaatttgcttgtttgtattcttaacactaacttagctgccacatttccatacatggctgtgcctctctcccttttctgcattctgtttatttcttttttattttacattacgcactgttaaatgaagggccttttcaacttcatagcccacaagaccaatcatctgagagccactgcttattcaaatctagtgaaaaaccaaaactgacacacctataaacctcatcccctactgagaggcagagaacttagcatctcctatgtctttatcatttagagtgtaccttctgtcaacctgccataaatatgtcttgtaaagtaagagtaatttaacttcaggggccagtccaaacaccctaaaaatattatatagcaaatggaaacacaagctcttccttggaaggaaaacaaatgttgaaaagcaataggcatttttagctgtggggctcccactgttcccagcaaatcttctgtggccaagatcctggacaaagctttgaaaacactgctgtaactgacctacagtcacagctgtgtttcagttcctgcaaacaatgaatagacagtcctcttaagttgggtgactgttcttggtttgtaatttttcagatgatgtataactaacctaaaaaggaaagattttaattatatttttcttaaagtttggtacatgttgttgaaacaaatcaataacaacaaagttgctgcacaaaaaaaatcccatgtctgcgtgctccagccccggcaacagagctagactttgtctaaaaaaaaaaaatcccgtgtctacagcttaagtttttaacaaaatagctgctttgactaccagagacctatgtgactgtcagagcaagtagagatctgattgggcttccagcaatataagaatatcctataatatatcacacaacatttgtaaacattgcattctttttggcagcctaattgtacagaagtacatattcatttcagttgtccctggaaatagattctaaatgaccaaaactggcctctctatccctgcaattgccatgaataaaaagaaaaggaggaaaattatctatttaaaacccaatttgggcttcttttttgtttgtttgtttgtttgctcttgtgcttggaaaggtgagaaaaggtggtgagcagcaggcacctgtcactttcccccttgactaaaaacatcttttctctctctcaggtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaa

SEQ ID NO: 1249 - DNA, 1021718 bp, Homo sapiens; identical to SEQ ID NO: 1248
